(12) United States Patent
Gradinaru et al.

(10) Patent No.: US 11,149,256 B2
(45) Date of Patent: Oct. 19, 2021

(54) ADENO-ASSOCIATED VIRUS COMPOSITIONS FOR TARGETED GENE THERAPY

(71) Applicant: California Institute of Technology, Pasadena, CA (US)

(72) Inventors: Viviana Gradinaru, La Canada Flintridge, CA (US); Nicholas C. Flytzanis, San Gabriel, CA (US); Nicholas Goeden, Manhattan Beach, CA (US)

(73) Assignee: California Institute of Technology, Pasadena, CA (US)

( * ) Notice: Subject to any disclaimer, the term of this patent is extended or adjusted under 35 U.S.C. 154(b) by 0 days.

(21) Appl. No.: 16/582,635

(22) Filed: Sep. 25, 2019

(65) Prior Publication Data

US 2020/0165576 A1      May 28, 2020

Related U.S. Application Data

(60) Provisional application No. 62/736,904, filed on Sep. 26, 2018, provisional application No. 62/832,812, filed on Apr. 11, 2019.

(51) Int. Cl.
*C12N 7/00* (2006.01)

(52) U.S. Cl.
CPC ...... *C12N 7/00* (2013.01); *C12N 2750/14071* (2013.01); *C12N 2750/14121* (2013.01); *C12N 2750/14122* (2013.01)

(58) Field of Classification Search
None
See application file for complete search history.

(56) References Cited

U.S. PATENT DOCUMENTS

| 5,919,676 A | 7/1999 | Graham et al. |
| 6,228,646 B1 | 5/2001 | Hardy |

(Continued)

FOREIGN PATENT DOCUMENTS

| EP | 1290205 A2 | 3/2003 |
| EP | 3561062 A1 | 10/2019 |

(Continued)

OTHER PUBLICATIONS

Venkatakrishnan et al., "Structure and Dynamics of Adeno-Associated Virus Serotype 1 VP1-Unique N-Terminal Domain and Its Role in Capsid Trafficking," Journal of Virology, vol. 87: No. 9: 4974-4984 (Year: 2013).*

(Continued)

*Primary Examiner* — M Franco G Salvoza
(74) *Attorney, Agent, or Firm* — Brown Rudnick LLP

(57) ABSTRACT

Described herein are compositions and kits comprising recombinant adeno-associated viruses (rAAVs) with tropisms showing increased specificity and efficiency of viral transduction in targeted cell-types, for e.g., the brain, and lung. The rAAV compositions described herein also have tropisms showing decreased specificity and decreased efficiency of viral transduction in an off-target cell type, for e.g., the liver. The rAAV compositions described herein encapsidate a transgene, such a therapeutic nucleic acid. Upon systemic delivery to a subject, the rAAV is capable of increased specificity and increased transduction of the transgene in a target cell-type, as compared to a parental or reference AAV.

25 Claims, 211 Drawing Sheets

Specification includes a Sequence Listing.

(56) References Cited

U.S. PATENT DOCUMENTS

| | | | |
|---|---|---|---|
| 6,274,354 | B1 | 8/2001 | Wilson et al. |
| 6,379,943 | B1 | 4/2002 | Graham et al. |
| 6,410,271 | B1 | 6/2002 | Zhu et al. |
| 6,566,118 | B1 | 5/2003 | Atkinson et al. |
| 9,018,138 | B2 | 4/2015 | Lupold et al. |
| 9,585,971 | B2 * | 3/2017 | Deverman ......... A61K 38/1709 |
| 9,957,303 | B2 | 5/2018 | Deverman et al. |
| 10,202,425 | B2 | 2/2019 | Deverman et al. |
| 10,287,607 | B2 | 5/2019 | Tagliatela et al. |
| 10,287,608 | B2 | 5/2019 | Tagliatela et al. |
| 10,301,360 | B2 | 5/2019 | Deverman et al. |
| 10,519,198 | B2 | 12/2019 | Deverman et al. |
| 10,519,465 | B2 | 12/2019 | Tagliatela et al. |
| 2002/0058325 | A1 | 5/2002 | Hardy |
| 2005/0287122 | A1 * | 12/2005 | Bartlett .................... C12N 9/93 424/93.2 |
| 2007/0036760 | A1 | 2/2007 | Wilson et al. |
| 2007/0172460 | A1 | 7/2007 | Kleinschmidt et al. |
| 2007/0243526 | A1 * | 10/2007 | Kay .................... C12N 15/1082 435/5 |
| 2009/0042257 | A1 | 2/2009 | Rodriguez et al. |
| 2009/0093403 | A1 | 4/2009 | Zhang et al. |
| 2009/0202490 | A1 | 8/2009 | Schaffer et al. |
| 2009/0215879 | A1 | 8/2009 | Diprimio et al. |
| 2010/0105123 | A2 | 4/2010 | Hallek et al. |
| 2011/0105998 | A1 | 5/2011 | Zhang et al. |
| 2011/0223635 | A1 | 9/2011 | Deisseroth et al. |
| 2011/0301529 | A1 | 12/2011 | Zhang et al. |
| 2013/0019325 | A1 | 1/2013 | Deisseroth et al. |
| 2013/0059732 | A1 | 3/2013 | Lisowski et al. |
| 2013/0089503 | A1 | 4/2013 | Deisseroth et al. |
| 2013/0090454 | A1 | 4/2013 | Deisseroth et al. |
| 2013/0142764 | A1 | 6/2013 | Davidson et al. |
| 2013/0195801 | A1 | 8/2013 | Gao et al. |
| 2013/0244323 | A1 | 9/2013 | Deisseroth et al. |
| 2014/0024701 | A1 | 1/2014 | Deisseroth et al. |
| 2014/0030192 | A1 | 1/2014 | Deisseroth et al. |
| 2014/0113367 | A1 | 4/2014 | Deisseroth et al. |
| 2014/0358067 | A1 | 12/2014 | Deisseroth et al. |
| 2015/0079038 | A1 | 3/2015 | Deverman et al. |
| 2015/0087001 | A1 | 3/2015 | Gradinaru et al. |
| 2015/0297719 | A1 | 10/2015 | Deisseroth et al. |
| 2015/0315612 | A1 | 11/2015 | Wilson et al. |
| 2016/0038761 | A1 | 2/2016 | Deisseroth et al. |
| 2016/0123854 | A1 | 5/2016 | Gradinaru et al. |
| 2016/0175607 | A1 | 6/2016 | Deisseroth et al. |
| 2016/0287895 | A1 | 10/2016 | Deisseroth et al. |
| 2016/0290899 | A1 | 10/2016 | Deisseroth et al. |
| 2017/0066806 | A1 | 3/2017 | Deisseroth et al. |
| 2017/0067908 | A1 | 3/2017 | Nakai et al. |
| 2017/0143986 | A1 | 5/2017 | Deisseroth et al. |
| 2017/0166926 | A1 | 6/2017 | Deverman et al. |
| 2017/0198017 | A1 | 7/2017 | Deisseroth et al. |
| 2017/0199104 | A1 | 7/2017 | Gradinaru et al. |
| 2017/0204144 | A1 | 7/2017 | Deverman et al. |
| 2017/0240885 | A1 | 8/2017 | Deverman et al. |
| 2018/0044388 | A1 | 2/2018 | Deisseroth et al. |
| 2018/0050219 | A1 | 2/2018 | Deisseroth et al. |
| 2018/0230186 | A1 | 8/2018 | Deverman et al. |
| 2018/0230489 | A1 | 8/2018 | Kotin |
| 2018/0244737 | A1 | 8/2018 | Deisseroth et al. |
| 2018/0311506 | A1 | 11/2018 | Deisseroth et al. |
| 2018/0371496 | A1 * | 12/2018 | Li ........................ C07K 14/005 |
| 2019/0048041 | A1 | 2/2019 | Asokan et al. |
| 2019/0055578 | A1 | 2/2019 | Sah et al. |
| 2019/0071476 | A1 | 3/2019 | Deisseroth et al. |
| 2019/0144509 | A1 | 5/2019 | Deverman et al. |
| 2019/0224493 | A1 | 7/2019 | Deisseroth et al. |
| 2019/0257724 | A1 | 8/2019 | Deisseroth et al. |
| 2019/0292230 | A1 | 9/2019 | Deverman et al. |
| 2019/0336784 | A1 | 11/2019 | Deisseroth et al. |
| 2020/0087353 | A1 | 3/2020 | Deverman et al. |
| 2020/0087358 | A1 | 3/2020 | Gradinaru et al. |
| 2020/0165576 | A1 | 5/2020 | Gradinaru et al. |

FOREIGN PATENT DOCUMENTS

| | | | |
|---|---|---|---|
| JP | 2014/518614 | A | 8/2014 |
| RU | 2457252 | C2 | 7/2012 |
| WO | 98/09657 | A2 | 3/1998 |
| WO | 2001/092551 | A2 | 12/2001 |
| WO | 2005/017101 | A2 | 2/2005 |
| WO | 2008/103993 | A2 | 8/2008 |
| WO | 2009/012176 | A2 | 1/2009 |
| WO | 2012/145601 | A2 | 10/2012 |
| WO | 2014/052789 | A1 | 4/2014 |
| WO | 2014/186579 | A1 | 11/2014 |
| WO | 2015/040002 | A1 | 3/2015 |
| WO | 2015/127128 | A2 | 8/2015 |
| WO | 2015/168666 | A2 | 11/2015 |
| WO | 2016/065001 | A1 | 4/2016 |
| WO | 2016/081811 | A1 | 5/2016 |
| WO | 2016/154344 | A1 | 9/2016 |
| WO | 2017/100671 | A1 | 6/2017 |
| WO | 2017/136202 | A1 | 8/2017 |
| WO | 2017/143100 | A1 | 8/2017 |
| WO | 2017/192750 | A1 | 11/2017 |
| WO | 2017/197355 | A2 | 11/2017 |
| WO | 2017/218842 | A1 | 12/2017 |
| WO | 2018/022905 | A2 | 2/2018 |
| WO | 2018/045347 | A1 | 3/2018 |
| WO | 2018/071831 | A1 | 4/2018 |
| WO | 2018/085688 | A1 | 5/2018 |
| WO | 2018/119330 | A2 | 6/2018 |
| WO | 2018/152333 | A1 | 8/2018 |
| WO | WO-2018204786 | A1 * | 11/2018 ......... A01K 67/0278 |
| WO | 2018/222503 | A1 | 12/2018 |
| WO | 2019/006182 | A1 | 1/2019 |
| WO | 2019/028306 | A2 | 2/2019 |
| WO | 2019/046069 | A1 | 3/2019 |
| WO | 2019/060454 | A2 | 3/2019 |
| WO | 2019/104279 | A1 | 5/2019 |
| WO | 2019/191701 | A1 | 10/2019 |
| WO | 2019/207132 | A1 | 10/2019 |
| WO | 2019/222329 | A1 | 11/2019 |
| WO | 2019/222441 | A1 | 11/2019 |
| WO | 2019/222444 | A2 | 11/2019 |
| WO | 2020/028751 | A2 | 2/2020 |
| WO | 2020/077165 | A1 | 4/2020 |
| WO | 2020/198737 | A1 | 10/2020 |
| WO | 2020/206189 | A1 | 10/2020 |
| WO | 2020/210633 | A1 | 10/2020 |
| WO | 2020/210655 | A1 | 10/2020 |
| WO | 2020/219988 | A2 | 10/2020 |
| WO | 2020/243651 | A1 | 12/2020 |

OTHER PUBLICATIONS

Buning et al., "Capsid Modifications for Targeting and Improving the Efficacy of AAV Vectors", Molecular Therapy: Methods & Clinical Development, vol. 12: 248-265 (Year: 2019).*

DiMattia et al., "Structural Insight into the Unique Properties of Adeno-Associated Virus Serotype-9", Journal of Virology, vol. 86, No. 12: 6947-6958 (Year: 2012).*

Wang et al., "A Rationally Engineered Capsid Variant of AAV9 for Systemic CNS-Directed and Peripheral Tissue-Detargeted Gene Delivery in Neonates," Molecular Therapy: Methods & Clinical Development, vol. 9: 234-246 (Year: 2018).*

Gibson, 2009, Enzymatic assembly of DNA molecules up to several hundred kilobases, Nature Methods, 6(5):343-345.

Gray, 2009, Directed Evolution of a Novel Adena-associated Virus (AAV) Vector That Crosses the Seizure-compromised Blood-Brain Barrier (BBB), Molecular therapy : The Journal of the American Society of Gene Therapy, 18:570-578.

Gray, 2011, Preclinical Differences of Intravascular AAV9 Delivery to Neurons and Glia: A Comparative Study of Adult Mice and Nonhuman Primates, Molecular therapy : The Journal of the American Society of Gene Therapy, 19:1058-1069.

Gray, 2011, Production of recombinant adeno-associated viral vectors and use in in vitro and in vivo administration, Current Protocols in Neuroscience / Editorial Board, Jacqueline N. Crawley . . . [Et Al.], Chapter 4, Unit 4.17, pp. 4.17.1-4.17.30.

(56) References Cited

OTHER PUBLICATIONS

Grieger, 2006, Production and characterization of adeno-associated viral vectors, Nature Protocols, 1(3):1412-1428.
Grimm, 2008, In vitro and in vivo gene therapy vector evolution via multispecies interbreeding and retargeting of adeno-associated viruses, Journal of virology, 82(12):5887-5911.
Groth, 2000, A phage integrase directs efficient site-specific integration in human cells, PNAS, 97(11):5995-6000.
Guenthner, 2013, Permanent genetic access to transiently active neurons via TRAP: targeted recombination in active populations, Neuron, 78:773-784.
Hancock, 1991, A CAAX or a CAAL motif and a second signal are sufficient for plasma membrane targeting of ras proteins, EMBO J., 10:4033-4039.
Handbook of Pharmaceutical Additives, 3rd Edition; Ash and Ash Eds., Gower Publishing Company: 2007.
Handbook of Pharmaceutical Excipients, 5th Edition; Rowe et al., Eds., The Pharmaceutical Press and the American Pharmaceutical Association: 2005.
High, 2014, Current status of haemophilia gene therapy, Haemophilia: the official journal of the World Federation of Hemophilia, 20 Suppl. 4, pp. 43-49.
Hirt, 1967, Selective extraction of polyoma DNA from infected mouse cell cultures, Journal of Molecular Biology, 26(2):365-369.
Huser, 2002, Kinetics and Frequency of Adeno-Associated Virus Site-Specific Integration into Human Chromosome 19 Monitored by Quantitative Real-Time PCR, J. Virol., 76(15):7554-7559.
Hutson, 2012, Corticospinal tract transduction: a comparison of seven adeno-associated viral vector serotypes and a non-integrating lentiviral vector, Gene therapy, 19:49-60.
Inagaki, 2006, Robust systemic transduction with AAV9 vectors in mice: efficient global cardiac gene transfer superior to that of AAV8, Molecular therapy : The Journal of the American Society of Gene Therapy, 14:45-53.
Inagaki, 2008, Frequency and spectrum of genomic integration of recombinant adeno-associated virus serotype 8 vector in neonatal mouse liver, J Virol, 82:9513-9524.
Izpisua Belmonte, 2015, Brains, genes, and primates, Neuron, 86:617-631.
Kaeppel, 2013, A largely random AAV integration profile after LPLD gene therapy, Nat Med, 19:889-891.
Kaplitt, 1994, Long-term gene expression and phenotypic correction using adeno-associated virus vectors in the mammalian brain, Nature, 8:148-154.
Kaplitt, 2007, Safety and tolerability of gene therapy with an adeno-associated virus (AAV) borne GAD gene for Parkinson's disease: an open label, phase I trial, Lancet, 369:2097-2105.
Kawashima, 2013, Functional labeling of neurons and their projections using the synthetic activity-dependent promoter E-SARE, Nat Methods, 10889-895.
Kessler, 1996, Gene delivery to skeletal muscle results in sustained expression and systemic delivery of a therapeutic protein, Proceedings of the National Academy of Sciences USA, 93:14082-14087.
Knipe, 2007, Fields of virology, edition (2006), Section 57, vol. II (Lippincott Williams & Wilkins), pp. 2107-2185.
Koerber, 2008, DNA Shuffling of Adeno-associated Virus Yields Functionally Diverse Viral Progeny, Mol Ther, 16(10):1703-1709.
Koerber, 2009, Molecular Evolution of Adeno-associated Virus for Enhanced Glial Gene Delivery, Mol Ther, 7(12)2088-2095.
Koerber. 2006, Construction of diverse adeno-associated viral libraries for directed evolution of enhanced gene delivery vehicles, Nature protocols, 1:701-706.
Levitt, 1989, Definition of an efficient synthetic poly(A) site, Genes and Development, 3:1019-1025.
Limberis, 2013, Intranasal antibody gene transfer in mice and ferrets elicits broad protection against pandemic influenza, Sci Transl Med, 5(187):187ra72, 10 pages.
Lisowski, 2014, Selection and evaluation of clinically relevant AAV variants in a xenograft liver model, Nature, 506:382-386.
Luo, 2008, Genetic dissection of neural circuits, Neuron, 57:634-660.
Löw, 2013, Direct and retrograde transduction of nigral neurons with AAV6, 8, and 9 and intraneuronal persistence of viral particles, Human gene therapy, 24:613-629.
Maguire, 2008, Safety and efficacy of gene transfer for Leber's congentital amaurosis, N. Engl J Med, 358:2240-2248.
Maguire, 2010, Directed evolution of adeno-associated virus for glioma cell transduction, Journal of neuro-oncology, 96(3):337-347.
Maguire, 2014, Gene therapy for the nervous system: challenges and new strategies, Neurotherapeutics, 11:817-839.
Maheshri, 2006, Directed evolution of adeno-associated virus yields enhanced gene delivery vectors, Nature biotechnology, 24(2):198-204.
Marshel, 2010, Targeting single neuronal networks for gene expression and cell labeling in vivo, Neuron, 67:562-574.
Martino, 2011, The genome of self-complementary adeno-associated viral vectors increases Toll-like receptor 9-dependent innate immune responses in the liver, Blood, 117:6459-6468.
Mcbride, 2011, Preclinical safety of RNAi-mediated HTT suppression in the rhesus macaque as a potential therapy for Huntington 's disease, Molecular Therapy : the Journal of the American Society of Gene Therapy, 19:2152-2162.
McCarty, 2008, Self-complementary AAV vectors; advances and applications, Molecular Therapy: The Journal of the American Society of Gene Therapy, 16:1648-1656.
Mich, 2019, Epignetic landscape and AAV targeting of human neocortical cell classes, bioRxiv.org, 17 pages.
Michelfelder, 2011, Peptime Ligands Incorporated into the Threefold Spike Capsid Domain to Re-Direct Gene Transduction of AAV8 and AAV( In Vivo, PLoS One, 6(8), e23101, 11 pages.
Mittermeyer, 2012, Long-term evaluation of a phase 1 study of AADC gene therapy for Parkinson's disease, Hum Gene Ther, 23:377-381.
Mori, 2004, Two novel adeno-associated viruses from cynomolgus monkey: pseudotyping characterization of capsid protein, Virology, 330(2):375-83.
Muller, 2003, Random peptide libraries displayed on adeno-associated virus to select for targeted gene therapy vectors, Nat Biotechnol, 21:1040-1046.
Nathwani, 2011, Adenovirus-associated virus vector-mediated gene transfer in hemophilia B, The New England Journal of Medicine, 365(25):2357-2365.
Nathwani, 2011, Long-term safety and efficacy following systemic administration of a self-complementary AAV vector encoding human FIX pseudotyped with serotype 5 and 8 capsid proteins, Molecular therapy : The Journal of the American Society of Gene Therapy, 19:876-885.
National Institute of Health. Advisory Committee to the Director, Interim Report: Brain Research Through Advancing Innovation Neurotechnologies (BRAIN) Working Group, Sep. 16, 2013, pp. 1-58.
Nowrouzi, 2012, Integration frequency and intermolecular recombination of rAAV vectors in non-human primate skeletal muscle and liver, Mol Ther, 20:1177-1186.
Ojala, 2015, Adena-associated virus vectors and neurological gene therapy, Neuroscientist, 21:84-98.
Osakada, 2011, New rabies virus variants for monitoring and manipulating activity and gene expression in defined neural circuits, Neuron, 71:617-631.
Pasca, 2015, Functional cortical neurons and astrocytes from human pluripotent stem cells in 3D culture, Nature methods, 12:671-678.
Perdomini, 2014, Prevention and reversal of severe mitochondrial cardiomyopathy by gene therapy in a mouse model of Friedreich's ataxia, Nat. Med., 20:542-547.
Pharmaceutical Preformulation and Formulation, Gibson Ed., CRC Press LLC: Boca Raton, FL, 2004.
Pulicherla, 2011, Engineering Liver-detargeted AAV9 Vectors for Cardiac and Musculoskeletal Gene Transfer, Molecular Therapy: the Journal of the American Society of Gene Therapy, 19:1070-1078.
Qiu, 2002, Characterization of the Transcription Profile of Adena-Associated Virus Type 5 Reveals a Number of Unique Features

(56) References Cited

OTHER PUBLICATIONS

Compared to Previously Characterized Adena-Associated Viruses, Journal of Virology, 76(24):12435-12447.
Remington: The Science and Practice of Pharmacy, 21st Edition; Lippincott Williams & Wilkins: Philadelphia, PA, 2005.
Salegio, 2013, Axonal transport of adeno-associated viral vectors is serotype-dependent, Gene Ther, 20:348-352.
Samaranch, 2011, AAV9 Transduction in the Central Nervous System of Non-Human Primates, Human gene therapy, 22:329-337.
Samaranch, 2012, Adena-associated virus serotype 9 transduction in the central nervous system of nonhuman primates, Hum Gene Ther, 23:382-389.
Sambrook, 1989, Molecular Cloning: A Laboratory Manual, 2nd Ed., Cold Spring Harbor Laboratory Press, Cold Spring Harbor, N.Y., 39 pages.
Savitt, 2005, Bcl-x Is Required for Proper Development of the Mouse Substantia Nigra, The Journal of Neuroscience, 25:6721-6728.
Schaffer, 2008, Molecular Engineering of Viral Gene Delivery Vehicles, Annual Review of Biomedical Engineering, 10:169-194.
Schnepp, 2002, Highly purified recombinant adeno-associated virus vectors. Preparation and quantification, Methods Mol. Med., 69:427-43.
Schuster, 2014, Biodistribution of adeno-associated virus serotype 9 (AAV9) vector after intrathecal and intravenous delivery in mouse, Front Neuroanat, 8(42) 14 pages.
Seo, 2020, Positron emission tomography imaging of novel AAV capsids maps rapid brain accumulation, Nat Commun, 11:2102.
Shaner, 2013, A bright monomeric green fluorescent protein derived from Branchiostoma lanceolatum, Nat Methods, 10(5):407-409.
Simonelli, 2009, Gene Therapy for Leber's Congenital Amaurosis is Safe and Effective Through 1.5 Years After Vector Administration, Molecular Therapy : The Journal of the American Society of Gene Therapy, 18(3):643-650.
Singer, 1998, Genes and Genomes, A changing Perspective, 1, p. 63.
Smith, 1990, The neural network of the basal ganglia as revealed by the study of synaptic connections of identified neurones, Trends Neurosci, 13:259-265.
Sonntag, 2010, A viral assembly factor promotes AAV2 capsid formation in the nucleolus, Proceedings of the National Academy of Sciences of the United States of America, 107:10220-10225.
Southwell, 2009, Intrabody gene therapy ameliorates motor, cognitive, and neuropathological symptoms in multiple mouse models of Huntington's disease, The Journal of Neuroscience : The Official Journal of the Society for Neuroscience, 29(43):13589-13602.
Srivastava, 1983, Nucleotide sequence and organization of the adeno-associated virus 2 genome, J Virol., 45(2):555-64.
Tang, 2008, Role of omithine decarboxylase antizyme inhibitor in vivo, Genes to Cells, 14(1):79-87.
Tomer, 2014, Advanced CLARITY for rapid and high-resolution imaging of intact tissues, Nat Protoc, 9:1682-1697.
Valori, 2010, Systemic delivery of scAAV9 expressing SMN prolongs survival in a model of spinal muscular atrophy, Sci Transl Med, 2(35):35ra42, 9 pages.
Van der Marel, 2011, Neutralizing antibodies against adeno-associated viruses in inflammatory bowel disease patients: Implications for gene therapy, Inflamm Bowel Dis, 17:2436-2442.
Van Duyne, 2001, A Structural View of Cre-loxP Site Specific Recombination, Annu. Rev. Biophys. Biomol. Struct. 30:87-104.
Vandendriessche, 2007, Efficacy and safety of adeno-associated viral vectors based on serotype 8 and 9 vs. lentiviral vectors for hemophilia B gene therapy, Journal of thrombosis and haemostasis : JTH, 5:16-24.
Varadi, 2012, Novel random peptide libraries displayed on AAV serotype 9 for selection of endothelial cell-directed gene transfer vectors, Gene Therapy, 19:800-809.
Wagner, 1998, Efficient and persistent gene transfer of AAV-CFTR in maxillary sinus, Lancet, 351(9117):1702-1703.
Wall, 2010, Monosynaptic circuit tracing in vivo through ere-dependent targeting and complementation of modified rabies virus, Proc Natl Acad Sci USA, 107:21848-21853.
Wall, 2013, Differential innervation of direct- and indirect-pathway striatal projection neurons, Neuron, 79:347-360.
Wang, 2007, Existence of transient functional double-stranded DNA intermediates during recombinant AAV transduction, Proceedings of the National Academy of Sciences of the United States of America, 104(32):13104-13109.
Wang, 2014, Widespread spinal cord transduction by intrathecal injection of rAAV delivers efficacious RNAi therapy for amyotrophic lateral sclerosis, Hum Mol Genet, 23:668-681.
Waterkamp, 2006, Isolation of targeted AAV2 vectors from novel virus display libraries, J Gene Med., 8(11):1307-1319.
Wobus, 2000, Monoclonal antibodies against the adeno-associated virus type 2 (AAV-2) capsid: epitope mapping and identification of capsid domains involved in AAV-2-cell interaction and neutralization of AAV-2 infection, J Virol, 74:9281-9293.
Wu, 2000, Mutational Analysis of the Adeno-Assiciated Virus Type 2 (AAV2) Capsid Gene and Construction of AAV2 Vectors with Altered Tropism, Journal of Virology, 74(18):8635-8647.
Wu, 2006, Adeno-associated virus serotypes: vector toolkit for human gene therapy, Molecular therapy : The Journal of the American Society of Gene Therapy, 14:316-327.
Wu, 2012, Self-complementary AAVs induce more potent transgene product-specific immune responses compared to a single-stranded genome, Mol Ther, 20:572-579.
Xie, 2010, MicroRNA-regulated, Systemically Delivered rAAV9: A step closer to CNS-restricted transgene expression, Molecular therapy, 19:526-535.
Xu, 2008, Adeno-related viral shell modification and tumor targeting therapy, Chinese Science Bulletin, 53(21):2546-2553.
Yang, 2009, A myocardium tropic adeno-associated virus (AAV) evolved by DNA shuffling and in vivo selection, Proceedings of the National Academy of Sciences of the United States of America, 106:3946-3951.
Yang, 2014, Global CNS Transduction of Adult Mice by Intravenously Delivered rAAVrh.8 and rAAVrh.10 and Nonhuman Primates by rAAVrh.10, Molecular Therapy, 22:1299-1309.
Yang, 2014, Single-Cell Phenotyping within Transparent Intact Tissue through Whole-Body Clearing, Cell, 158:945-958.
Ying, 2010, Heart-targeted adeno-associated viral vectors selected by in vivo biopanning of a random viral display peptide library, Gene therapy, 17:980-990.
Zariwala, 2012, A Cre-dependent GCaMP3 reporter mouse for neuronal imaging in vivo, J. Neurosci., 32(9):3131-3141.
Zolotukhin, 1999, Recombinant adeno-associated virus purification using novel methods improves infectious titer and yield, Gene therapy, 6:973-985.
Albert, 1995, Site-Specific integration of DNA into wild-type and mutant lox sites placed in the plant genome, The Plant Journal: for cell and molecular biology, 7(4):649-659.
Araki, 1997, Targeted integration of DNA using mutant lox sites in embryonic stem cells, Nucleic Acids Res, 25:868-872.
Aschauer, 2013, Analyis of transduction efficiency, tropism and axonal transport of AAV serotypes 1, 2, 5, 6, 8, and 9 in the mouse brain, PloS One 8(9), e76310, 16 pages.
Asokan, 2010, Reengineered AAV vectors: old dog, new tricks, Discovery medicine, 9(48):399-403.
Asokan, 2012, The AAV Vector Toolkit: Poised at the Clinical Crossroads, Molecular Therapy: the Journal of the American Society of Gene Therapy, 20(4):699-708.
Ayuso, 2010, High AAV vector purity results in serotype- and tissue-independent enhancement of transduction efficiency, Gene Therapy, 17(4):503-510.
Balazs, 2011, Antibody-based protection against HIV infection by vectored immunoprophylaxis, Nature, 481(7379):81-84.
Balazs, 2013, Broad protection against influenza infection by vectored immunoprophylaxis in mice, Nature Biotechnology, 7:647-52.
Bartel, 2011, Enhancing the Clinical Potential of AAV Vectors by Capsid Engineering to Evade Pre-Existing Immunity, Frontiers in Microbiology, vol. 2, Article 204, 10 pages.

(56) References Cited

OTHER PUBLICATIONS

Bartel, 2012, Directed evolution of novel adeno-associated viruses for therapeutic gene delivery, Gene Therapy, 19:694-700.
Bartlett, 1998, Selective and rapid uptake of adeno-associated virus type 2 in brain, Human Gene Therapy, 9(8)1181-1186.
Bartlett, 1999, Targeted adeno-associated virus vector transduction of nonpermissive cells mediated by a bispecific F(ab'gamma)2 antibody, Nat Biotechnol, 1999, vol. 17, pp. 181-186.
Bedbrook, 2018, Viral Strategies for Targeting the Central and Peripheral Nervous Systems, Annual Review of Neuroscience, 41:323-348.
Betley, 2011, Adeno-associated viral vectors for mapping, monitoring, and manipulating neural circuits, Hum Gene Ther, 2011, vol. 22, pp. 669-677.
Bevan, 2011, Systemic gene delivery in large species for targeting spinal cord, brain, and peripheral tissues for pediatric disorders, Molecular therapy: The Journal of the America Society of Gene Therapy, vol. 19, pp. 1971-1980.
Borel, 2014, Recombinant AAV as a platform for translating the therapeutic potential of RNA interference, Molecular Therapy: The Journal of the American Society of Gene Therapy, vol. 22, pp. 692-701.
Boudreau, 2009, Nonallele-specific silencing of mutant and wild-type huntingtin demonstrates therapeutic efficacy in Huntington's disease mice, Molecular therapy: The Journal of the American Society of Gene Therapy, vol. 17, pp. 1053-1063.
Boutin, 2010, Prevalence of serum IgG and neutralizing factors against adeno-associated virus (AAV) types 1, 2, 5, 6, 8, and 9 in the healthy population: implications for gene therapy using AAV vectors, Hum Gene Ther, 21:704-712.
Calcedo, 2009, Worldwide epidemiology of neutralizing antibodies to adeno-associated viruses, J Infect Dis, 1999:381-390.
Callaway, 2008, Transneuronal circuit tracing with neurotropic viruses, Curr Opin Neurobiol, 18:617-623.
Castle, 2014, Adeno-Associated Virus Serotypes 1, 8 and 9 Share Conserved Mechanisms for Anterograde and Retrograde Axonal Transport, Hum Gene Ther, 25(8):705-720.
Castle, 2014, Long-distance axonal transport of AAV9 is driven by dynein and kinesin-2 and is trafficked in a highly motile Rab7-positive compartment, Molecular Therapy, 22:554-566.
Cearley, 2007, A single injection of an adeno-associated virus vector into neuclei with divergent connections results in widespread vector distribution in the brain and global correction of a neurogenetic disease, The Journal of Neuroscience: The Official Journal of the Society for Neuroscience, 27:9928-9940.
Chakrabarty, 2013, Capsid serotype and timing of injection determines AAV transduction in the neonatal mice brain, PLoS One, 8(6):e67680, 9 pages.
Challis, 2018, Widespread and targeted gene expression by systemic AAV vectors: Production, purification, and administration, bioRxiv. org, 66 pages.
Challis, 2019, Systemic AAV vectors for widespreadand targeted gene delivery in rodents, Nature Protocols, 14:379-414.
Chan, 2017, Engineered AAVs for efficient noninvasive gene delivery to the central and peripheral nervous systems, Nat Neurosci, 20(8):1172-1179.
Chen, 2003, New Insight Into Site-Specific Recombination From FLP Recombinase-DNA Structures, Annu. Rev. Biophys. Biomol. Struct., 32:135-159.
Chiorini, 1999, Cloning and Characterization of adeno-associated virus type, J. Virol., 73:1309-1319.
Chung, 2013, CLARITY for mapping the nervous system, Nat Methods, 10(6):508-513.
Clark, 1999, Highly purified recombinant adeno-associated virus vectors are biologically active and free of detectable helper and wild-type viruses, Hum Gene Ther., 10(6):1031-9.
Coleman, 2018, Visual Biochemistry, 5th edition, Laboratory of Knowledge, Moscow, p. 58.
Dalkara, 2013, In vivo-directed evolution of a new adeno-associated virus for therapeutic outer retinal gene delivery from the vitreous, Science translational medicine, 5(189):189ra176.
De, 2006, High levels of persistent expression of alpha1-antitrypsin rh.10 adeno-associated virus despite preexisting immunity to common human adeno-assiciated viruses, Mol. Ther., 13(1):67-76.
Deverman, 2016, Cre-dependent selection yields AAV variants for widespread gene transfer to the adult brain, Nature Biotechnology, 34-204-209.
Dufour, 2014, Intrajugular vein delivery of AAV9-RNAi prevents neuropathological changes ad weight loss in Huntington's disease mice, Molecular therapy: The Journal of the American Society of Gene Therapy, 22:797-810.
Duque, 2009, Intravenous Administration of Self-complementary AAV9 Enables Transgene Delivery to Adult Motor Neurons, Molecular therapy: The Journal of the American Society of Gene Therapy, 17:1187-1196.
Excoffon, 2009, Directed evolution of adeno-associated virus to an infectious respiratory virus, Proceedings of the National Academy of Sciences of the Untied States of America, 106(10):3865-3870.
Farris, 2008, Improved splicing of adeno-associated viral (AAV) capsid rotein-supplying pre-mRNAs leads to increased recombinant AAV vector prodcution, Human Gene Therapy, 19:1421-1427.
Fenno, 2011, The development and application of optogenetics, Annual review of neuroscience, 34:389-412.
Fenno, 2014, Targeting cells with single vectors using multiple-feature Boolean logic, Nat Methods, 11:763-772.
Flotte, 1998, Adeo-associated virus vectors for gene therapy of cystic fibrosis, Methods Enzymol, 292:717-732.
Flytzanis, 2020, Broad gene expression throughout the mouse and marmoset brain after intravenous delivery of engineered AAV capsids, bioRxiv.org, 21 pages.
Foust, 2009, Intravascular AAV9 preferentially targets neonatal neurons and adult astrocytes, Nature biotechnology, 27:59-65.
Foust, 2010, Rescue of the spinal muscular atrophy phenotype in a mouse model by early postnatal delivery of SMN, Nat Biotechnol, 28:271-274.
Foust, 2013, Therapeutic AAV9-mediated Suppression of Mutant SOD1 Slows Disease Progression and Extends Survival in Models of inherited ALS, Molecular therapy: The Journal of the American Society of Gene Therapy, 21(12):2148-2159.
Gao, 2004, Clades of Adeno-associated viruses are widely disseminated in human tissues, J Virol., 78(12):6381-8.
Garcia, 2004, GFAP-expressing progenitors are the principal source of constitutive neurogenesis in adult mouse forebrain, Nature neuroscience, 7:1233-1241.
Garg, 2013, Systemic Delivery of MeCP2 Rescues Behavioral and Cellular Deficits in Female Mouse Models of Rett Syndrome, The Journal of Neuroscience: The Official Journal of the Society for Neuroscience, 33:13612-13620.
Gaudet, 2010, Review of the clinical development of alipogene tiparvovec gene therapy for lipoprotein lipase deficiency, Atherosclerosis Supplements, 11:55-60.

\* cited by examiner

FIG. 2

| DNA SEQ ID NO | AA SEQ ID NO | Log 10 enrichment in the brain |
|---|---|---|
| 12740 | 11 | 1.912817683 |
| 12741 | 12 | 1.683542214 |
| 12742 | 13 | 1.646549793 |
| 12743 | 14 | 1.624376814 |
| 12744 | 15 | 1.609487799 |
| 12745 | 16 | 1.581298365 |
| 12746 | 17 | 1.560127515 |
| 12747 | 18 | 1.532606441 |
| 12748 | 19 | 1.510809312 |
| 12749 | 20 | 1.497374065 |
| 12750 | 21 | 1.495179943 |
| 12751 | 22 | 1.492959081 |
| 12752 | 23 | 1.465659651 |
| 12753 | 24 | 1.464822053 |
| 12754 | 25 | 1.464030027 |
| 12755 | 26 | 1.458626389 |
| 12756 | 27 | 1.456753138 |
| 12757 | 28 | 1.451684533 |
| 12758 | 29 | 1.44624661 |
| 12759 | 30 | 1.424823398 |
| 12760 | 31 | 1.414846289 |
| 12761 | 32 | 1.414026449 |
| 12762 | 33 | 1.407667705 |
| 12763 | 34 | 1.401327526 |
| 12764 | 35 | 1.397448539 |
| 12765 | 36 | 1.397202271 |
| 12766 | 37 | 1.392230734 |
| 12767 | 38 | 1.381591777 |
| 12768 | 39 | 1.379179167 |
| 12769 | 40 | 1.376188618 |
| 12770 | 41 | 1.367455168 |
| 12771 | 42 | 1.367065364 |
| 12772 | 43 | 1.35551795 |
| 12773 | 44 | 1.352278129 |
| 12774 | 45 | 1.346786579 |
| 12775 | 46 | 1.34383415 |
| 12776 | 47 | 1.341943936 |
| 12777 | 48 | 1.339902445 |
| 12778 | 49 | 1.336311796 |
| 12779 | 50 | 1.329892702 |
| 12780 | 51 | 1.329439904 |
| 12781 | 52 | 1.328486458 |
| 12782 | 53 | 1.327743439 |
| 12783 | 54 | 1.32517543 |
| 12784 | 55 | 1.322496095 |
| 12785 | 56 | 1.320628446 |
| 12786 | 57 | 1.318377088 |
| 12787 | 58 | 1.316220587 |
| 12788 | 59 | 1.315353443 |
| 12789 | 60 | 1.312609696 |
| 12790 | 61 | 1.312160906 |
| 12791 | 62 | 1.310022222 |
| 12792 | 63 | 1.309518619 |
| 12793 | 64 | 1.306381891 |
| 12794 | 65 | 1.301939226 |
| 12795 | 66 | 1.301709563 |
| 12796 | 67 | 1.299175819 |
| 12797 | 68 | 1.290697898 |
| 12798 | 69 | 1.289568392 |
| 12799 | 70 | 1.287980477 |
| 12800 | 71 | 1.286624012 |
| 12801 | 72 | 1.285052291 |
| 12802 | 73 | 1.282728968 |
| 12803 | 74 | 1.278319849 |
| 12804 | 75 | 1.275593274 |
| 12805 | 76 | 1.274661346 |
| 12806 | 77 | 1.273234025 |
| 12807 | 78 | 1.268647757 |
| 12808 | 79 | 1.266338552 |
| 12809 | 80 | 1.263761129 |
| 12810 | 81 | 1.26298491 |
| 12811 | 82 | 1.262610679 |
| 12812 | 83 | 1.262390393 |
| 12813 | 84 | 1.261678178 |
| 12814 | 85 | 1.259605169 |
| 12815 | 86 | 1.257729164 |
| 12816 | 87 | 1.255488603 |
| 12817 | 88 | 1.255155632 |
| 12818 | 89 | 1.254372642 |
| 12819 | 90 | 1.249837762 |
| 12820 | 91 | 1.243541237 |
| 12821 | 92 | 1.239129583 |
| 12822 | 93 | 1.235336594 |
| 12823 | 94 | 1.235150906 |
| 12824 | 95 | 1.234689681 |
| 12825 | 96 | 1.231576445 |
| 12826 | 97 | 1.231576445 |
| 12827 | 98 | 1.231576445 |
| 12828 | 99 | 1.228870552 |
| 12829 | 100 | 1.228347475 |
| 12830 | 101 | 1.227339393 |
| 12831 | 102 | 1.226613026 |
| 12832 | 103 | 1.224627586 |
| 12833 | 104 | 1.224338037 |
| 12834 | 105 | 1.223797829 |
| 12835 | 106 | 1.221816608 |
| 12836 | 107 | 1.221276489 |
| 12837 | 108 | 1.218666529 |
| 12838 | 109 | 1.218414999 |
| 12839 | 110 | 1.218073975 |
| 12840 | 111 | 1.214638024 |
| 12841 | 112 | 1.213424183 |
| 12842 | 113 | 1.212227129 |
| 12843 | 114 | 1.211476697 |
| 12844 | 115 | 1.209857196 |
| 12845 | 116 | 1.209857196 |
| 12846 | 117 | 1.201953979 |
| 12847 | 118 | 1.201928042 |
| 12848 | 119 | 1.201613222 |
| 12849 | 120 | 1.200542212 |
| 12850 | 121 | 1.200167981 |
| 12851 | 122 | 1.199862032 |
| 12852 | 123 | 1.196814339 |
| 12853 | 124 | 1.194084635 |
| 12854 | 125 | 1.193231453 |
| 12855 | 126 | 1.192382724 |
| 12856 | 127 | 1.1866093 |
| 12857 | 128 | 1.186498071 |
| 12858 | 129 | 1.183884455 |
| 12859 | 130 | 1.183884455 |
| 12860 | 131 | 1.182214831 |
| 12861 | 132 | 1.182091082 |
| 12862 | 133 | 1.181831686 |
| 12863 | 134 | 1.180423923 |
| 12864 | 135 | 1.179440243 |
| 12865 | 136 | 1.178498002 |
| 12866 | 137 | 1.176907349 |
| 12867 | 138 | 1.176383945 |
| 12868 | 139 | 1.17146908 |
| 12869 | 140 | 1.171160523 |
| 12870 | 141 | 1.17062002 |
| 12871 | 142 | 1.170381985 |
| 12872 | 143 | 1.167118456 |
| 12873 | 144 | 1.16589767 |
| 12874 | 145 | 1.165446767 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 12875 | 146 | 1.164629656 | 12904 | 175 | 1.126066261 | 12933 | 204 | 1.094993728 | 12962 | 233 | 1.079288101 | 12991 | 262 | 1.066593068 |
| 12876 | 147 | 1.164629656 | 12905 | 176 | 1.125618303 | 12934 | 205 | 1.094738486 | 12963 | 234 | 1.07909396 | 12992 | 263 | 1.066143255 |
| 12877 | 148 | 1.158618564 | 12906 | 177 | 1.125121115 | 12935 | 206 | 1.094403252 | 12964 | 235 | 1.078348069 | 12993 | 264 | 1.064628566 |
| 12878 | 149 | 1.158555508 | 12907 | 178 | 1.121163962 | 12936 | 207 | 1.094342123 | 12965 | 236 | 1.078149171 | 12994 | 265 | 1.063959494 |
| 12879 | 150 | 1.156075683 | 12908 | 179 | 1.121163962 | 12937 | 208 | 1.093830178 | 12966 | 237 | 1.077204436 | 12995 | 266 | 1.063310524 |
| 12880 | 151 | 1.1551881 | 12909 | 180 | 1.120878148 | 12938 | 209 | 1.090813149 | 12967 | 238 | 1.076674485 | 12996 | 267 | 1.062271176 |
| 12881 | 152 | 1.154529329 | 12910 | 181 | 1.120635141 | 12939 | 210 | 1.090813149 | 12968 | 239 | 1.076674485 | 12997 | 268 | 1.061559334 |
| 12882 | 153 | 1.154410491 | 12911 | 182 | 1.120161744 | 12940 | 211 | 1.09046277 | 12969 | 240 | 1.075571748 | 12998 | 269 | 1.060180308 |
| 12883 | 154 | 1.15423934 | 12912 | 183 | 1.119817311 | 12941 | 212 | 1.089343454 | 12970 | 241 | 1.075423516 | 12999 | 270 | 1.060180308 |
| 12884 | 155 | 1.152891253 | 12913 | 184 | 1.119689276 | 12942 | 213 | 1.088908942 | 12971 | 242 | 1.075038723 | 13000 | 271 | 1.058278087 |
| 12885 | 156 | 1.152395199 | 12914 | 185 | 1.119349674 | 12943 | 214 | 1.088683393 | 12972 | 243 | 1.074790342 | 13001 | 272 | 1.058174325 |
| 12886 | 157 | 1.151954067 | 12915 | 186 | 1.118536932 | 12944 | 215 | 1.08797094 | 12973 | 244 | 1.073968592 | 13002 | 273 | 1.058125283 |
| 12887 | 158 | 1.151892834 | 12916 | 187 | 1.118172255 | 12945 | 216 | 1.08766987 | 12974 | 245 | 1.073123935 | 13003 | 274 | 1.057988332 |
| 12888 | 159 | 1.151056849 | 12917 | 188 | 1.118097331 | 12946 | 217 | 1.08674288 | 12975 | 246 | 1.073009531 | 13004 | 275 | 1.057945785 |
| 12889 | 160 | 1.150868679 | 12918 | 189 | 1.116069944 | 12947 | 218 | 1.086361753 | 12976 | 247 | 1.072975919 | 13005 | 276 | 1.057789141 |
| 12890 | 161 | 1.150162318 | 12919 | 190 | 1.112212811 | 12948 | 219 | 1.08544841 | 12977 | 248 | 1.072859282 | 13006 | 277 | 1.055485186 |
| 12891 | 162 | 1.148336343 | 12920 | 191 | 1.109534948 | 12949 | 220 | 1.084523395 | 12978 | 249 | 1.072518526 | 13007 | 278 | 1.055485186 |
| 12892 | 163 | 1.146900889 | 12921 | 192 | 1.109004442 | 12950 | 221 | 1.084130368 | 12979 | 250 | 1.072255397 | 13008 | 279 | 1.053805128 |
| 12893 | 164 | 1.14614625 | 12922 | 193 | 1.106637709 | 12951 | 222 | 1.083973724 | 12980 | 251 | 1.072063324 | 13009 | 280 | 1.05303845 |
| 12894 | 165 | 1.144885598 | 12923 | 194 | 1.105531225 | 12952 | 223 | 1.08351391 | 12981 | 252 | 1.071279454 | 13010 | 281 | 1.050984685 |
| 12895 | 166 | 1.141399815 | 12924 | 195 | 1.104703209 | 12953 | 224 | 1.082637432 | 12982 | 253 | 1.070997353 | 13011 | 282 | 1.049952698 |
| 12896 | 167 | 1.139806072 | 12925 | 196 | 1.101666172 | 12954 | 225 | 1.082407829 | 12983 | 254 | 1.070832878 | 13012 | 283 | 1.047832222 |
| 12897 | 168 | 1.139430222 | 12926 | 197 | 1.101666172 | 12955 | 226 | 1.081928669 | 12984 | 255 | 1.070725153 | 13013 | 284 | 1.047290708 |
| 12898 | 169 | 1.138959329 | 12927 | 198 | 1.100297531 | 12956 | 227 | 1.081814125 | 12985 | 256 | 1.069495901 | 13014 | 285 | 1.046530344 |
| 12899 | 170 | 1.131873532 | 12928 | 199 | 1.100297531 | 12957 | 228 | 1.081526988 | 12986 | 257 | 1.068547659 | 13015 | 286 | 1.045500965 |
| 12900 | 171 | 1.131681579 | 12929 | 200 | 1.097682866 | 12958 | 229 | 1.081190587 | 12987 | 258 | 1.067983732 | 13016 | 287 | 1.043964763 |
| 12901 | 172 | 1.129062555 | 12930 | 201 | 1.096877872 | 12959 | 230 | 1.081039291 | 12988 | 259 | 1.067894444 | 13017 | 288 | 1.04325073 |
| 12902 | 173 | 1.129038347 | 12931 | 202 | 1.096103037 | 12960 | 231 | 1.08030877 | 12989 | 260 | 1.06738441 | 13018 | 289 | 1.042843706 |
| 12903 | 174 | 1.128356959 | 12932 | 203 | 1.095157891 | 12961 | 232 | 1.08030877 | 12990 | 261 | 1.066766197 | 13019 | 290 | 1.042520209 |

FIG. 2 (Cont.)

| DNA SEQ ID NO | AA SEQ ID NO | Log 10 enrichment in the brain |
|---|---|---|
| 13020 | 291 | 1.042223256 |
| 13021 | 292 | 1.040351443 |
| 13022 | 293 | 1.039247988 |
| 13023 | 294 | 1.039038335 |
| 13024 | 295 | 1.037440684 |
| 13025 | 296 | 1.037001781 |
| 13026 | 297 | 1.0352818 |
| 13027 | 298 | 1.035022132 |
| 13028 | 299 | 1.034295887 |
| 13029 | 300 | 1.032470823 |
| 13030 | 301 | 1.031446946 |
| 13031 | 302 | 1.030531904 |
| 13032 | 303 | 1.030531904 |
| 13033 | 304 | 1.029156248 |
| 13034 | 305 | 1.02861304 |
| 13035 | 306 | 1.027941437 |
| 13036 | 307 | 1.027456463 |
| 13037 | 308 | 1.02665886 |
| 13038 | 309 | 1.02619581 |
| 13039 | 310 | 1.026030207 |
| 13040 | 311 | 1.026030207 |
| 13041 | 312 | 1.026030207 |
| 13042 | 313 | 1.025680205 |
| 13043 | 314 | 1.025261204 |
| 13044 | 315 | 1.024861439 |
| 13045 | 316 | 1.024816367 |
| 13046 | 317 | 1.024816367 |
| 13047 | 318 | 1.023770773 |
| 13048 | 319 | 1.021962152 |

| DNA SEQ ID NO | AA SEQ ID NO | Log 10 enrichment in the brain |
|---|---|---|
| 13049 | 320 | 1.021736603 |
| 13050 | 321 | 1.021538657 |
| 13051 | 322 | 1.021271086 |
| 13052 | 323 | 1.02072308 |
| 13053 | 324 | 1.02072308 |
| 13054 | 325 | 1.02072308 |
| 13055 | 326 | 1.02019313 |
| 13056 | 327 | 1.017696626 |
| 13057 | 328 | 1.016855784 |
| 13058 | 329 | 1.015106024 |
| 13059 | 330 | 1.014740219 |
| 13060 | 331 | 1.01428897 |
| 13061 | 332 | 1.013081338 |
| 13062 | 333 | 1.012897743 |
| 13063 | 334 | 1.012632686 |
| 13064 | 335 | 1.010903054 |
| 13065 | 336 | 1.010738859 |
| 13066 | 337 | 1.010563682 |
| 13067 | 338 | 1.010518041 |
| 13068 | 339 | 1.009727696 |
| 13069 | 340 | 1.009727696 |
| 13070 | 341 | 1.009727696 |
| 13071 | 342 | 1.009727696 |
| 13072 | 343 | 1.008488624 |
| 13073 | 344 | 1.006267164 |
| 13074 | 345 | 1.006047212 |
| 13075 | 346 | 1.005797402 |
| 13076 | 347 | 1.005797402 |
| 13077 | 348 | 1.005571736 |

| DNA SEQ ID NO | AA SEQ ID NO | Log 10 enrichment in the brain |
|---|---|---|
| 13078 | 349 | 1.005180068 |
| 13079 | 350 | 1.004706894 |
| 13080 | 351 | 1.004332664 |
| 13081 | 352 | 1.003778363 |
| 13082 | 353 | 1.001127524 |
| 13083 | 354 | 1.001127524 |
| 13084 | 355 | 1.000679567 |
| 13085 | 356 | 0.999729954 |
| 13086 | 357 | 0.99871764 |
| 13087 | 358 | 0.995899496 |
| 13088 | 359 | 0.995813181 |
| 13089 | 360 | 0.995756754 |
| 13090 | 361 | 0.995687439 |
| 13091 | 362 | 0.995118742 |
| 13092 | 363 | 0.995004439 |
| 13093 | 364 | 0.993967148 |
| 13094 | 365 | 0.99373959 |
| 13095 | 366 | 0.993216659 |
| 13096 | 367 | 0.993158594 |
| 13097 | 368 | 0.991998929 |
| 13098 | 369 | 0.99124429 |
| 13099 | 370 | 0.990218455 |
| 13100 | 371 | 0.988538397 |
| 13101 | 372 | 0.988538397 |
| 13102 | 373 | 0.988538397 |
| 13103 | 374 | 0.988538397 |
| 13104 | 375 | 0.987097949 |
| 13105 | 376 | 0.987027806 |
| 13106 | 377 | 0.986541637 |

| DNA SEQ ID NO | AA SEQ ID NO | Log 10 enrichment in the brain |
|---|---|---|
| 13107 | 378 | 0.986063778 |
| 13108 | 379 | 0.98544732 |
| 13109 | 380 | 0.984596211 |
| 13110 | 381 | 0.980713059 |
| 13111 | 382 | 0.980234234 |
| 13112 | 383 | 0.980064089 |
| 13113 | 384 | 0.979764472 |
| 13114 | 385 | 0.979764472 |
| 13115 | 386 | 0.979764472 |
| 13116 | 387 | 0.979238374 |
| 13117 | 388 | 0.979238374 |
| 13118 | 389 | 0.979096841 |
| 13119 | 390 | 0.978645156 |
| 13120 | 391 | 0.978554176 |
| 13121 | 392 | 0.977289853 |
| 13122 | 393 | 0.976768178 |
| 13123 | 394 | 0.975443099 |
| 13124 | 395 | 0.97496559 |
| 13125 | 396 | 0.974180247 |
| 13126 | 397 | 0.973581082 |
| 13127 | 398 | 0.97329843 |
| 13128 | 399 | 0.97329843 |
| 13129 | 400 | 0.973004889 |
| 13130 | 401 | 0.972510951 |
| 13131 | 402 | 0.972510951 |
| 13132 | 403 | 0.972510951 |
| 13133 | 404 | 0.972510951 |
| 13134 | 405 | 0.972301198 |
| 13135 | 406 | 0.972245084 |

| DNA SEQ ID NO | AA SEQ ID NO | Log 10 enrichment in the brain |
|---|---|---|
| 13136 | 407 | 0.971708189 |
| 13137 | 408 | 0.970889691 |
| 13138 | 409 | 0.970663673 |
| 13139 | 410 | 0.970474397 |
| 13140 | 411 | 0.970313577 |
| 13141 | 412 | 0.970054991 |
| 13142 | 413 | 0.969917142 |
| 13143 | 414 | 0.969299039 |
| 13144 | 415 | 0.969299039 |
| 13145 | 416 | 0.969233242 |
| 13146 | 417 | 0.967654831 |
| 13147 | 418 | 0.967063284 |
| 13148 | 419 | 0.966927248 |
| 13149 | 420 | 0.965874412 |
| 13150 | 421 | 0.965620661 |
| 13151 | 422 | 0.965524033 |
| 13152 | 423 | 0.965524033 |
| 13153 | 424 | 0.965057301 |
| 13154 | 425 | 0.964915351 |
| 13155 | 426 | 0.964404717 |
| 13156 | 427 | 0.963714813 |
| 13157 | 428 | 0.963270295 |
| 13158 | 429 | 0.963215567 |
| 13159 | 430 | 0.962731133 |
| 13160 | 431 | 0.962731133 |
| 13161 | 432 | 0.962731133 |
| 13162 | 433 | 0.960808055 |
| 13163 | 434 | 0.960698867 |
| 13164 | 435 | 0.960648182 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13165 | 436 | 0.95940319 | 13194 | 465 | 0.947851308 | 13223 | 494 | 0.933078786 | 13252 | 523 | 0.924206272 | 13281 | 552 | 0.913904778 |
| 13166 | 437 | 0.959318192 | 13195 | 466 | 0.947729572 | 13224 | 495 | 0.932965924 | 13253 | 524 | 0.924080408 | 13282 | 553 | 0.913221866 |
| 13167 | 438 | 0.959191631 | 13196 | 467 | 0.947145712 | 13225 | 496 | 0.932723369 | 13254 | 525 | 0.923670932 | 13283 | 554 | 0.913221866 |
| 13168 | 439 | 0.957698696 | 13197 | 468 | 0.946340717 | 13226 | 497 | 0.931977405 | 13255 | 526 | 0.923247211 | 13284 | 555 | 0.913133648 |
| 13169 | 440 | 0.957054 | 13198 | 469 | 0.946340717 | 13227 | 498 | 0.93054645 | 13256 | 527 | 0.923206087 | 13285 | 556 | 0.912448228 |
| 13170 | 441 | 0.956559882 | 13199 | 470 | 0.946340717 | 13228 | 499 | 0.93054645 | 13257 | 528 | 0.92257752 | 13286 | 557 | 0.91232163 |
| 13171 | 442 | 0.956559882 | 13200 | 471 | 0.94512845 | 13229 | 500 | 0.93054645 | 13258 | 529 | 0.921946278 | 13287 | 558 | 0.91232163 |
| 13172 | 443 | 0.956353713 | 13201 | 472 | 0.944694101 | 13230 | 501 | 0.93054645 | 13259 | 530 | 0.921831218 | 13288 | 559 | 0.912219069 |
| 13173 | 444 | 0.956353713 | 13202 | 473 | 0.94404892 | 13231 | 502 | 0.93054645 | 13260 | 531 | 0.921591607 | 13289 | 560 | 0.910802392 |
| 13174 | 445 | 0.95595103 | 13203 | 474 | 0.943258415 | 13232 | 503 | 0.93054645 | 13261 | 532 | 0.921591607 | 13290 | 561 | 0.910428161 |
| 13175 | 446 | 0.955630793 | 13204 | 475 | 0.943063007 | 13233 | 504 | 0.93054645 | 13262 | 533 | 0.921338448 | 13291 | 562 | 0.910024783 |
| 13176 | 447 | 0.954458607 | 13205 | 476 | 0.942128322 | 13234 | 505 | 0.93054645 | 13263 | 534 | 0.921148675 | 13292 | 563 | 0.909357151 |
| 13177 | 448 | 0.954458607 | 13206 | 477 | 0.941925996 | 13235 | 506 | 0.93054645 | 13264 | 535 | 0.921001132 | 13293 | 564 | 0.909357151 |
| 13178 | 449 | 0.953776291 | 13207 | 478 | 0.941925996 | 13236 | 507 | 0.928422756 | 13265 | 536 | 0.920786613 | 13294 | 565 | 0.908496309 |
| 13179 | 450 | 0.953611754 | 13208 | 479 | 0.941182765 | 13237 | 508 | 0.927969027 | 13266 | 537 | 0.920786613 | 13295 | 566 | 0.908270055 |
| 13180 | 451 | 0.952822845 | 13209 | 480 | 0.940846406 | 13238 | 509 | 0.927969027 | 13267 | 538 | 0.920786613 | 13296 | 567 | 0.908270055 |
| 13181 | 452 | 0.952822845 | 13210 | 481 | 0.940663584 | 13239 | 510 | 0.927906354 | 13268 | 539 | 0.920485124 | 13297 | 568 | 0.908270055 |
| 13182 | 453 | 0.952822845 | 13211 | 482 | 0.938979617 | 13240 | 511 | 0.927906354 | 13269 | 540 | 0.919606464 | 13298 | 569 | 0.907738157 |
| 13183 | 454 | 0.951231049 | 13212 | 483 | 0.938371787 | 13241 | 512 | 0.927698607 | 13270 | 541 | 0.919551065 | 13299 | 570 | 0.907562543 |
| 13184 | 455 | 0.949851605 | 13213 | 484 | 0.938233278 | 13242 | 513 | 0.92726874 | 13271 | 542 | 0.919551065 | 13300 | 571 | 0.906832176 |
| 13185 | 456 | 0.949851605 | 13214 | 485 | 0.938013014 | 13243 | 514 | 0.927058122 | 13272 | 543 | 0.919066632 | 13301 | 572 | 0.906696839 |
| 13186 | 457 | 0.949851605 | 13215 | 486 | 0.937845689 | 13244 | 515 | 0.926818577 | 13273 | 544 | 0.918380543 | 13302 | 573 | 0.906187104 |
| 13187 | 458 | 0.949431794 | 13216 | 487 | 0.937845689 | 13245 | 516 | 0.926137331 | 13274 | 545 | 0.917603843 | 13303 | 574 | 0.905564162 |
| 13188 | 459 | 0.949386273 | 13217 | 488 | 0.937385874 | 13246 | 517 | 0.926045949 | 13275 | 546 | 0.917182488 | 13304 | 575 | 0.905329661 |
| 13189 | 460 | 0.949029855 | 13218 | 489 | 0.93698056 | 13247 | 518 | 0.925950698 | 13276 | 547 | 0.916845172 | 13305 | 576 | 0.905240585 |
| 13190 | 461 | 0.949029855 | 13219 | 490 | 0.935625975 | 13248 | 519 | 0.925950698 | 13277 | 548 | 0.915654894 | 13306 | 577 | 0.904908513 |
| 13191 | 462 | 0.948519821 | 13220 | 491 | 0.934512637 | 13249 | 520 | 0.925525648 | 13278 | 549 | 0.9156061 | 13307 | 578 | 0.904739186 |
| 13192 | 463 | 0.948421174 | 13221 | 492 | 0.93412091 | 13250 | 521 | 0.92540681 | 13279 | 550 | 0.915034284 | 13308 | 579 | 0.904217511 |
| 13193 | 464 | 0.948037182 | 13222 | 493 | 0.933202693 | 13251 | 522 | 0.924869317 | 13280 | 551 | 0.913904778 | 13309 | 580 | 0.904217511 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13310 | 581 | 0.904217511 | 13339 | 610 | 0.895784344 | 13368 | 639 | 0.886342787 | 13397 | 668 | 0.880467585 | 13426 | 697 | 0.872032828 |
| 13311 | 582 | 0.903272365 | 13340 | 611 | 0.895116712 | 13369 | 640 | 0.886342787 | 13398 | 669 | 0.879393927 | 13427 | 698 | 0.871840789 |
| 13312 | 583 | 0.903002701 | 13341 | 612 | 0.89502575 | 13370 | 641 | 0.885964317 | 13399 | 670 | 0.879393927 | 13428 | 699 | 0.871679791 |
| 13313 | 584 | 0.902517726 | 13342 | 613 | 0.894741619 | 13371 | 642 | 0.885624945 | 13400 | 671 | 0.879393927 | 13429 | 700 | 0.871424998 |
| 13314 | 585 | 0.901752257 | 13343 | 614 | 0.894501346 | 13372 | 643 | 0.88531891 | 13401 | 672 | 0.879393927 | 13430 | 701 | 0.871081818 |
| 13315 | 586 | 0.901670322 | 13344 | 615 | 0.894501346 | 13373 | 644 | 0.885041529 | 13402 | 673 | 0.879393927 | 13431 | 702 | 0.87096076 |
| 13316 | 587 | 0.901388221 | 13345 | 616 | 0.894501346 | 13374 | 645 | 0.884558013 | 13403 | 674 | 0.878218569 | 13432 | 703 | 0.870707748 |
| 13317 | 588 | 0.900583226 | 13346 | 617 | 0.893701392 | 13375 | 646 | 0.88424643 | 13404 | 675 | 0.87815838 | 13433 | 704 | 0.869848609 |
| 13318 | 589 | 0.900583226 | 13347 | 618 | 0.893634366 | 13376 | 647 | 0.884014125 | 13405 | 676 | 0.877840099 | 13434 | 705 | 0.869848609 |
| 13319 | 590 | 0.900304922 | 13348 | 619 | 0.893119952 | 13377 | 648 | 0.884014125 | 13406 | 677 | 0.877387945 | 13435 | 706 | 0.869455405 |
| 13320 | 591 | 0.899597313 | 13349 | 620 | 0.892757889 | 13378 | 649 | 0.883970308 | 13407 | 678 | 0.877300938 | 13436 | 707 | 0.869351989 |
| 13321 | 592 | 0.899137986 | 13350 | 621 | 0.892583928 | 13379 | 650 | 0.883803046 | 13408 | 679 | 0.877300938 | 13437 | 708 | 0.869108755 |
| 13322 | 593 | 0.899137986 | 13351 | 622 | 0.8924564 | 13380 | 651 | 0.883803046 | 13409 | 680 | 0.877206041 | 13438 | 709 | 0.868800854 |
| 13323 | 594 | 0.898361766 | 13352 | 623 | 0.892168215 | 13381 | 652 | 0.883433905 | 13410 | 681 | 0.876388417 | 13439 | 710 | 0.868054002 |
| 13324 | 595 | 0.898361766 | 13353 | 624 | 0.891293151 | 13382 | 653 | 0.883324221 | 13411 | 682 | 0.876188787 | 13440 | 711 | 0.86775562 |
| 13325 | 596 | 0.898361766 | 13354 | 625 | 0.890952088 | 13383 | 654 | 0.8831218 | 13412 | 683 | 0.876040285 | 13441 | 712 | 0.867494704 |
| 13326 | 597 | 0.897877333 | 13355 | 626 | 0.89089909 | 13384 | 655 | 0.882622897 | 13413 | 684 | 0.875834117 | 13442 | 713 | 0.86722182 |
| 13327 | 598 | 0.897753936 | 13356 | 627 | 0.890837079 | 13385 | 656 | 0.882622897 | 13414 | 685 | 0.875697782 | 13443 | 714 | 0.867060192 |
| 13328 | 599 | 0.897417031 | 13357 | 628 | 0.890429227 | 13386 | 657 | 0.882622897 | 13415 | 686 | 0.875498883 | 13444 | 715 | 0.866712896 |
| 13329 | 600 | 0.897046828 | 13358 | 629 | 0.889153765 | 13387 | 658 | 0.882622897 | 13416 | 687 | 0.875277361 | 13445 | 716 | 0.866636697 |
| 13330 | 601 | 0.896979102 | 13359 | 630 | 0.889153765 | 13388 | 659 | 0.882420382 | 13417 | 688 | 0.874662268 | 13446 | 717 | 0.86642895 |
| 13331 | 602 | 0.896863337 | 13360 | 631 | 0.889153765 | 13389 | 660 | 0.882358406 | 13418 | 689 | 0.874497658 | 13447 | 718 | 0.86642895 |
| 13332 | 603 | 0.896768023 | 13361 | 632 | 0.888733954 | 13390 | 661 | 0.882358406 | 13419 | 690 | 0.874065094 | 13448 | 719 | 0.865992473 |
| 13333 | 604 | 0.896620329 | 13362 | 633 | 0.887994099 | 13391 | 662 | 0.881813401 | 13420 | 691 | 0.873641598 | 13449 | 720 | 0.865605643 |
| 13334 | 605 | 0.896427267 | 13363 | 634 | 0.887994099 | 13392 | 663 | 0.881697882 | 13421 | 692 | 0.873641598 | 13450 | 721 | 0.864950499 |
| 13335 | 606 | 0.895784344 | 13364 | 635 | 0.887711723 | 13393 | 664 | 0.881697882 | 13422 | 693 | 0.873251046 | 13451 | 722 | 0.864794419 |
| 13336 | 607 | 0.895784344 | 13365 | 636 | 0.887711723 | 13394 | 665 | 0.881497052 | 13423 | 694 | 0.873144978 | 13452 | 723 | 0.864794419 |
| 13337 | 608 | 0.895784344 | 13366 | 637 | 0.887511818 | 13395 | 666 | 0.881328427 | 13424 | 695 | 0.87286306 | 13453 | 724 | 0.864670671 |
| 13338 | 609 | 0.895784344 | 13367 | 638 | 0.887321296 | 13396 | 667 | 0.880632999 | 13425 | 696 | 0.872032828 | 13454 | 725 | 0.864670671 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13455 | 726 | 0.864486881 | 13484 | 755 | 0.855912831 | 13513 | 784 | 0.848054175 | 13542 | 813 | 0.840736777 | 13571 | 842 | 0.833636437 |
| 13456 | 727 | 0.864486881 | 13485 | 756 | 0.855912831 | 13514 | 785 | 0.847955134 | 13543 | 814 | 0.840641338 | 13572 | 843 | 0.833636437 |
| 13457 | 728 | 0.86359966 | 13486 | 757 | 0.855912831 | 13515 | 786 | 0.847955134 | 13544 | 815 | 0.840548431 | 13573 | 844 | 0.833636437 |
| 13458 | 729 | 0.86359966 | 13487 | 758 | 0.855125353 | 13516 | 787 | 0.847955134 | 13545 | 816 | 0.840369819 | 13574 | 845 | 0.831012293 |
| 13459 | 730 | 0.862824826 | 13488 | 759 | 0.855067078 | 13517 | 788 | 0.847876876 | 13546 | 817 | 0.840369819 | 13575 | 846 | 0.830930543 |
| 13460 | 731 | 0.862688234 | 13489 | 760 | 0.854456281 | 13518 | 789 | 0.847209244 | 13547 | 818 | 0.83946598 | 13576 | 847 | 0.83054536 |
| 13461 | 732 | 0.862600133 | 13490 | 761 | 0.854012196 | 13519 | 790 | 0.846864703 | 13548 | 819 | 0.83946598 | 13577 | 848 | 0.830243494 |
| 13462 | 733 | 0.862600133 | 13491 | 762 | 0.853958014 | 13520 | 791 | 0.846864703 | 13549 | 820 | 0.83946598 | 13578 | 849 | 0.830175905 |
| 13463 | 734 | 0.862051372 | 13492 | 763 | 0.85370642 | 13521 | 792 | 0.846864703 | 13550 | 821 | 0.83848894 | 13579 | 850 | 0.830032313 |
| 13464 | 735 | 0.861465531 | 13493 | 764 | 0.853380495 | 13522 | 793 | 0.846491757 | 13551 | 822 | 0.83848894 | 13580 | 851 | 0.829876288 |
| 13465 | 736 | 0.861465531 | 13494 | 765 | 0.853380495 | 13523 | 794 | 0.846457869 | 13552 | 823 | 0.83848894 | 13581 | 852 | 0.829519871 |
| 13466 | 737 | 0.861219958 | 13495 | 766 | 0.853380495 | 13524 | 795 | 0.846225564 | 13553 | 824 | 0.838232188 | 13582 | 853 | 0.829419952 |
| 13467 | 738 | 0.861219958 | 13496 | 767 | 0.853380495 | 13525 | 796 | 0.845970172 | 13554 | 825 | 0.838001242 | 13583 | 854 | 0.829419952 |
| 13468 | 739 | 0.861219958 | 13497 | 768 | 0.853064989 | 13526 | 797 | 0.845928611 | 13555 | 826 | 0.83789426 | 13584 | 855 | 0.829204822 |
| 13469 | 740 | 0.860788683 | 13498 | 769 | 0.852941592 | 13527 | 798 | 0.844360302 | 13556 | 827 | 0.837792397 | 13585 | 856 | 0.829088809 |
| 13470 | 741 | 0.858283872 | 13499 | 770 | 0.852463294 | 13528 | 799 | 0.844186619 | 13557 | 828 | 0.837792397 | 13586 | 857 | 0.828966559 |
| 13471 | 742 | 0.858283872 | 13500 | 771 | 0.852463294 | 13529 | 800 | 0.844186619 | 13558 | 829 | 0.837792397 | 13587 | 858 | 0.828966559 |
| 13472 | 743 | 0.857770117 | 13501 | 772 | 0.852119842 | 13530 | 801 | 0.84397727 | 13559 | 830 | 0.837602624 | 13588 | 859 | 0.828556911 |
| 13473 | 744 | 0.857770117 | 13502 | 773 | 0.851829442 | 13531 | 802 | 0.843181755 | 13560 | 831 | 0.837514092 | 13589 | 860 | 0.82840391 |
| 13474 | 745 | 0.857674678 | 13503 | 774 | 0.851776662 | 13532 | 803 | 0.842716095 | 13561 | 832 | 0.837514092 | 13590 | 861 | 0.82840391 |
| 13475 | 746 | 0.857674678 | 13504 | 775 | 0.851365204 | 13533 | 804 | 0.842069604 | 13562 | 833 | 0.837124765 | 13591 | 862 | 0.828068483 |
| 13476 | 747 | 0.857439351 | 13505 | 776 | 0.851365204 | 13534 | 805 | 0.841988511 | 13563 | 834 | 0.836749672 | 13592 | 863 | 0.828068483 |
| 13477 | 748 | 0.856907779 | 13506 | 777 | 0.851365204 | 13535 | 806 | 0.841605366 | 13564 | 835 | 0.835709445 | 13593 | 864 | 0.828068483 |
| 13478 | 749 | 0.856760236 | 13507 | 778 | 0.851365204 | 13536 | 807 | 0.841605366 | 13565 | 836 | 0.83552879 | 13594 | 865 | 0.828068483 |
| 13479 | 750 | 0.85649932 | 13508 | 779 | 0.850971999 | 13537 | 808 | 0.841605366 | 13566 | 837 | 0.833636437 | 13595 | 866 | 0.827687104 |
| 13480 | 751 | 0.855912831 | 13509 | 780 | 0.850669776 | 13538 | 809 | 0.841461774 | 13567 | 838 | 0.833636437 | 13596 | 867 | 0.827476128 |
| 13481 | 752 | 0.855912831 | 13510 | 781 | 0.85059586 | 13539 | 810 | 0.841368887 | 13568 | 839 | 0.833636437 | 13597 | 868 | 0.827326963 |
| 13482 | 753 | 0.855912831 | 13511 | 782 | 0.850388163 | 13540 | 811 | 0.841146039 | 13569 | 840 | 0.833636437 | 13598 | 869 | 0.827326963 |
| 13483 | 754 | 0.855912831 | 13512 | 783 | 0.848087494 | 13541 | 812 | 0.841146039 | 13570 | 841 | 0.833636437 | 13599 | 870 | 0.827005858 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13600 | 871 | 0.826148415 | 13629 | 900 | 0.817067335 | 13658 | 929 | 0.811232327 | 13687 | 958 | 0.804429166 | 13716 | 987 | 0.797920885 |
| 13601 | 872 | 0.825811099 | 13630 | 901 | 0.816262341 | 13659 | 930 | 0.811232327 | 13688 | 959 | 0.80401397 | 13717 | 988 | 0.797920885 |
| 13602 | 873 | 0.825568815 | 13631 | 902 | 0.816112092 | 13660 | 931 | 0.810773554 | 13689 | 960 | 0.803524762 | 13718 | 989 | 0.797661217 |
| 13603 | 874 | 0.825036265 | 13632 | 903 | 0.815724847 | 13661 | 932 | 0.810155341 | 13690 | 961 | 0.803441651 | 13719 | 990 | 0.797612108 |
| 13604 | 875 | 0.825036265 | 13633 | 904 | 0.815411617 | 13662 | 933 | 0.809869715 | 13691 | 962 | 0.803147115 | 13720 | 991 | 0.797612108 |
| 13605 | 876 | 0.824862512 | 13634 | 905 | 0.815411617 | 13663 | 934 | 0.809757999 | 13692 | 963 | 0.802602203 | 13721 | 992 | 0.797424264 |
| 13606 | 877 | 0.823728148 | 13635 | 906 | 0.815250856 | 13664 | 935 | 0.809502757 | 13693 | 964 | 0.802227973 | 13722 | 993 | 0.797207171 |
| 13607 | 878 | 0.823233676 | 13636 | 907 | 0.815250856 | 13665 | 936 | 0.809502757 | 13694 | 965 | 0.802227973 | 13723 | 994 | 0.797085435 |
| 13608 | 879 | 0.822912571 | 13637 | 908 | 0.815153031 | 13666 | 937 | 0.809013962 | 13695 | 966 | 0.802227973 | 13724 | 995 | 0.797007541 |
| 13609 | 880 | 0.822641052 | 13638 | 909 | 0.815039948 | 13667 | 938 | 0.808930564 | 13696 | 967 | 0.802227973 | 13725 | 996 | 0.797007541 |
| 13610 | 881 | 0.82245227 | 13639 | 910 | 0.814976524 | 13668 | 939 | 0.808812853 | 13697 | 968 | 0.801747292 | 13726 | 997 | 0.796652871 |
| 13611 | 882 | 0.822206975 | 13640 | 911 | 0.814751093 | 13669 | 940 | 0.808552094 | 13698 | 969 | 0.801634268 | 13727 | 998 | 0.796209939 |
| 13612 | 883 | 0.822206975 | 13641 | 912 | 0.814751093 | 13670 | 941 | 0.808504952 | 13699 | 970 | 0.801451753 | 13728 | 999 | 0.796131821 |
| 13613 | 884 | 0.82140198 | 13642 | 913 | 0.814562556 | 13671 | 942 | 0.808330572 | 13700 | 971 | 0.801451753 | 13729 | 1000 | 0.79608143 |
| 13614 | 885 | 0.820955405 | 13643 | 914 | 0.814520146 | 13672 | 943 | 0.80814005 | 13701 | 972 | 0.801251664 | 13730 | 1001 | 0.79608143 |
| 13615 | 886 | 0.820955405 | 13644 | 915 | 0.81445312 | 13673 | 944 | 0.808082332 | 13702 | 973 | 0.801198594 | 13731 | 1002 | 0.795690551 |
| 13616 | 887 | 0.820474991 | 13645 | 916 | 0.81445312 | 13674 | 945 | 0.807700703 | 13703 | 974 | 0.800998024 | 13732 | 1003 | 0.795641118 |
| 13617 | 888 | 0.819774798 | 13646 | 917 | 0.814040881 | 13675 | 946 | 0.807421054 | 13704 | 975 | 0.800700379 | 13733 | 1004 | 0.795291445 |
| 13618 | 889 | 0.819774798 | 13647 | 918 | 0.813576643 | 13676 | 947 | 0.807161541 | 13705 | 976 | 0.800636177 | 13734 | 1005 | 0.79514228 |
| 13619 | 890 | 0.819721922 | 13648 | 919 | 0.813433051 | 13677 | 948 | 0.807038668 | 13706 | 977 | 0.799903465 | 13735 | 1006 | 0.795007034 |
| 13620 | 891 | 0.819395998 | 13649 | 920 | 0.813160851 | 13678 | 949 | 0.806694809 | 13707 | 978 | 0.799829874 | 13736 | 1007 | 0.794883848 |
| 13621 | 892 | 0.818857505 | 13650 | 921 | 0.812951838 | 13679 | 950 | 0.806341939 | 13708 | 979 | 0.799617349 | 13737 | 1008 | 0.794718371 |
| 13622 | 893 | 0.818787316 | 13651 | 922 | 0.812447138 | 13680 | 951 | 0.806239414 | 13709 | 980 | 0.799617349 | 13738 | 1009 | 0.793963732 |
| 13623 | 894 | 0.818787316 | 13652 | 923 | 0.812447138 | 13681 | 952 | 0.805607713 | 13710 | 981 | 0.799388593 | 13739 | 1010 | 0.79389193 |
| 13624 | 895 | 0.818319679 | 13653 | 924 | 0.812447138 | 13682 | 953 | 0.805607713 | 13711 | 982 | 0.799104787 | 13740 | 1011 | 0.793607315 |
| 13625 | 896 | 0.818124271 | 13654 | 925 | 0.811780531 | 13683 | 954 | 0.805607713 | 13712 | 983 | 0.798360676 | 13741 | 1012 | 0.793257275 |
| 13626 | 897 | 0.817648331 | 13655 | 926 | 0.811681861 | 13684 | 955 | 0.805607713 | 13713 | 984 | 0.797920885 | 13742 | 1013 | 0.793162894 |
| 13627 | 898 | 0.817506936 | 13656 | 927 | 0.811360042 | 13685 | 956 | 0.805607713 | 13714 | 985 | 0.797920885 | 13743 | 1014 | 0.792243752 |
| 13628 | 899 | 0.817246021 | 13657 | 928 | 0.811360042 | 13686 | 957 | 0.804946183 | 13715 | 986 | 0.797920885 | 13744 | 1015 | 0.792243752 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13745 | 1016 | 0.792243752 | 13774 | 1045 | 0.784787869 | 13803 | 1074 | 0.77858887 | 13832 | 1103 | 0.773760346 | 13861 | 1132 | 0.767117734 |
| 13746 | 1017 | 0.792243752 | 13775 | 1046 | 0.784010434 | 13804 | 1075 | 0.778528049 | 13833 | 1104 | 0.773548133 | 13862 | 1133 | 0.767044318 |
| 13747 | 1018 | 0.792243752 | 13776 | 1047 | 0.78386482 | 13805 | 1076 | 0.778455467 | 13834 | 1105 | 0.772938596 | 13863 | 1134 | 0.766689647 |
| 13748 | 1019 | 0.791281859 | 13777 | 1048 | 0.783662462 | 13806 | 1077 | 0.778258105 | 13835 | 1106 | 0.772938596 | 13864 | 1135 | 0.766689647 |
| 13749 | 1020 | 0.791232588 | 13778 | 1049 | 0.783662462 | 13807 | 1078 | 0.778258105 | 13836 | 1107 | 0.772938596 | 13865 | 1136 | 0.766689647 |
| 13750 | 1021 | 0.790972025 | 13779 | 1050 | 0.783418887 | 13808 | 1079 | 0.777936287 | 13837 | 1108 | 0.772428562 | 13866 | 1137 | 0.766689647 |
| 13751 | 1022 | 0.790530556 | 13780 | 1051 | 0.783226933 | 13809 | 1080 | 0.777520495 | 13838 | 1109 | 0.771681593 | 13867 | 1138 | 0.766401175 |
| 13752 | 1023 | 0.790170743 | 13781 | 1052 | 0.783100372 | 13810 | 1081 | 0.777318074 | 13839 | 1110 | 0.771681593 | 13868 | 1139 | 0.765563072 |
| 13753 | 1024 | 0.789619608 | 13782 | 1053 | 0.782816835 | 13811 | 1082 | 0.777318074 | 13840 | 1111 | 0.771681593 | 13869 | 1140 | 0.765563072 |
| 13754 | 1025 | 0.789619608 | 13783 | 1054 | 0.782483914 | 13812 | 1083 | 0.777318074 | 13841 | 1112 | 0.77148853 | 13870 | 1141 | 0.765563072 |
| 13755 | 1026 | 0.789432774 | 13784 | 1055 | 0.782483914 | 13813 | 1084 | 0.776962532 | 13842 | 1113 | 0.771225401 | 13871 | 1142 | 0.765450575 |
| 13756 | 1027 | 0.789217297 | 13785 | 1056 | 0.782483914 | 13814 | 1085 | 0.776449484 | 13843 | 1114 | 0.770845607 | 13872 | 1143 | 0.765313118 |
| 13757 | 1028 | 0.788966042 | 13786 | 1057 | 0.782208259 | 13815 | 1086 | 0.776283628 | 13844 | 1115 | 0.770641952 | 13873 | 1144 | 0.764920624 |
| 13758 | 1029 | 0.788669291 | 13787 | 1058 | 0.781840991 | 13816 | 1087 | 0.776097116 | 13845 | 1116 | 0.770641952 | 13874 | 1145 | 0.764920624 |
| 13759 | 1030 | 0.788669291 | 13788 | 1059 | 0.781412904 | 13817 | 1088 | 0.776097116 | 13846 | 1117 | 0.769967357 | 13875 | 1146 | 0.764920624 |
| 13760 | 1031 | 0.78849981 | 13789 | 1060 | 0.780784129 | 13818 | 1089 | 0.775885832 | 13847 | 1118 | 0.76987555 | 13876 | 1147 | 0.764439412 |
| 13761 | 1032 | 0.788439688 | 13790 | 1061 | 0.780557993 | 13819 | 1090 | 0.77564449 | 13848 | 1119 | 0.769802883 | 13877 | 1148 | 0.764439412 |
| 13762 | 1033 | 0.788178563 | 13791 | 1062 | 0.780077845 | 13820 | 1091 | 0.77564449 | 13849 | 1120 | 0.769695157 | 13878 | 1149 | 0.764215028 |
| 13763 | 1034 | 0.788178563 | 13792 | 1063 | 0.780009295 | 13821 | 1092 | 0.77564449 | 13850 | 1121 | 0.769695157 | 13879 | 1150 | 0.764085175 |
| 13764 | 1035 | 0.788107582 | 13793 | 1064 | 0.779902313 | 13822 | 1093 | 0.775439682 | 13851 | 1122 | 0.769178448 | 13880 | 1151 | 0.76359857 |
| 13765 | 1036 | 0.787455451 | 13794 | 1065 | 0.779278774 | 13823 | 1094 | 0.775210412 | 13852 | 1123 | 0.769178448 | 13881 | 1152 | 0.76359857 |
| 13766 | 1037 | 0.787336417 | 13795 | 1066 | 0.779278774 | 13824 | 1095 | 0.775210412 | 13853 | 1124 | 0.769178448 | 13882 | 1153 | 0.763055363 |
| 13767 | 1038 | 0.785712884 | 13796 | 1067 | 0.779278774 | 13825 | 1096 | 0.775041722 | 13854 | 1125 | 0.768762656 | 13883 | 1154 | 0.762954376 |
| 13768 | 1039 | 0.785489424 | 13797 | 1068 | 0.779278774 | 13826 | 1097 | 0.775041722 | 13855 | 1126 | 0.768602842 | 13884 | 1155 | 0.762573081 |
| 13769 | 1040 | 0.785489424 | 13798 | 1069 | 0.779278774 | 13827 | 1098 | 0.774793766 | 13856 | 1127 | 0.768602842 | 13885 | 1156 | 0.761754429 |
| 13770 | 1041 | 0.785124011 | 13799 | 1070 | 0.779278774 | 13828 | 1099 | 0.774658577 | 13857 | 1128 | 0.768602842 | 13886 | 1157 | 0.761754429 |
| 13771 | 1042 | 0.784993258 | 13800 | 1071 | 0.779278774 | 13829 | 1100 | 0.774050747 | 13858 | 1129 | 0.768465905 | 13887 | 1158 | 0.761754429 |
| 13772 | 1043 | 0.784993258 | 13801 | 1072 | 0.779278774 | 13830 | 1101 | 0.773933544 | 13859 | 1130 | 0.767819152 | 13888 | 1159 | 0.760795369 |
| 13773 | 1044 | 0.78483782 | 13802 | 1073 | 0.77858887 | 13831 | 1102 | 0.773933544 | 13860 | 1131 | 0.767819152 | 13889 | 1160 | 0.760529338 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 13890 | 1161 | 0.759952663 | 13919 | 1190 | 0.754455191 | 13948 | 1219 | 0.746768362 | 13977 | 1248 | 0.742555967 | 14006 | 1277 | 0.73755444 |
| 13891 | 1162 | 0.759534716 | 13920 | 1191 | 0.754455191 | 13949 | 1220 | 0.746768362 | 13978 | 1249 | 0.742045933 | 14007 | 1278 | 0.737421851 |
| 13892 | 1163 | 0.759475992 | 13921 | 1192 | 0.754455191 | 13950 | 1221 | 0.746486261 | 13979 | 1250 | 0.741718369 | 14008 | 1279 | 0.737421851 |
| 13893 | 1164 | 0.759307694 | 13922 | 1193 | 0.754455191 | 13951 | 1222 | 0.746182665 | 13980 | 1251 | 0.741490214 | 14009 | 1280 | 0.736726424 |
| 13894 | 1165 | 0.759002818 | 13923 | 1194 | 0.752554555 | 13952 | 1223 | 0.746022023 | 13981 | 1252 | 0.741091229 | 14010 | 1281 | 0.736726424 |
| 13895 | 1166 | 0.75886431 | 13924 | 1195 | 0.75239203 | 13953 | 1224 | 0.746022023 | 13982 | 1253 | 0.740882384 | 14011 | 1282 | 0.736726424 |
| 13896 | 1167 | 0.758733989 | 13925 | 1196 | 0.75219911 | 13954 | 1225 | 0.745855019 | 13983 | 1254 | 0.74081131 | 14012 | 1283 | 0.736726424 |
| 13897 | 1168 | 0.758183063 | 13926 | 1197 | 0.752126528 | 13955 | 1226 | 0.745855019 | 13984 | 1255 | 0.740753913 | 14013 | 1284 | 0.736281222 |
| 13898 | 1169 | 0.758089475 | 13927 | 1198 | 0.752049121 | 13956 | 1227 | 0.745769012 | 13985 | 1256 | 0.740214752 | 14014 | 1285 | 0.736230371 |
| 13899 | 1170 | 0.757481645 | 13928 | 1199 | 0.75196639 | 13957 | 1228 | 0.745500348 | 13986 | 1257 | 0.740214752 | 14015 | 1286 | 0.736083501 |
| 13900 | 1171 | 0.757144329 | 13929 | 1200 | 0.751877768 | 13958 | 1229 | 0.745500348 | 13987 | 1258 | 0.740214752 | 14016 | 1287 | 0.735971785 |
| 13901 | 1172 | 0.757144329 | 13930 | 1201 | 0.751569503 | 13959 | 1230 | 0.745500348 | 13988 | 1259 | 0.740214752 | 14017 | 1288 | 0.735705755 |
| 13902 | 1173 | 0.757095287 | 13931 | 1202 | 0.751319477 | 13960 | 1231 | 0.745214534 | 13989 | 1260 | 0.740214752 | 14018 | 1289 | 0.735392185 |
| 13903 | 1174 | 0.757048001 | 13932 | 1203 | 0.751319477 | 13961 | 1232 | 0.745115164 | 13990 | 1261 | 0.739802903 | 14019 | 1290 | 0.735281183 |
| 13904 | 1175 | 0.757048001 | 13933 | 1204 | 0.751177481 | 13962 | 1233 | 0.745115164 | 13991 | 1262 | 0.739731934 | 14020 | 1291 | 0.734933051 |
| 13905 | 1176 | 0.756874665 | 13934 | 1205 | 0.751022015 | 13963 | 1234 | 0.745115164 | 13992 | 1263 | 0.739731934 | 14021 | 1292 | 0.734933051 |
| 13906 | 1177 | 0.756723052 | 13935 | 1206 | 0.750662202 | 13964 | 1235 | 0.744782308 | 13993 | 1264 | 0.739731934 | 14022 | 1293 | 0.734800503 |
| 13907 | 1178 | 0.756470482 | 13936 | 1207 | 0.750662202 | 13965 | 1236 | 0.74447097 | 13994 | 1265 | 0.739631414 | 14023 | 1294 | 0.734646797 |
| 13908 | 1179 | 0.756364181 | 13937 | 1208 | 0.750560147 | 13966 | 1237 | 0.744236026 | 13995 | 1266 | 0.739631414 | 14024 | 1295 | 0.734251805 |
| 13909 | 1180 | 0.755905257 | 13938 | 1209 | 0.749315551 | 13967 | 1238 | 0.744236026 | 13996 | 1267 | 0.739631414 | 14025 | 1296 | 0.734251805 |
| 13910 | 1181 | 0.754455191 | 13939 | 1210 | 0.749315551 | 13968 | 1239 | 0.744236026 | 13997 | 1268 | 0.739215224 | 14026 | 1297 | 0.733992137 |
| 13911 | 1182 | 0.754455191 | 13940 | 1211 | 0.749026439 | 13969 | 1240 | 0.743939072 | 13998 | 1269 | 0.739215224 | 14027 | 1298 | 0.733933524 |
| 13912 | 1183 | 0.754455191 | 13941 | 1212 | 0.748464827 | 13970 | 1241 | 0.743806456 | 13999 | 1270 | 0.739215224 | 14028 | 1299 | 0.733452244 |
| 13913 | 1184 | 0.754455191 | 13942 | 1213 | 0.748464827 | 13971 | 1242 | 0.743731325 | 14000 | 1271 | 0.739080329 | 14029 | 1300 | 0.733265892 |
| 13914 | 1185 | 0.754455191 | 13943 | 1214 | 0.748115013 | 13972 | 1243 | 0.743459806 | 14001 | 1272 | 0.738660924 | 14030 | 1301 | 0.733265892 |
| 13915 | 1186 | 0.754455191 | 13944 | 1215 | 0.747276606 | 13973 | 1244 | 0.742934768 | 14002 | 1273 | 0.738217992 | 14031 | 1302 | 0.732966275 |
| 13916 | 1187 | 0.754455191 | 13945 | 1216 | 0.747276606 | 13974 | 1245 | 0.742934768 | 14003 | 1274 | 0.738064775 | 14032 | 1303 | 0.732735941 |
| 13917 | 1188 | 0.754455191 | 13946 | 1217 | 0.747094091 | 13975 | 1246 | 0.742873318 | 14004 | 1275 | 0.738064775 | 14033 | 1304 | 0.732553349 |
| 13918 | 1189 | 0.754455191 | 13947 | 1218 | 0.746902053 | 13976 | 1247 | 0.742555967 | 14005 | 1276 | 0.737749497 | 14034 | 1305 | 0.732553349 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14035 | 1306 | 0.732553349 | 14064 | 1335 | 0.726426467 | 14093 | 1364 | 0.72084659 | 14122 | 1393 | 0.716365141 | 14151 | 1422 | 0.711420559 |
| 14036 | 1307 | 0.73240505 | 14065 | 1336 | 0.726002558 | 14094 | 1365 | 0.720596923 | 14123 | 1394 | 0.716365141 | 14152 | 1423 | 0.711117174 |
| 14037 | 1308 | 0.73240505 | 14066 | 1337 | 0.725924102 | 14095 | 1366 | 0.720550527 | 14124 | 1395 | 0.716250838 | 14153 | 1424 | 0.710989497 |
| 14038 | 1309 | 0.732282212 | 14067 | 1338 | 0.725924102 | 14096 | 1367 | 0.719693084 | 14125 | 1396 | 0.715996939 | 14154 | 1425 | 0.710874619 |
| 14039 | 1310 | 0.732178796 | 14068 | 1339 | 0.725810009 | 14097 | 1368 | 0.719693084 | 14126 | 1397 | 0.715996939 | 14155 | 1426 | 0.710676266 |
| 14040 | 1311 | 0.731712064 | 14069 | 1340 | 0.725810009 | 14098 | 1369 | 0.719693084 | 14127 | 1398 | 0.715996939 | 14156 | 1427 | 0.710511041 |
| 14041 | 1312 | 0.731712064 | 14070 | 1341 | 0.725491495 | 14099 | 1370 | 0.719693084 | 14128 | 1399 | 0.715780495 | 14157 | 1428 | 0.710438362 |
| 14042 | 1313 | 0.730974095 | 14071 | 1342 | 0.725296962 | 14100 | 1371 | 0.719693084 | 14129 | 1400 | 0.715702602 | 14158 | 1429 | 0.710251528 |
| 14043 | 1314 | 0.730974095 | 14072 | 1343 | 0.725296962 | 14101 | 1372 | 0.719693084 | 14130 | 1401 | 0.715702602 | 14159 | 1430 | 0.710251528 |
| 14044 | 1315 | 0.730974095 | 14073 | 1344 | 0.725115059 | 14102 | 1373 | 0.719693084 | 14131 | 1402 | 0.715201892 | 14160 | 1431 | 0.709642846 |
| 14045 | 1316 | 0.730974095 | 14074 | 1345 | 0.725000211 | 14103 | 1374 | 0.719693084 | 14132 | 1403 | 0.714660647 | 14161 | 1432 | 0.7086977 |
| 14046 | 1317 | 0.730186616 | 14075 | 1346 | 0.724863318 | 14104 | 1375 | 0.719693084 | 14133 | 1404 | 0.714337968 | 14162 | 1433 | 0.7086977 |
| 14047 | 1318 | 0.730095845 | 14076 | 1347 | 0.72478452 | 14105 | 1376 | 0.718791123 | 14134 | 1405 | 0.714160596 | 14163 | 1434 | 0.7086977 |
| 14048 | 1319 | 0.730095845 | 14077 | 1348 | 0.724491967 | 14106 | 1377 | 0.718739638 | 14135 | 1406 | 0.713971072 | 14164 | 1435 | 0.7086977 |
| 14049 | 1320 | 0.730042132 | 14078 | 1349 | 0.724491967 | 14107 | 1378 | 0.718410087 | 14136 | 1407 | 0.71383734 | 14165 | 1436 | 0.708225897 |
| 14050 | 1321 | 0.729981421 | 14079 | 1350 | 0.724491967 | 14108 | 1379 | 0.718243018 | 14137 | 1408 | 0.71383734 | 14166 | 1437 | 0.707829979 |
| 14051 | 1322 | 0.72934447 | 14080 | 1351 | 0.723889199 | 14109 | 1380 | 0.717938357 | 14138 | 1409 | 0.713550203 | 14167 | 1438 | 0.707556321 |
| 14052 | 1323 | 0.728901086 | 14081 | 1352 | 0.723889199 | 14110 | 1381 | 0.717565924 | 14139 | 1410 | 0.713550203 | 14168 | 1439 | 0.707556321 |
| 14053 | 1324 | 0.728901086 | 14082 | 1353 | 0.723720574 | 14111 | 1382 | 0.717471624 | 14140 | 1411 | 0.713062506 | 14169 | 1440 | 0.707202709 |
| 14054 | 1325 | 0.728574672 | 14083 | 1354 | 0.723420957 | 14112 | 1383 | 0.717471624 | 14141 | 1412 | 0.713062506 | 14170 | 1441 | 0.707202709 |
| 14055 | 1326 | 0.728441758 | 14084 | 1355 | 0.723162832 | 14113 | 1384 | 0.717313383 | 14142 | 1413 | 0.713062506 | 14171 | 1442 | 0.707030541 |
| 14056 | 1327 | 0.728369622 | 14085 | 1356 | 0.723046726 | 14114 | 1385 | 0.716992799 | 14143 | 1414 | 0.712716316 | 14172 | 1443 | 0.707030541 |
| 14057 | 1328 | 0.727471701 | 14086 | 1357 | 0.722740778 | 14115 | 1386 | 0.716839003 | 14144 | 1415 | 0.712490689 | 14173 | 1444 | 0.706813556 |
| 14058 | 1329 | 0.727302945 | 14087 | 1358 | 0.722566046 | 14116 | 1387 | 0.71666663 | 14145 | 1416 | 0.712214274 | 14174 | 1445 | 0.706813556 |
| 14059 | 1330 | 0.727302945 | 14088 | 1359 | 0.722485985 | 14117 | 1388 | 0.71666663 | 14146 | 1417 | 0.712214274 | 14175 | 1446 | 0.706728107 |
| 14060 | 1331 | 0.727016942 | 14089 | 1360 | 0.721366668 | 14118 | 1389 | 0.71666663 | 14147 | 1418 | 0.712051342 | 14176 | 1447 | 0.706531638 |
| 14061 | 1332 | 0.726426467 | 14090 | 1361 | 0.721031435 | 14119 | 1390 | 0.71666663 | 14148 | 1419 | 0.712051342 | 14177 | 1448 | 0.706531638 |
| 14062 | 1333 | 0.726426467 | 14091 | 1362 | 0.720932157 | 14120 | 1391 | 0.716472097 | 14149 | 1420 | 0.711810936 | 14178 | 1449 | 0.70629163 |
| 14063 | 1334 | 0.726426467 | 14092 | 1363 | 0.72084659 | 14121 | 1392 | 0.716365141 | 14150 | 1421 | 0.711642081 | 14179 | 1450 | 0.706150511 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14180 | 1451 | 0.706150511 | 14209 | 1480 | 0.701842854 | 14238 | 1509 | 0.695860475 | 14267 | 1538 | 0.690621637 | 14296 | 1567 | 0.687508401 |
| 14181 | 1452 | 0.705991807 | 14210 | 1481 | 0.701519116 | 14239 | 1510 | 0.695860475 | 14268 | 1539 | 0.690337691 | 14297 | 1568 | 0.687508401 |
| 14182 | 1453 | 0.705606623 | 14211 | 1482 | 0.701209679 | 14240 | 1511 | 0.69567719 | 14269 | 1540 | 0.690337691 | 14298 | 1569 | 0.686190359 |
| 14183 | 1454 | 0.705606623 | 14212 | 1483 | 0.701209679 | 14241 | 1512 | 0.695333739 | 14270 | 1541 | 0.690101212 | 14299 | 1570 | 0.685374272 |
| 14184 | 1455 | 0.705606623 | 14213 | 1484 | 0.700538213 | 14242 | 1513 | 0.695333739 | 14271 | 1542 | 0.690101212 | 14300 | 1571 | 0.685216604 |
| 14185 | 1456 | 0.70531796 | 14214 | 1485 | 0.700387929 | 14243 | 1514 | 0.695018003 | 14272 | 1543 | 0.689901214 | 14301 | 1572 | 0.685216604 |
| 14186 | 1457 | 0.70531796 | 14215 | 1486 | 0.700097528 | 14244 | 1515 | 0.694869501 | 14273 | 1544 | 0.689901214 | 14302 | 1573 | 0.685128699 |
| 14187 | 1458 | 0.705237168 | 14216 | 1487 | 0.700097528 | 14245 | 1516 | 0.694457261 | 14274 | 1545 | 0.689812356 | 14303 | 1574 | 0.685128699 |
| 14188 | 1459 | 0.705093576 | 14217 | 1488 | 0.699742858 | 14246 | 1517 | 0.694457261 | 14275 | 1546 | 0.689729861 | 14304 | 1575 | 0.685033782 |
| 14189 | 1460 | 0.705093576 | 14218 | 1489 | 0.698937863 | 14247 | 1518 | 0.694457261 | 14276 | 1547 | 0.689729861 | 14305 | 1576 | 0.684930978 |
| 14190 | 1461 | 0.704767407 | 14219 | 1490 | 0.698937863 | 14248 | 1519 | 0.694267985 | 14277 | 1548 | 0.68923522 | 14306 | 1577 | 0.684930978 |
| 14191 | 1462 | 0.704767407 | 14220 | 1491 | 0.698597373 | 14249 | 1520 | 0.694088746 | 14278 | 1549 | 0.687508401 | 14307 | 1578 | 0.684697424 |
| 14192 | 1463 | 0.70454174 | 14221 | 1492 | 0.698232266 | 14250 | 1521 | 0.693974443 | 14279 | 1550 | 0.687508401 | 14308 | 1579 | 0.68456402 |
| 14193 | 1464 | 0.704376326 | 14222 | 1493 | 0.697973835 | 14251 | 1522 | 0.693364146 | 14280 | 1551 | 0.687508401 | 14309 | 1580 | 0.68456402 |
| 14194 | 1465 | 0.704150072 | 14223 | 1494 | 0.697973835 | 14252 | 1523 | 0.693185534 | 14281 | 1552 | 0.687508401 | 14310 | 1581 | 0.68456402 |
| 14195 | 1466 | 0.704002579 | 14224 | 1495 | 0.697973835 | 14253 | 1524 | 0.693185534 | 14282 | 1553 | 0.687508401 | 14311 | 1582 | 0.684255244 |
| 14196 | 1467 | 0.704002579 | 14225 | 1496 | 0.697973835 | 14254 | 1525 | 0.693017496 | 14283 | 1554 | 0.687508401 | 14312 | 1583 | 0.684255244 |
| 14197 | 1468 | 0.703898817 | 14226 | 1497 | 0.697550339 | 14255 | 1526 | 0.693017496 | 14284 | 1555 | 0.687508401 | 14313 | 1584 | 0.683874116 |
| 14198 | 1469 | 0.703898817 | 14227 | 1498 | 0.697550339 | 14256 | 1527 | 0.692937153 | 14285 | 1556 | 0.687508401 | 14314 | 1585 | 0.68352402 |
| 14199 | 1470 | 0.703302668 | 14228 | 1499 | 0.69741669 | 14257 | 1528 | 0.692307284 | 14286 | 1557 | 0.687508401 | 14315 | 1586 | 0.683099282 |
| 14200 | 1471 | 0.703302668 | 14229 | 1500 | 0.69741669 | 14258 | 1529 | 0.691962743 | 14287 | 1558 | 0.687508401 | 14316 | 1587 | 0.683099282 |
| 14201 | 1472 | 0.703302668 | 14230 | 1501 | 0.697159787 | 14259 | 1530 | 0.691962743 | 14288 | 1559 | 0.687508401 | 14317 | 1588 | 0.683099282 |
| 14202 | 1473 | 0.702815518 | 14231 | 1502 | 0.697159787 | 14260 | 1531 | 0.69157359 | 14289 | 1560 | 0.687508401 | 14318 | 1589 | 0.682761966 |
| 14203 | 1474 | 0.702748368 | 14232 | 1503 | 0.697159787 | 14261 | 1532 | 0.691173355 | 14290 | 1561 | 0.687508401 | 14319 | 1590 | 0.682637758 |
| 14204 | 1475 | 0.702748368 | 14233 | 1504 | 0.697159787 | 14262 | 1533 | 0.690968933 | 14291 | 1562 | 0.687508401 | 14320 | 1591 | 0.682368761 |
| 14205 | 1476 | 0.702659745 | 14234 | 1505 | 0.696798477 | 14263 | 1534 | 0.690968933 | 14292 | 1563 | 0.687508401 | 14321 | 1592 | 0.682368761 |
| 14206 | 1477 | 0.702357522 | 14235 | 1506 | 0.696463244 | 14264 | 1535 | 0.690968933 | 14293 | 1564 | 0.687508401 | 14322 | 1593 | 0.681639467 |
| 14207 | 1478 | 0.702231658 | 14236 | 1507 | 0.696151363 | 14265 | 1536 | 0.690786111 | 14294 | 1565 | 0.687508401 | 14323 | 1594 | 0.681137219 |
| 14208 | 1479 | 0.701842854 | 14237 | 1508 | 0.696052175 | 14266 | 1537 | 0.690701757 | 14295 | 1566 | 0.687508401 | 14324 | 1595 | 0.681026274 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14325 | 1596 | 0.680668977 | 14354 | 1625 | 0.675273945 | 14383 | 1654 | 0.670134305 | 14412 | 1683 | 0.663374721 | 14441 | 1712 | 0.660185274 |
| 14326 | 1597 | 0.680408061 | 14355 | 1626 | 0.674858153 | 14384 | 1655 | 0.669779634 | 14413 | 1684 | 0.663374721 | 14442 | 1713 | 0.660185274 |
| 14327 | 1598 | 0.680329816 | 14356 | 1627 | 0.674858153 | 14385 | 1656 | 0.669283581 | 14414 | 1685 | 0.66294021 | 14443 | 1714 | 0.659618186 |
| 14328 | 1599 | 0.680269992 | 14357 | 1628 | 0.67477158 | 14386 | 1657 | 0.669283581 | 14415 | 1686 | 0.662841518 | 14444 | 1715 | 0.659618186 |
| 14329 | 1600 | 0.680269992 | 14358 | 1629 | 0.67477158 | 14387 | 1658 | 0.668668578 | 14416 | 1687 | 0.662684817 | 14445 | 1716 | 0.659618186 |
| 14330 | 1601 | 0.680126447 | 14359 | 1630 | 0.673720117 | 14388 | 1659 | 0.668540562 | 14417 | 1688 | 0.662565979 | 14446 | 1717 | 0.659479678 |
| 14331 | 1602 | 0.680126447 | 14360 | 1631 | 0.673631998 | 14389 | 1660 | 0.668540562 | 14418 | 1689 | 0.662565979 | 14447 | 1718 | 0.659479678 |
| 14332 | 1603 | 0.679821572 | 14361 | 1632 | 0.673631998 | 14390 | 1661 | 0.66843452 | 14419 | 1690 | 0.662397681 | 14448 | 1719 | 0.659251642 |
| 14333 | 1604 | 0.679821572 | 14362 | 1633 | 0.673631998 | 14391 | 1662 | 0.66843452 | 14420 | 1691 | 0.662397681 | 14449 | 1720 | 0.659071698 |
| 14334 | 1605 | 0.679490429 | 14363 | 1634 | 0.67342194 | 14392 | 1663 | 0.668345242 | 14421 | 1692 | 0.662140929 | 14450 | 1721 | 0.658926083 |
| 14335 | 1606 | 0.678412896 | 14364 | 1635 | 0.673267962 | 14393 | 1664 | 0.667838874 | 14422 | 1693 | 0.662140929 | 14451 | 1722 | 0.65880583 |
| 14336 | 1607 | 0.678066845 | 14365 | 1636 | 0.673150251 | 14394 | 1665 | 0.667305015 | 14423 | 1694 | 0.661954297 | 14452 | 1723 | 0.65880583 |
| 14337 | 1608 | 0.677920937 | 14366 | 1637 | 0.673150251 | 14395 | 1666 | 0.666319102 | 14424 | 1695 | 0.661701138 | 14453 | 1724 | 0.657545178 |
| 14338 | 1609 | 0.677920937 | 14367 | 1638 | 0.672268435 | 14396 | 1667 | 0.666145349 | 14425 | 1696 | 0.661701138 | 14454 | 1725 | 0.657545178 |
| 14339 | 1610 | 0.677920937 | 14368 | 1639 | 0.672268435 | 14397 | 1668 | 0.666145349 | 14426 | 1697 | 0.661701138 | 14455 | 1726 | 0.657545178 |
| 14340 | 1611 | 0.677693419 | 14369 | 1640 | 0.672268435 | 14398 | 1669 | 0.666145349 | 14427 | 1698 | 0.661475471 | 14456 | 1727 | 0.657545178 |
| 14341 | 1612 | 0.677693419 | 14370 | 1641 | 0.672268435 | 14399 | 1670 | 0.665663068 | 14428 | 1699 | 0.661422833 | 14457 | 1728 | 0.657545178 |
| 14342 | 1613 | 0.677289236 | 14371 | 1642 | 0.671714134 | 14400 | 1671 | 0.665514107 | 14429 | 1700 | 0.661338167 | 14458 | 1729 | 0.657545178 |
| 14343 | 1614 | 0.676941104 | 14372 | 1643 | 0.671617806 | 14401 | 1672 | 0.665514107 | 14430 | 1701 | 0.661179462 | 14459 | 1730 | 0.657545178 |
| 14344 | 1615 | 0.676784536 | 14373 | 1644 | 0.671480956 | 14402 | 1673 | 0.665232006 | 14431 | 1702 | 0.661179462 | 14460 | 1731 | 0.657545178 |
| 14345 | 1616 | 0.676372035 | 14374 | 1645 | 0.671480956 | 14403 | 1674 | 0.665232006 | 14432 | 1703 | 0.661179462 | 14461 | 1732 | 0.657545178 |
| 14346 | 1617 | 0.676227391 | 14375 | 1646 | 0.671271202 | 14404 | 1675 | 0.665232006 | 14433 | 1704 | 0.660774148 | 14462 | 1733 | 0.657545178 |
| 14347 | 1618 | 0.676227391 | 14376 | 1647 | 0.671117985 | 14405 | 1676 | 0.664844416 | 14434 | 1705 | 0.660774148 | 14463 | 1734 | 0.657545178 |
| 14348 | 1619 | 0.676168475 | 14377 | 1648 | 0.670909139 | 14406 | 1677 | 0.664844416 | 14435 | 1706 | 0.660774148 | 14464 | 1735 | 0.6566687 |
| 14349 | 1620 | 0.675926529 | 14378 | 1649 | 0.670909139 | 14407 | 1678 | 0.664494038 | 14436 | 1707 | 0.660774148 | 14465 | 1736 | 0.6566687 |
| 14350 | 1621 | 0.675787599 | 14379 | 1650 | 0.670909139 | 14408 | 1679 | 0.664494038 | 14437 | 1708 | 0.660450168 | 14466 | 1737 | 0.656612214 |
| 14351 | 1622 | 0.675738183 | 14380 | 1651 | 0.670607651 | 14409 | 1680 | 0.663374721 | 14438 | 1709 | 0.660450168 | 14467 | 1738 | 0.656547945 |
| 14352 | 1623 | 0.675738183 | 14381 | 1652 | 0.670134305 | 14410 | 1681 | 0.663374721 | 14439 | 1710 | 0.660450168 | 14468 | 1739 | 0.656388601 |
| 14353 | 1624 | 0.675738183 | 14382 | 1653 | 0.670134305 | 14411 | 1682 | 0.663374721 | 14440 | 1711 | 0.660185274 | 14469 | 1740 | 0.656388601 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14470 | 1741 | 0.656288174 | 14499 | 1770 | 0.652581758 | 14528 | 1799 | 0.646549793 | 14557 | 1828 | 0.641481246 | 14586 | 1857 | 0.638290378 |
| 14471 | 1742 | 0.656288174 | 14500 | 1771 | 0.651792849 | 14529 | 1800 | 0.646361011 | 14558 | 1829 | 0.641481246 | 14587 | 1858 | 0.638290378 |
| 14472 | 1743 | 0.656168649 | 14501 | 1772 | 0.651792849 | 14530 | 1801 | 0.646361011 | 14559 | 1830 | 0.641307979 | 14588 | 1859 | 0.638173774 |
| 14473 | 1744 | 0.655845393 | 14502 | 1773 | 0.651792849 | 14531 | 1802 | 0.645784067 | 14560 | 1831 | 0.641307979 | 14589 | 1860 | 0.638082698 |
| 14474 | 1745 | 0.655845393 | 14503 | 1774 | 0.650914599 | 14532 | 1803 | 0.645784067 | 14561 | 1832 | 0.641098327 | 14590 | 1861 | 0.637634344 |
| 14475 | 1746 | 0.655482017 | 14504 | 1775 | 0.650705753 | 14533 | 1804 | 0.645645954 | 14562 | 1833 | 0.641098327 | 14591 | 1862 | 0.637634344 |
| 14476 | 1747 | 0.655482017 | 14505 | 1776 | 0.650612165 | 14534 | 1805 | 0.645310721 | 14563 | 1834 | 0.641098327 | 14592 | 1863 | 0.637341792 |
| 14477 | 1748 | 0.655323718 | 14506 | 1777 | 0.650524835 | 14535 | 1806 | 0.645310721 | 14564 | 1835 | 0.640976076 | 14593 | 1864 | 0.637341792 |
| 14478 | 1749 | 0.655203962 | 14507 | 1778 | 0.650366593 | 14536 | 1807 | 0.645104553 | 14565 | 1836 | 0.640976076 | 14594 | 1865 | 0.637341792 |
| 14479 | 1750 | 0.654921034 | 14508 | 1779 | 0.650366593 | 14537 | 1808 | 0.644580201 | 14566 | 1837 | 0.640511838 | 14595 | 1866 | 0.636983019 |
| 14480 | 1751 | 0.654752278 | 14509 | 1780 | 0.64971984 | 14538 | 1809 | 0.644580201 | 14567 | 1838 | 0.640511838 | 14596 | 1867 | 0.636655702 |
| 14481 | 1752 | 0.654659489 | 14510 | 1781 | 0.649576248 | 14539 | 1810 | 0.644580201 | 14568 | 1839 | 0.640511838 | 14597 | 1868 | 0.636080224 |
| 14482 | 1753 | 0.654659489 | 14511 | 1782 | 0.649350699 | 14540 | 1811 | 0.644042707 | 14569 | 1840 | 0.640511838 | 14598 | 1869 | 0.636080224 |
| 14483 | 1754 | 0.654152235 | 14512 | 1783 | 0.649219789 | 14541 | 1812 | 0.644042707 | 14570 | 1841 | 0.640511838 | 14599 | 1870 | 0.636080224 |
| 14484 | 1755 | 0.654084646 | 14513 | 1784 | 0.64911201 | 14542 | 1813 | 0.643914275 | 14571 | 1842 | 0.640511838 | 14600 | 1871 | 0.635825928 |
| 14485 | 1756 | 0.654084646 | 14514 | 1785 | 0.648821609 | 14543 | 1814 | 0.643304739 | 14572 | 1843 | 0.640152769 | 14601 | 1872 | 0.635372199 |
| 14486 | 1757 | 0.653785029 | 14515 | 1786 | 0.648651465 | 14544 | 1815 | 0.643304739 | 14573 | 1844 | 0.640083751 | 14602 | 1873 | 0.635268783 |
| 14487 | 1758 | 0.653785029 | 14516 | 1787 | 0.64799986 | 14545 | 1816 | 0.643304739 | 14574 | 1845 | 0.640083751 | 14603 | 1874 | 0.635168957 |
| 14488 | 1759 | 0.653428612 | 14517 | 1788 | 0.64799986 | 14546 | 1817 | 0.643304739 | 14575 | 1846 | 0.640083751 | 14604 | 1875 | 0.63497935 |
| 14489 | 1760 | 0.653428612 | 14518 | 1789 | 0.64799986 | 14547 | 1818 | 0.643304739 | 14576 | 1847 | 0.639981888 | 14605 | 1876 | 0.634802051 |
| 14490 | 1761 | 0.653428612 | 14519 | 1790 | 0.64799986 | 14548 | 1819 | 0.643304739 | 14577 | 1848 | 0.639816411 | 14606 | 1877 | 0.634717648 |
| 14491 | 1762 | 0.653428612 | 14520 | 1791 | 0.647142417 | 14549 | 1820 | 0.642638131 | 14578 | 1849 | 0.63968775 | 14607 | 1878 | 0.634717648 |
| 14492 | 1763 | 0.653428612 | 14521 | 1792 | 0.647007186 | 14550 | 1821 | 0.642638131 | 14579 | 1850 | 0.639500675 | 14608 | 1879 | 0.634635898 |
| 14493 | 1764 | 0.65299755 | 14522 | 1793 | 0.647007186 | 14551 | 1822 | 0.642638131 | 14580 | 1851 | 0.639203722 | 14609 | 1880 | 0.634479874 |
| 14494 | 1765 | 0.65299755 | 14523 | 1794 | 0.647007186 | 14552 | 1823 | 0.64222842 | 14581 | 1852 | 0.639061772 | 14610 | 1881 | 0.634262889 |
| 14495 | 1766 | 0.652900273 | 14524 | 1795 | 0.646821312 | 14553 | 1824 | 0.642033012 | 14582 | 1853 | 0.638659834 | 14611 | 1882 | 0.634064082 |
| 14496 | 1767 | 0.652900273 | 14525 | 1796 | 0.646821312 | 14554 | 1825 | 0.641750911 | 14583 | 1854 | 0.638659834 | 14612 | 1883 | 0.634064082 |
| 14497 | 1768 | 0.652746295 | 14526 | 1797 | 0.646699576 | 14555 | 1826 | 0.641750911 | 14584 | 1855 | 0.638659834 | 14613 | 1884 | 0.634064082 |
| 14498 | 1769 | 0.652581758 | 14527 | 1798 | 0.646549793 | 14556 | 1827 | 0.641557072 | 14585 | 1856 | 0.638659834 | 14614 | 1885 | 0.634064082 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14615 | 1886 | 0.633940545 | 14644 | 1915 | 0.629516454 | 14673 | 1944 | 0.620916282 | 14702 | 1973 | 0.616152493 | 14731 | 2002 | 0.611787687 |
| 14616 | 1887 | 0.633411498 | 14645 | 1916 | 0.629516454 | 14674 | 1945 | 0.620561611 | 14703 | 1974 | 0.616152493 | 14732 | 2003 | 0.611787687 |
| 14617 | 1888 | 0.633411498 | 14646 | 1917 | 0.627968166 | 14675 | 1946 | 0.620561611 | 14704 | 1975 | 0.616152493 | 14733 | 2004 | 0.611787687 |
| 14618 | 1889 | 0.632922703 | 14647 | 1918 | 0.626810561 | 14676 | 1947 | 0.620176428 | 14705 | 1976 | 0.615776643 | 14734 | 2005 | 0.611787687 |
| 14619 | 1890 | 0.632542909 | 14648 | 1919 | 0.626668611 | 14677 | 1948 | 0.620176428 | 14706 | 1977 | 0.615665342 | 14735 | 2006 | 0.611245158 |
| 14620 | 1891 | 0.632542909 | 14649 | 1920 | 0.626510944 | 14678 | 1949 | 0.620176428 | 14707 | 1978 | 0.615665342 | 14736 | 2007 | 0.611189073 |
| 14621 | 1892 | 0.632383095 | 14650 | 1921 | 0.626510944 | 14679 | 1950 | 0.620040562 | 14708 | 1979 | 0.61546039 | 14737 | 2008 | 0.611189073 |
| 14622 | 1893 | 0.632239312 | 14651 | 1922 | 0.626510944 | 14680 | 1951 | 0.619756617 | 14709 | 1980 | 0.61546039 | 14738 | 2009 | 0.610767018 |
| 14623 | 1894 | 0.631693373 | 14652 | 1923 | 0.626334795 | 14681 | 1952 | 0.619756617 | 14710 | 1981 | 0.61546039 | 14739 | 2010 | 0.610548615 |
| 14624 | 1895 | 0.631392459 | 14653 | 1924 | 0.626136713 | 14682 | 1953 | 0.619577932 | 14711 | 1982 | 0.615141329 | 14740 | 2011 | 0.610548615 |
| 14625 | 1896 | 0.631329795 | 14654 | 1925 | 0.625656033 | 14683 | 1954 | 0.619455128 | 14712 | 1983 | 0.614957734 | 14741 | 2012 | 0.610211299 |
| 14626 | 1897 | 0.631329795 | 14655 | 1926 | 0.625656033 | 14684 | 1955 | 0.619297289 | 14713 | 1984 | 0.614957734 | 14742 | 2013 | 0.609962918 |
| 14627 | 1898 | 0.631164633 | 14656 | 1927 | 0.62519508 | 14685 | 1956 | 0.619200186 | 14714 | 1985 | 0.614692678 | 14743 | 2014 | 0.609861766 |
| 14628 | 1899 | 0.629516454 | 14657 | 1928 | 0.624821333 | 14686 | 1957 | 0.618792589 | 14715 | 1986 | 0.614276488 | 14744 | 2015 | 0.609621625 |
| 14629 | 1900 | 0.629516454 | 14658 | 1929 | 0.62460912 | 14687 | 1958 | 0.618792589 | 14716 | 1987 | 0.614276488 | 14745 | 2016 | 0.609313068 |
| 14630 | 1901 | 0.629516454 | 14659 | 1930 | 0.623936577 | 14688 | 1959 | 0.618792589 | 14717 | 1988 | 0.614276488 | 14746 | 2017 | 0.609313068 |
| 14631 | 1902 | 0.629516454 | 14660 | 1931 | 0.62352609 | 14689 | 1960 | 0.618351457 | 14718 | 1989 | 0.614276488 | 14747 | 2018 | 0.609313068 |
| 14632 | 1903 | 0.629516454 | 14661 | 1932 | 0.623176276 | 14690 | 1961 | 0.618235444 | 14719 | 1990 | 0.613964606 | 14748 | 2019 | 0.609123295 |
| 14633 | 1904 | 0.629516454 | 14662 | 1933 | 0.623176276 | 14691 | 1962 | 0.618036636 | 14720 | 1991 | 0.61383625 | 14749 | 2020 | 0.609123295 |
| 14634 | 1905 | 0.629516454 | 14663 | 1934 | 0.622985587 | 14692 | 1963 | 0.618036636 | 14721 | 1992 | 0.613528349 | 14750 | 2021 | 0.608901999 |
| 14635 | 1906 | 0.629516454 | 14664 | 1935 | 0.622783071 | 14693 | 1964 | 0.618036636 | 14722 | 1993 | 0.613528349 | 14751 | 2022 | 0.608776968 |
| 14636 | 1907 | 0.629516454 | 14665 | 1936 | 0.622783071 | 14694 | 1965 | 0.617872473 | 14723 | 1994 | 0.61330091 | 14752 | 2023 | 0.608776968 |
| 14637 | 1908 | 0.629516454 | 14666 | 1937 | 0.622492671 | 14695 | 1966 | 0.617872473 | 14724 | 1995 | 0.61330091 | 14753 | 2024 | 0.608327155 |
| 14638 | 1909 | 0.629516454 | 14667 | 1938 | 0.62233787 | 14696 | 1967 | 0.617617231 | 14725 | 1996 | 0.612702955 | 14754 | 2025 | 0.608327155 |
| 14639 | 1910 | 0.629516454 | 14668 | 1939 | 0.621829625 | 14697 | 1968 | 0.617617231 | 14726 | 1997 | 0.612578032 | 14755 | 2026 | 0.608327155 |
| 14640 | 1911 | 0.629516454 | 14669 | 1940 | 0.621243928 | 14698 | 1969 | 0.617350547 | 14727 | 1998 | 0.612578032 | 14756 | 2027 | 0.608327155 |
| 14641 | 1912 | 0.629516454 | 14670 | 1941 | 0.621243928 | 14699 | 1970 | 0.617350547 | 14728 | 1999 | 0.612578032 | 14757 | 2028 | 0.608327155 |
| 14642 | 1913 | 0.629516454 | 14671 | 1942 | 0.620916282 | 14700 | 1971 | 0.616927327 | 14729 | 2000 | 0.612408551 | 14758 | 2029 | 0.607719325 |
| 14643 | 1914 | 0.629516454 | 14672 | 1943 | 0.620916282 | 14701 | 1972 | 0.616679229 | 14730 | 2001 | 0.611787687 | 14759 | 2030 | 0.607614613 |

FIG. 2 (Cont.)

| DNA SEQ ID NO | AA SEQ ID NO | Log 10 enrichment in the brain |
|---|---|---|
| 14760 | 2031 | 0.607240059 |
| 14761 | 2032 | 0.607135674 |
| 14762 | 2033 | 0.607075585 |
| 14763 | 2034 | 0.606532547 |
| 14764 | 2035 | 0.606532547 |
| 14765 | 2036 | 0.606532547 |
| 14766 | 2037 | 0.606392655 |
| 14767 | 2038 | 0.606392655 |
| 14768 | 2039 | 0.606035358 |
| 14769 | 2040 | 0.606035358 |
| 14770 | 2041 | 0.605516178 |
| 14771 | 2042 | 0.605516178 |
| 14772 | 2043 | 0.605516178 |
| 14773 | 2044 | 0.605516178 |
| 14774 | 2045 | 0.605157108 |
| 14775 | 2046 | 0.605157108 |
| 14776 | 2047 | 0.60469287 |
| 14777 | 2048 | 0.604534166 |
| 14778 | 2049 | 0.604405734 |
| 14779 | 2050 | 0.604134723 |
| 14780 | 2051 | 0.604134723 |
| 14781 | 2052 | 0.603878517 |
| 14782 | 2053 | 0.603187515 |
| 14783 | 2054 | 0.603187515 |
| 14784 | 2055 | 0.603187515 |
| 14785 | 2056 | 0.603187515 |
| 14786 | 2057 | 0.603187515 |
| 14787 | 2058 | 0.603187515 |
| 14788 | 2059 | 0.603187515 |

| DNA SEQ ID NO | AA SEQ ID NO | Log 10 enrichment in the brain |
|---|---|---|
| 14789 | 2060 | 0.603187515 |
| 14790 | 2061 | 0.602242369 |
| 14791 | 2062 | 0.601972705 |
| 14792 | 2063 | 0.601972705 |
| 14793 | 2064 | 0.60168736 |
| 14794 | 2065 | 0.601226815 |
| 14795 | 2066 | 0.601226815 |
| 14796 | 2067 | 0.601063822 |
| 14797 | 2068 | 0.600871273 |
| 14798 | 2069 | 0.600871273 |
| 14799 | 2070 | 0.600871273 |
| 14800 | 2071 | 0.600192369 |
| 14801 | 2072 | 0.600005857 |
| 14802 | 2073 | 0.599553231 |
| 14803 | 2074 | 0.599553231 |
| 14804 | 2075 | 0.599553231 |
| 14805 | 2076 | 0.599274926 |
| 14806 | 2077 | 0.598805092 |
| 14807 | 2078 | 0.598567318 |
| 14808 | 2079 | 0.59810799 |
| 14809 | 2080 | 0.59810799 |
| 14810 | 2081 | 0.59810799 |
| 14811 | 2082 | 0.59810799 |
| 14812 | 2083 | 0.596275521 |
| 14813 | 2084 | 0.596275521 |
| 14814 | 2085 | 0.595949106 |
| 14815 | 2086 | 0.595949106 |
| 14816 | 2087 | 0.595738028 |
| 14817 | 2088 | 0.595738028 |

| DNA SEQ ID NO | AA SEQ ID NO | Log 10 enrichment in the brain |
|---|---|---|
| 14818 | 2089 | 0.594754348 |
| 14819 | 2090 | 0.594754348 |
| 14820 | 2091 | 0.594754348 |
| 14821 | 2092 | 0.594754348 |
| 14822 | 2093 | 0.594754348 |
| 14823 | 2094 | 0.594754348 |
| 14824 | 2095 | 0.594754348 |
| 14825 | 2096 | 0.594754348 |
| 14826 | 2097 | 0.594754348 |
| 14827 | 2098 | 0.594754348 |
| 14828 | 2099 | 0.594754348 |
| 14829 | 2100 | 0.594086716 |
| 14830 | 2101 | 0.594086716 |
| 14831 | 2102 | 0.593995755 |
| 14832 | 2103 | 0.593711624 |
| 14833 | 2104 | 0.593603898 |
| 14834 | 2105 | 0.593304281 |
| 14835 | 2106 | 0.593087189 |
| 14836 | 2107 | 0.593087189 |
| 14837 | 2108 | 0.593087189 |
| 14838 | 2109 | 0.593087189 |
| 14839 | 2110 | 0.592793647 |
| 14840 | 2111 | 0.592793647 |
| 14841 | 2112 | 0.592671397 |
| 14842 | 2113 | 0.592374646 |
| 14843 | 2114 | 0.592089956 |
| 14844 | 2115 | 0.591727893 |
| 14845 | 2116 | 0.591727893 |
| 14846 | 2117 | 0.591727893 |

| DNA SEQ ID NO | AA SEQ ID NO | Log 10 enrichment in the brain |
|---|---|---|
| 14847 | 2118 | 0.591727893 |
| 14848 | 2119 | 0.591553932 |
| 14849 | 2120 | 0.591426405 |
| 14850 | 2121 | 0.591426405 |
| 14851 | 2122 | 0.591251954 |
| 14852 | 2123 | 0.590598388 |
| 14853 | 2124 | 0.590598388 |
| 14854 | 2125 | 0.590598388 |
| 14855 | 2126 | 0.590598388 |
| 14856 | 2127 | 0.590598388 |
| 14857 | 2128 | 0.590007913 |
| 14858 | 2129 | 0.589869094 |
| 14859 | 2130 | 0.589869094 |
| 14860 | 2131 | 0.589771947 |
| 14861 | 2132 | 0.589644942 |
| 14862 | 2133 | 0.589644942 |
| 14863 | 2134 | 0.589644942 |
| 14864 | 2135 | 0.589644942 |
| 14865 | 2136 | 0.589399231 |
| 14866 | 2137 | 0.589221859 |
| 14867 | 2138 | 0.588982908 |
| 14868 | 2139 | 0.588982908 |
| 14869 | 2140 | 0.588643571 |
| 14870 | 2141 | 0.588123769 |
| 14871 | 2142 | 0.588123769 |
| 14872 | 2143 | 0.588123769 |
| 14873 | 2144 | 0.587744307 |
| 14874 | 2145 | 0.587744307 |
| 14875 | 2146 | 0.587654007 |

| DNA SEQ ID NO | AA SEQ ID NO | Log 10 enrichment in the brain |
|---|---|---|
| 14876 | 2147 | 0.587654007 |
| 14877 | 2148 | 0.587507311 |
| 14878 | 2149 | 0.587227392 |
| 14879 | 2150 | 0.587227392 |
| 14880 | 2151 | 0.587227392 |
| 14881 | 2152 | 0.587227392 |
| 14882 | 2153 | 0.587227392 |
| 14883 | 2154 | 0.587227392 |
| 14884 | 2155 | 0.587112606 |
| 14885 | 2156 | 0.586964103 |
| 14886 | 2157 | 0.586964103 |
| 14887 | 2158 | 0.586838239 |
| 14888 | 2159 | 0.586838239 |
| 14889 | 2160 | 0.586838239 |
| 14890 | 2161 | 0.586481822 |
| 14891 | 2162 | 0.586481822 |
| 14892 | 2163 | 0.586481822 |
| 14893 | 2164 | 0.586481822 |
| 14894 | 2165 | 0.586481822 |
| 14895 | 2166 | 0.58605076 |
| 14896 | 2167 | 0.58566317 |
| 14897 | 2168 | 0.585312792 |
| 14898 | 2169 | 0.585312792 |
| 14899 | 2170 | 0.585312792 |
| 14900 | 2171 | 0.584994511 |
| 14901 | 2172 | 0.584846059 |
| 14902 | 2173 | 0.584846059 |
| 14903 | 2174 | 0.58470411 |
| 14904 | 2175 | 0.584438079 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 14905 | 2176 | 0.584438079 | 14934 | 2205 | 0.580467057 | 14963 | 2234 | 0.575534642 | 14992 | 2263 | 0.571185347 | 15021 | 2292 | 0.566464708 |
| 14906 | 2177 | 0.584438079 | 14935 | 2206 | 0.580298431 | 14964 | 2235 | 0.575358422 | 14993 | 2264 | 0.571185347 | 15022 | 2293 | 0.566464708 |
| 14907 | 2178 | 0.584438079 | 14936 | 2207 | 0.580298431 | 14965 | 2236 | 0.575358422 | 14994 | 2265 | 0.571002832 | 15023 | 2294 | 0.566464708 |
| 14908 | 2179 | 0.584438079 | 14937 | 2208 | 0.580223868 | 14966 | 2237 | 0.575158792 | 14995 | 2266 | 0.570810794 | 15024 | 2295 | 0.566464708 |
| 14909 | 2180 | 0.584193475 | 14938 | 2209 | 0.580031091 | 14967 | 2238 | 0.575158792 | 14996 | 2267 | 0.570710967 | 15025 | 2296 | 0.565954674 |
| 14910 | 2181 | 0.584078415 | 14939 | 2210 | 0.578363932 | 14968 | 2239 | 0.574930756 | 14997 | 2268 | 0.570395002 | 15026 | 2297 | 0.565954674 |
| 14911 | 2182 | 0.584078415 | 14940 | 2211 | 0.578363932 | 14969 | 2240 | 0.574667786 | 14998 | 2269 | 0.570395002 | 15027 | 2298 | 0.565847374 |
| 14912 | 2183 | 0.583967809 | 14941 | 2212 | 0.578363932 | 14970 | 2241 | 0.574520593 | 14999 | 2270 | 0.570395002 | 15028 | 2299 | 0.565562747 |
| 14913 | 2184 | 0.583758964 | 14942 | 2213 | 0.578363932 | 14971 | 2242 | 0.574187991 | 15000 | 2271 | 0.570395002 | 15029 | 2300 | 0.565398955 |
| 14914 | 2185 | 0.583473337 | 14943 | 2214 | 0.578363932 | 14972 | 2243 | 0.573792369 | 15001 | 2272 | 0.569930764 | 15030 | 2301 | 0.565398955 |
| 14915 | 2186 | 0.582773051 | 14944 | 2215 | 0.578363932 | 14973 | 2244 | 0.573792369 | 15002 | 2273 | 0.569930764 | 15031 | 2302 | 0.565162475 |
| 14916 | 2187 | 0.582773051 | 14945 | 2216 | 0.578363932 | 14974 | 2245 | 0.573792369 | 15003 | 2274 | 0.569831349 | 15032 | 2303 | 0.565162475 |
| 14917 | 2188 | 0.582403909 | 14946 | 2217 | 0.578363932 | 14975 | 2246 | 0.573719027 | 15004 | 2275 | 0.569677752 | 15033 | 2304 | 0.564791124 |
| 14918 | 2189 | 0.582241587 | 14947 | 2218 | 0.578363932 | 14976 | 2247 | 0.573565049 | 15005 | 2276 | 0.569677752 | 15034 | 2305 | 0.564398276 |
| 14919 | 2190 | 0.581953163 | 14948 | 2219 | 0.578363932 | 14977 | 2248 | 0.573565049 | 15006 | 2277 | 0.569677752 | 15035 | 2306 | 0.564123493 |
| 14920 | 2191 | 0.581824464 | 14949 | 2220 | 0.578363932 | 14978 | 2249 | 0.573565049 | 15007 | 2278 | 0.569409089 | 15036 | 2307 | 0.564123493 |
| 14921 | 2192 | 0.581824464 | 14950 | 2221 | 0.578363932 | 14979 | 2250 | 0.573565049 | 15008 | 2279 | 0.569409089 | 15037 | 2308 | 0.564123493 |
| 14922 | 2193 | 0.581390386 | 14951 | 2222 | 0.578363932 | 14980 | 2251 | 0.573400512 | 15009 | 2280 | 0.569409089 | 15038 | 2309 | 0.563920504 |
| 14923 | 2194 | 0.581390386 | 14952 | 2223 | 0.576810104 | 14981 | 2252 | 0.573400512 | 15010 | 2281 | 0.568818614 | 15039 | 2310 | 0.563920504 |
| 14924 | 2195 | 0.581390386 | 14953 | 2224 | 0.576643951 | 14982 | 2253 | 0.573313939 | 15011 | 2282 | 0.568818614 | 15040 | 2311 | 0.563764423 |
| 14925 | 2196 | 0.581390386 | 14954 | 2225 | 0.576438011 | 14983 | 2254 | 0.573313939 | 15012 | 2283 | 0.568818614 | 15041 | 2312 | 0.563764423 |
| 14926 | 2197 | 0.581211775 | 14955 | 2226 | 0.576357949 | 14984 | 2255 | 0.573035098 | 15013 | 2284 | 0.568818614 | 15042 | 2313 | 0.563640675 |
| 14927 | 2198 | 0.581211775 | 14956 | 2227 | 0.576072135 | 14985 | 2256 | 0.573035098 | 15014 | 2285 | 0.568144767 | 15043 | 2314 | 0.563540155 |
| 14928 | 2199 | 0.58105307 | 14957 | 2228 | 0.576072135 | 14986 | 2257 | 0.572831443 | 15015 | 2286 | 0.567998416 | 15044 | 2315 | 0.563540155 |
| 14929 | 2200 | 0.580911121 | 14958 | 2229 | 0.575957862 | 14987 | 2258 | 0.572723664 | 15016 | 2287 | 0.567368547 | 15045 | 2316 | 0.563386776 |
| 14930 | 2201 | 0.580783406 | 14959 | 2230 | 0.575691342 | 14988 | 2259 | 0.572611603 | 15017 | 2288 | 0.567368547 | 15046 | 2317 | 0.562569664 |
| 14931 | 2202 | 0.580783406 | 14960 | 2231 | 0.575691342 | 14989 | 2260 | 0.572114982 | 15018 | 2289 | 0.56715571 | 15047 | 2318 | 0.562569664 |
| 14932 | 2203 | 0.580562896 | 14961 | 2232 | 0.575691342 | 14990 | 2261 | 0.571833065 | 15019 | 2290 | 0.56693447 | 15048 | 2319 | 0.562569664 |
| 14933 | 2204 | 0.580562896 | 14962 | 2233 | 0.575534642 | 14991 | 2262 | 0.571758565 | 15020 | 2291 | 0.56693447 | 15049 | 2320 | 0.562569664 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 15050 | 2321 | 0.562569664 | 15079 | 2350 | 0.559478588 | 15108 | 2379 | 0.553681467 | 15137 | 2408 | 0.550335208 | 15166 | 2437 | 0.546394726 |
| 15051 | 2322 | 0.562569664 | 15080 | 2351 | 0.559058776 | 15109 | 2380 | 0.553361663 | 15138 | 2409 | 0.550335208 | 15167 | 2438 | 0.546029414 |
| 15052 | 2323 | 0.562569664 | 15081 | 2352 | 0.559058776 | 15110 | 2381 | 0.553128108 | 15139 | 2410 | 0.550335208 | 15168 | 2439 | 0.545571418 |
| 15053 | 2324 | 0.562569664 | 15082 | 2353 | 0.55893538 | 15111 | 2382 | 0.5529822 | 15140 | 2411 | 0.549942003 | 15169 | 2440 | 0.545195568 |
| 15054 | 2325 | 0.562569664 | 15083 | 2354 | 0.55893538 | 15112 | 2383 | 0.552809827 | 15141 | 2412 | 0.549832843 | 15170 | 2441 | 0.544940176 |
| 15055 | 2326 | 0.561973515 | 15084 | 2355 | 0.55893538 | 15113 | 2384 | 0.552809827 | 15142 | 2413 | 0.54963978 | 15171 | 2442 | 0.544086259 |
| 15056 | 2327 | 0.561973515 | 15085 | 2356 | 0.55893538 | 15114 | 2385 | 0.552350499 | 15143 | 2414 | 0.54963978 | 15172 | 2443 | 0.544086259 |
| 15057 | 2328 | 0.561895817 | 15086 | 2357 | 0.55893538 | 15115 | 2386 | 0.552350499 | 15144 | 2415 | 0.549474366 | 15173 | 2444 | 0.543601825 |
| 15058 | 2329 | 0.561895817 | 15087 | 2358 | 0.558709244 | 15116 | 2387 | 0.552350499 | 15145 | 2416 | 0.549205703 | 15174 | 2445 | 0.543601825 |
| 15059 | 2330 | 0.561658238 | 15088 | 2359 | 0.558709244 | 15117 | 2388 | 0.552350499 | 15146 | 2417 | 0.549205703 | 15175 | 2446 | 0.543601825 |
| 15060 | 2331 | 0.561658238 | 15089 | 2360 | 0.558160546 | 15118 | 2389 | 0.552350499 | 15147 | 2418 | 0.548996857 | 15176 | 2447 | 0.543601825 |
| 15061 | 2332 | 0.561658238 | 15090 | 2361 | 0.558160546 | 15119 | 2390 | 0.552034993 | 15148 | 2419 | 0.548908952 | 15177 | 2448 | 0.543601825 |
| 15062 | 2333 | 0.561658238 | 15091 | 2362 | 0.558160546 | 15120 | 2391 | 0.552034993 | 15149 | 2420 | 0.548908952 | 15178 | 2449 | 0.543601825 |
| 15063 | 2334 | 0.561658238 | 15092 | 2363 | 0.558160546 | 15121 | 2392 | 0.552034993 | 15150 | 2421 | 0.548693261 | 15179 | 2450 | 0.543601825 |
| 15064 | 2335 | 0.561570137 | 15093 | 2364 | 0.557749476 | 15122 | 2393 | 0.551911596 | 15151 | 2422 | 0.548400708 | 15180 | 2451 | 0.543071875 |
| 15065 | 2336 | 0.561570137 | 15094 | 2365 | 0.557430025 | 15123 | 2394 | 0.551911596 | 15152 | 2423 | 0.548211514 | 15181 | 2452 | 0.542947274 |
| 15066 | 2337 | 0.561463181 | 15095 | 2366 | 0.556409356 | 15124 | 2395 | 0.551629678 | 15153 | 2424 | 0.548211514 | 15182 | 2453 | 0.542947274 |
| 15067 | 2338 | 0.561161902 | 15096 | 2367 | 0.556409356 | 15125 | 2396 | 0.551629678 | 15154 | 2425 | 0.548079128 | 15183 | 2454 | 0.542746072 |
| 15068 | 2339 | 0.56094004 | 15097 | 2368 | 0.556229486 | 15126 | 2397 | 0.551629678 | 15155 | 2426 | 0.548079128 | 15184 | 2455 | 0.542366278 |
| 15069 | 2340 | 0.56094004 | 15098 | 2369 | 0.555877784 | 15127 | 2398 | 0.551380442 | 15156 | 2427 | 0.547906068 | 15185 | 2456 | 0.542366278 |
| 15070 | 2341 | 0.560435535 | 15099 | 2370 | 0.554882836 | 15128 | 2399 | 0.551380442 | 15157 | 2428 | 0.547329698 | 15186 | 2457 | 0.54201391 |
| 15071 | 2342 | 0.560189963 | 15100 | 2371 | 0.554882836 | 15129 | 2400 | 0.551288654 | 15158 | 2429 | 0.547329698 | 15187 | 2458 | 0.541847098 |
| 15072 | 2343 | 0.560189963 | 15101 | 2372 | 0.554882836 | 15130 | 2401 | 0.550867758 | 15159 | 2430 | 0.547329698 | 15188 | 2459 | 0.541380365 |
| 15073 | 2344 | 0.559992242 | 15102 | 2373 | 0.554882836 | 15131 | 2402 | 0.550867758 | 15160 | 2431 | 0.547329698 | 15189 | 2460 | 0.541380365 |
| 15074 | 2345 | 0.559478588 | 15103 | 2374 | 0.554882836 | 15132 | 2403 | 0.550746667 | 15161 | 2432 | 0.547329698 | 15190 | 2461 | 0.541380365 |
| 15075 | 2346 | 0.559478588 | 15104 | 2375 | 0.554882836 | 15133 | 2404 | 0.550670441 | 15162 | 2433 | 0.546542219 | 15191 | 2462 | 0.541039609 |
| 15076 | 2347 | 0.559478588 | 15105 | 2376 | 0.554882836 | 15134 | 2405 | 0.550335208 | 15163 | 2434 | 0.546542219 | 15192 | 2463 | 0.540958515 |
| 15077 | 2348 | 0.559478588 | 15106 | 2377 | 0.554882836 | 15135 | 2406 | 0.550335208 | 15164 | 2435 | 0.546542219 | 15193 | 2464 | 0.540958515 |
| 15078 | 2349 | 0.559478588 | 15107 | 2378 | 0.553969493 | 15136 | 2407 | 0.550335208 | 15165 | 2436 | 0.546542219 | 15194 | 2465 | 0.540826771 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 15195 | 2466 | 0.540826771 | 15224 | 2495 | 0.538435985 | 15253 | 2524 | 0.532606441 | 15282 | 2553 | 0.529002317 | 15311 | 2582 | 0.525427856 |
| 15196 | 2467 | 0.540826771 | 15225 | 2496 | 0.538435985 | 15254 | 2525 | 0.532606441 | 15283 | 2554 | 0.529002317 | 15312 | 2583 | 0.525009259 |
| 15197 | 2468 | 0.540575371 | 15226 | 2497 | 0.538435985 | 15255 | 2526 | 0.532606441 | 15284 | 2555 | 0.529002317 | 15313 | 2584 | 0.525009259 |
| 15198 | 2469 | 0.540575371 | 15227 | 2498 | 0.538435985 | 15256 | 2527 | 0.532606441 | 15285 | 2556 | 0.528676147 | 15314 | 2585 | 0.525009259 |
| 15199 | 2470 | 0.540338891 | 15228 | 2499 | 0.538435985 | 15257 | 2528 | 0.532606441 | 15286 | 2557 | 0.528676147 | 15315 | 2586 | 0.524781104 |
| 15200 | 2471 | 0.53990568 | 15229 | 2500 | 0.53830842 | 15258 | 2529 | 0.532606441 | 15287 | 2558 | 0.528676147 | 15316 | 2587 | 0.524411963 |
| 15201 | 2472 | 0.53990568 | 15230 | 2501 | 0.538069337 | 15259 | 2530 | 0.532606441 | 15288 | 2559 | 0.528676147 | 15317 | 2588 | 0.524006269 |
| 15202 | 2473 | 0.539706782 | 15231 | 2502 | 0.537646666 | 15260 | 2531 | 0.532606441 | 15289 | 2560 | 0.528489875 | 15318 | 2589 | 0.524006269 |
| 15203 | 2474 | 0.539611343 | 15232 | 2503 | 0.537458944 | 15261 | 2532 | 0.532606441 | 15290 | 2561 | 0.528285067 | 15319 | 2590 | 0.524006269 |
| 15204 | 2475 | 0.539518436 | 15233 | 2504 | 0.537458944 | 15262 | 2533 | 0.532606441 | 15291 | 2562 | 0.528058813 | 15320 | 2591 | 0.523712728 |
| 15205 | 2476 | 0.539518436 | 15234 | 2505 | 0.536572628 | 15263 | 2534 | 0.532606441 | 15292 | 2563 | 0.528058813 | 15321 | 2592 | 0.523398439 |
| 15206 | 2477 | 0.539518436 | 15235 | 2506 | 0.536572628 | 15264 | 2535 | 0.532606441 | 15293 | 2564 | 0.527624041 | 15322 | 2593 | 0.523398439 |
| 15207 | 2478 | 0.539518436 | 15236 | 2507 | 0.536572628 | 15265 | 2536 | 0.532606441 | 15294 | 2565 | 0.527526916 | 15323 | 2594 | 0.523398439 |
| 15208 | 2479 | 0.539339824 | 15237 | 2508 | 0.536094769 | 15266 | 2537 | 0.530939282 | 15295 | 2566 | 0.527211409 | 15324 | 2595 | 0.523398439 |
| 15209 | 2480 | 0.539339824 | 15238 | 2509 | 0.535960083 | 15267 | 2538 | 0.530636848 | 15296 | 2567 | 0.527211409 | 15325 | 2596 | 0.523266415 |
| 15210 | 2481 | 0.539339824 | 15239 | 2510 | 0.535329299 | 15268 | 2539 | 0.530326675 | 15297 | 2568 | 0.527211409 | 15326 | 2597 | 0.523061123 |
| 15211 | 2482 | 0.539170211 | 15240 | 2511 | 0.535329299 | 15269 | 2540 | 0.530200371 | 15298 | 2569 | 0.527211409 | 15327 | 2598 | 0.523061123 |
| 15212 | 2483 | 0.539170211 | 15241 | 2512 | 0.535168658 | 15270 | 2541 | 0.530200371 | 15299 | 2570 | 0.526854112 | 15328 | 2599 | 0.522698152 |
| 15213 | 2484 | 0.539170211 | 15242 | 2513 | 0.535168658 | 15271 | 2542 | 0.530200371 | 15300 | 2571 | 0.526854112 | 15329 | 2600 | 0.522506114 |
| 15214 | 2485 | 0.539170211 | 15243 | 2514 | 0.535025915 | 15272 | 2543 | 0.530059252 | 15301 | 2572 | 0.526446132 | 15330 | 2601 | 0.522506114 |
| 15215 | 2486 | 0.53885539 | 15244 | 2515 | 0.534898238 | 15273 | 2544 | 0.530059252 | 15302 | 2573 | 0.526446132 | 15331 | 2602 | 0.522506114 |
| 15216 | 2487 | 0.53885539 | 15245 | 2516 | 0.534898238 | 15274 | 2545 | 0.530059252 | 15303 | 2574 | 0.526446132 | 15332 | 2603 | 0.522306484 |
| 15217 | 2488 | 0.53885539 | 15246 | 2517 | 0.53467945 | 15275 | 2546 | 0.530059252 | 15304 | 2575 | 0.526446132 | 15333 | 2604 | 0.521882576 |
| 15218 | 2489 | 0.53885539 | 15247 | 2518 | 0.534585007 | 15276 | 2547 | 0.530059252 | 15305 | 2576 | 0.526140399 | 15334 | 2605 | 0.521882576 |
| 15219 | 2490 | 0.53885539 | 15248 | 2519 | 0.534585007 | 15277 | 2548 | 0.529515364 | 15306 | 2577 | 0.526140399 | 15335 | 2606 | 0.521882576 |
| 15220 | 2491 | 0.53885539 | 15249 | 2520 | 0.534498795 | 15278 | 2549 | 0.529515364 | 15307 | 2578 | 0.525975862 | 15336 | 2607 | 0.521422274 |
| 15221 | 2492 | 0.538569388 | 15250 | 2521 | 0.534280025 | 15279 | 2550 | 0.529278498 | 15308 | 2579 | 0.525975862 | 15337 | 2608 | 0.521325431 |
| 15222 | 2493 | 0.538569388 | 15251 | 2522 | 0.534217925 | 15280 | 2551 | 0.529278498 | 15309 | 2580 | 0.525975862 | 15338 | 2609 | 0.521068528 |
| 15223 | 2494 | 0.538435985 | 15252 | 2523 | 0.532606441 | 15281 | 2552 | 0.529278498 | 15310 | 2581 | 0.525975862 | 15339 | 2610 | 0.520707218 |

FIG. 2 (Cont.)

| DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain | DNA SEQ ID NO | AA SEQ ID NO | Log 10 enrichment in the brain |
|---|---|---|---|---|---|---|---|---|---|---|---|---|---|---|
| 15340 | 2611 | 0.520707218 | 15367 | 2638 | 0.516369242 | 15394 | 2665 | 0.511417142 | 15421 | 2692 | 0.508839719 | 15448 | 2719 | 0.504577718 |
| 15341 | 2612 | 0.520707218 | 15368 | 2639 | 0.516216025 | 15395 | 2666 | 0.511417142 | 15422 | 2693 | 0.508472761 | 15449 | 2720 | 0.504577718 |
| 15342 | 2613 | 0.520371985 | 15369 | 2640 | 0.516216025 | 15396 | 2667 | 0.511417142 | 15423 | 2694 | 0.508472761 | 15450 | 2721 | 0.504577718 |
| 15343 | 2614 | 0.520371985 | 15370 | 2641 | 0.516216025 | 15397 | 2668 | 0.511417142 | 15424 | 2695 | 0.508163985 | 15451 | 2722 | 0.504035188 |
| 15344 | 2615 | 0.520371985 | 15371 | 2642 | 0.516216025 | 15398 | 2669 | 0.511417142 | 15425 | 2696 | 0.507983966 | 15452 | 2723 | 0.503864004 |
| 15345 | 2616 | 0.520017314 | 15372 | 2643 | 0.516216025 | 15399 | 2670 | 0.511417142 | 15426 | 2697 | 0.507983966 | 15453 | 2724 | 0.503864004 |
| 15346 | 2617 | 0.519769216 | 15373 | 2644 | 0.51603734 | 15400 | 2671 | 0.511417142 | 15427 | 2698 | 0.507983966 | 15454 | 2725 | 0.503864004 |
| 15347 | 2618 | 0.519769216 | 15374 | 2645 | 0.515871483 | 15401 | 2672 | 0.511417142 | 15428 | 2699 | 0.507983966 | 15455 | 2726 | 0.503864004 |
| 15348 | 2619 | 0.519769216 | 15375 | 2646 | 0.515573102 | 15402 | 2673 | 0.511417142 | 15429 | 2700 | 0.507300576 | 15456 | 2727 | 0.503864004 |
| 15349 | 2620 | 0.519585931 | 15376 | 2647 | 0.515573102 | 15403 | 2674 | 0.511417142 | 15430 | 2701 | 0.507300576 | 15457 | 2728 | 0.503864004 |
| 15350 | 2621 | 0.519444995 | 15377 | 2648 | 0.515573102 | 15404 | 2675 | 0.511417142 | 15431 | 2702 | 0.507300576 | 15458 | 2729 | 0.50339917 |
| 15351 | 2622 | 0.519103971 | 15378 | 2649 | 0.515573102 | 15405 | 2676 | 0.511417142 | 15432 | 2703 | 0.506845579 | 15459 | 2730 | 0.503222663 |
| 15352 | 2623 | 0.518926744 | 15379 | 2650 | 0.515263885 | 15406 | 2677 | 0.511417142 | 15433 | 2704 | 0.506845579 | 15460 | 2731 | 0.503222663 |
| 15353 | 2624 | 0.51886663 | 15380 | 2651 | 0.514877674 | 15407 | 2678 | 0.5107046 | 15434 | 2705 | 0.506670707 | 15461 | 2732 | 0.503222663 |
| 15354 | 2625 | 0.518366002 | 15381 | 2652 | 0.514381621 | 15408 | 2679 | 0.510590701 | 15435 | 2706 | 0.506520873 | 15462 | 2733 | 0.503222663 |
| 15355 | 2626 | 0.518366002 | 15382 | 2653 | 0.514381621 | 15409 | 2680 | 0.510518911 | 15436 | 2707 | 0.506520873 | 15463 | 2734 | 0.503222663 |
| 15356 | 2627 | 0.518366002 | 15383 | 2654 | 0.514381621 | 15410 | 2681 | 0.510330046 | 15437 | 2708 | 0.506277502 | 15464 | 2735 | 0.503222663 |
| 15357 | 2628 | 0.518366002 | 15384 | 2655 | 0.513721097 | 15411 | 2682 | 0.510330046 | 15438 | 2709 | 0.506277502 | 15465 | 2736 | 0.503222663 |
| 15358 | 2629 | 0.518366002 | 15385 | 2656 | 0.513490151 | 15412 | 2683 | 0.510330046 | 15439 | 2710 | 0.506277502 | 15466 | 2737 | 0.503222663 |
| 15359 | 2630 | 0.518366002 | 15386 | 2657 | 0.513490151 | 15413 | 2684 | 0.510202332 | 15440 | 2711 | 0.505548208 | 15467 | 2738 | 0.503222663 |
| 15360 | 2631 | 0.518366002 | 15387 | 2658 | 0.513301286 | 15414 | 2685 | 0.510202332 | 15441 | 2712 | 0.505548208 | 15468 | 2739 | 0.503222663 |
| 15361 | 2632 | 0.518366002 | 15388 | 2659 | 0.513301286 | 15415 | 2686 | 0.510040613 | 15442 | 2713 | 0.505256833 | | | |
| 15362 | 2633 | 0.517542695 | 15389 | 2660 | 0.513010885 | 15416 | 2687 | 0.509829226 | 15443 | 2714 | 0.505168193 | | | |
| 15363 | 2634 | 0.517542695 | 15390 | 2661 | 0.512798048 | 15417 | 2688 | 0.509829226 | 15444 | 2715 | 0.504577718 | | | |
| 15364 | 2635 | 0.517366475 | 15391 | 2662 | 0.51263536 | 15418 | 2689 | 0.509697162 | 15445 | 2716 | 0.504577718 | | | |
| 15365 | 2636 | 0.517366475 | 15392 | 2663 | 0.512506966 | 15419 | 2690 | 0.508942523 | 15446 | 2717 | 0.504577718 | | | |
| 15366 | 2637 | 0.516437943 | 15393 | 2664 | 0.512317235 | 15420 | 2691 | 0.508839719 | 15447 | 2718 | 0.504577718 | | | |

FIG. 3

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 15469 | 2740 | 1.805607713 | 0 | 15495 | 2766 | 1.435696428 | 0 | 15521 | 2792 | 1.339481843 | 0 | 15547 | 2818 | 1.297077994 | 0 |
| 15470 | 2741 | 1.782483914 | 0 | 15496 | 2767 | 1.432491288 | 0 | 15522 | 2793 | 1.338270728 | 0 | 15548 | 2819 | 1.295614353 | -1.155224741 |
| 15471 | 2742 | 1.756796407 | 0 | 15497 | 2768 | 1.429944099 | 0 | 15523 | 2794 | 1.336311796 | 0 | 15549 | 2820 | 1.294022734 | 0 |
| 15472 | 2743 | 1.7086977 | 0 | 15498 | 2769 | 1.417512639 | -0.925181513 | 15524 | 2795 | 1.333449878 | 0 | 15550 | 2821 | 1.29166475 | -0.839051407 |
| 15473 | 2744 | 1.621547524 | 0 | 15499 | 2770 | 1.4131306 | -1.199559314 | 15525 | 2796 | 1.333375379 | 0 | 15551 | 2822 | 1.288127945 | 0 |
| 15474 | 2745 | 1.611787687 | 0 | 15500 | 2771 | 1.411817991 | 0 | 15526 | 2797 | 1.333323519 | -1.222750977 | 15552 | 2823 | 1.281422818 | -0.34186017 |
| 15475 | 2746 | 1.611787687 | 0 | 15501 | 2772 | 1.407667705 | 0 | 15527 | 2798 | 1.332155836 | 0 | 15553 | 2824 | 1.280794468 | 0 |
| 15476 | 2747 | 1.599553231 | 0 | 15502 | 2773 | 1.404438734 | 0 | 15528 | 2799 | 1.329708103 | 0 | 15554 | 2825 | 1.280509778 | 0 |
| 15477 | 2748 | 1.593175811 | 0 | 15503 | 2774 | 1.403779635 | -1.39768257 | 15529 | 2800 | 1.327984093 | -0.761827075 | 15555 | 2826 | 1.277333936 | 0 |
| 15478 | 2749 | 1.559758687 | 0 | 15504 | 2775 | 1.397907867 | 0 | 15530 | 2801 | 1.322187153 | 0 | 15556 | 2827 | 1.276699466 | 0 |
| 15479 | 2750 | 1.534699431 | -1.140781313 | 15505 | 2776 | 1.397404629 | 0 | 15531 | 2802 | 1.317363058 | -0.588238962 | 15557 | 2828 | 1.276082366 | -0.365765777 |
| 15480 | 2751 | 1.532606441 | 0 | 15506 | 2777 | 1.39473782 | 0 | 15532 | 2803 | 1.315218569 | -1.002828148 | 15558 | 2829 | 1.27535537 | 0 |
| 15481 | 2752 | 1.532606441 | 0 | 15507 | 2778 | 1.39394168 | 0 | 15533 | 2804 | 1.314723879 | 0 | 15559 | 2830 | 1.2748016 | 0 |
| 15482 | 2753 | 1.514877674 | 0 | 15508 | 2779 | 1.386478405 | 0 | 15534 | 2805 | 1.312609696 | 0 | 15560 | 2831 | 1.273774125 | 0 |
| 15483 | 2754 | 1.511287094 | -1.321740616 | 15509 | 2780 | 1.38211136 | -1.271968999 | 15535 | 2806 | 1.311982783 | 0 | 15561 | 2832 | 1.273412515 | 0 |
| 15484 | 2755 | 1.497844335 | 0 | 15510 | 2781 | 1.379456849 | 0 | 15536 | 2807 | 1.310757692 | 0 | 15562 | 2833 | 1.272412699 | 0 |
| 15485 | 2756 | 1.496394268 | -1.222750977 | 15511 | 2782 | 1.379378065 | 0 | 15537 | 2808 | 1.310757692 | 0 | 15563 | 2834 | 1.270886179 | -1.103564569 |
| 15486 | 2757 | 1.486848951 | 0 | 15512 | 2783 | 1.374998588 | -0.4875688 | 15538 | 2809 | 1.310757692 | 0 | 15564 | 2835 | 1.269696909 | 0 |
| 15487 | 2758 | 1.480843526 | 0 | 15513 | 2784 | 1.374075258 | 0 | 15539 | 2810 | 1.310757692 | 0 | 15565 | 2836 | 1.269365006 | 0 |
| 15488 | 2759 | 1.457728072 | -1.321740616 | 15514 | 2785 | 1.370525897 | 0 | 15540 | 2811 | 1.3080933 | 0 | 15566 | 2837 | 1.269365006 | 0 |
| 15489 | 2760 | 1.455309339 | 0 | 15515 | 2786 | 1.365741816 | 0 | 15541 | 2812 | 1.305958809 | -0.540814312 | 15567 | 2838 | 1.268005711 | -0.288568261 |
| 15490 | 2761 | 1.445456265 | 0 | 15516 | 2787 | 1.358399326 | -1.4875688 | 15542 | 2813 | 1.302995926 | -0.237691326 | 15568 | 2839 | 1.265117594 | 0 |
| 15491 | 2762 | 1.445456265 | 0 | 15517 | 2788 | 1.345977191 | 0 | 15543 | 2814 | 1.300494616 | 0 | 15569 | 2840 | 1.262245265 | 0 |
| 15492 | 2763 | 1.444470352 | 0 | 15518 | 2789 | 1.345519798 | 0 | 15544 | 2815 | 1.300354931 | 0 | 15570 | 2841 | 1.260221627 | 0 |
| 15493 | 2764 | 1.444085169 | 0 | 15519 | 2790 | 1.340720915 | 0 | 15545 | 2816 | 1.300033826 | 0 | 15571 | 2842 | 1.259605169 | 0 |
| 15494 | 2765 | 1.442429811 | 0 | 15520 | 2791 | 1.340124766 | 0 | 15546 | 2817 | 1.297920467 | 0 | 15572 | 2843 | 1.259605169 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 15573 | 2844 | 1.259605169 | 0 | 15601 | 2872 | 1.231576445 | 0 | 15629 | 2900 | 1.210125444 | 0 | 15657 | 2928 | 1.196814339 | 0 |
| 15574 | 2845 | 1.258899573 | 0 | 15602 | 2873 | 1.229452752 | -1.136564829 | 15630 | 2901 | 1.209731112 | 0 | 15658 | 2929 | 1.196814339 | 0 |
| 15575 | 2846 | 1.258823361 | 0 | 15603 | 2874 | 1.229410384 | -1.429037021 | 15631 | 2902 | 1.20809535 | 0 | 15659 | 2930 | 1.196814339 | 0 |
| 15576 | 2847 | 1.258728692 | 0 | 15604 | 2875 | 1.227750038 | 0 | 15632 | 2903 | 1.20809535 | 0 | 15660 | 2931 | 1.194252122 | -0.418437792 |
| 15577 | 2848 | 1.256882311 | -0.312927607 | 15605 | 2876 | 1.226980694 | 0 | 15633 | 2904 | 1.20809535 | 0 | 15661 | 2932 | 1.194039285 | -0.280347931 |
| 15578 | 2849 | 1.254439328 | -0.995072683 | 15606 | 2877 | 1.225972568 | 0 | 15634 | 2905 | 1.206752862 | 0 | 15662 | 2933 | 1.193787885 | 0 |
| 15579 | 2850 | 1.25385284 | -0.016414393 | 15607 | 2878 | 1.225899313 | 0 | 15635 | 2906 | 1.206392899 | 0 | 15663 | 2934 | 1.193787885 | 0 |
| 15580 | 2851 | 1.253295695 | 0 | 15608 | 2879 | 1.225236267 | 0 | 15636 | 2907 | 1.206392899 | 0 | 15664 | 2935 | 1.192947043 | 0 |
| 15581 | 2852 | 1.25321837 | 0 | 15609 | 2880 | 1.224737021 | -0.454899683 | 15637 | 2908 | 1.206392899 | 0 | 15665 | 2936 | 1.19018376 | 0 |
| 15582 | 2853 | 1.25321837 | -1.262561531 | 15610 | 2881 | 1.224152427 | 0 | 15638 | 2909 | 1.205563013 | 0 | 15666 | 2937 | 1.19018376 | 0 |
| 15583 | 2854 | 1.251779832 | 0 | 15611 | 2882 | 1.221452573 | 0 | 15639 | 2910 | 1.205247507 | 0 | 15667 | 2938 | 1.189567302 | -1.275060076 |
| 15584 | 2855 | 1.249305212 | 0 | 15612 | 2883 | 1.22135728 | 0 | 15640 | 2911 | 1.205247507 | 0 | 15668 | 2939 | 1.188964402 | 0 |
| 15585 | 2856 | 1.248282139 | -1.134441135 | 15613 | 2884 | 1.22119441 | 0 | 15641 | 2912 | 1.204842192 | 0 | 15669 | 2940 | 1.188110752 | -0.874028991 |
| 15586 | 2857 | 1.247181519 | 0 | 15614 | 2885 | 1.22085258 | 0 | 15642 | 2913 | 1.204138197 | -0.992128303 | 15670 | 2941 | 1.187911944 | 0 |
| 15587 | 2858 | 1.244671744 | -1.418097035 | 15615 | 2886 | 1.220636459 | 0 | 15643 | 2914 | 1.204032696 | 0 | 15671 | 2942 | 1.187797521 | 0 |
| 15588 | 2859 | 1.239545375 | 0 | 15616 | 2887 | 1.219410538 | 0 | 15644 | 2915 | 1.203803867 | -1.479949403 | 15672 | 2943 | 1.187372783 | 0 |
| 15589 | 2860 | 1.237566809 | 0 | 15617 | 2888 | 1.217725334 | 0 | 15645 | 2916 | 1.20261275 | 0 | 15673 | 2944 | 1.185818955 | 0 |
| 15590 | 2861 | 1.236655971 | 0 | 15618 | 2889 | 1.217700042 | -1.327238088 | 15646 | 2917 | 1.201905775 | 0 | 15674 | 2945 | 1.184720865 | -0.593202381 |
| 15591 | 2862 | 1.235471489 | 0 | 15619 | 2890 | 1.217640668 | -0.501504578 | 15647 | 2918 | 1.201613222 | 0 | 15675 | 2946 | 1.184151796 | 0 |
| 15592 | 2863 | 1.234023181 | -1.37381423 | 15620 | 2891 | 1.217489984 | -1.399998813 | 15648 | 2919 | 1.201613222 | 0 | 15676 | 2947 | 1.183412885 | 0 |
| 15593 | 2864 | 1.231576445 | 0 | 15621 | 2892 | 1.216336479 | 0 | 15649 | 2920 | 1.201193816 | 0 | 15677 | 2948 | 1.183143371 | 0 |
| 15594 | 2865 | 1.231576445 | 0 | 15622 | 2893 | 1.213249064 | 0 | 15650 | 2921 | 1.20114649 | 0 | 15678 | 2949 | 1.182971112 | 0 |
| 15595 | 2866 | 1.231576445 | 0 | 15623 | 2894 | 1.21309304 | -1.284203456 | 15651 | 2922 | 1.201087123 | 0 | 15679 | 2950 | 1.182918442 | 0 |
| 15596 | 2867 | 1.231576445 | 0 | 15624 | 2895 | 1.21227129 | 0 | 15652 | 2923 | 1.199784611 | 0 | 15680 | 2951 | 1.182727878 | 0 |
| 15597 | 2868 | 1.231576445 | 0 | 15625 | 2896 | 1.211882137 | 0 | 15653 | 2924 | 1.199173359 | -1.310532394 | 15681 | 2952 | 1.182358423 | 0 |
| 15598 | 2869 | 1.231576445 | 0 | 15626 | 2897 | 1.21079284 | 0 | 15654 | 2925 | 1.197893332 | 0 | 15682 | 2953 | 1.18198333 | 0 |
| 15599 | 2870 | 1.231576445 | 0 | 15627 | 2898 | 1.210678521 | 0 | 15655 | 2926 | 1.197671782 | 0 | 15683 | 2954 | 1.181730073 | 0 |
| 15600 | 2871 | 1.231576445 | 0 | 15628 | 2899 | 1.210387146 | 0 | 15656 | 2927 | 1.196814339 | 0 | 15684 | 2955 | 1.181662995 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 15685 | 2956 | 1.18160247 | 0 | 15713 | 2984 | 1.16829461 | -1.498752967 | 15741 | 3012 | 1.152395199 | 0 | 15769 | 3040 | 1.141399815 | 0 |
| 15686 | 2957 | 1.181166942 | 0 | 15714 | 2985 | 1.168090188 | 0 | 15742 | 3013 | 1.151925438 | -0.137740187 | 15770 | 3041 | 1.141399815 | 0 |
| 15687 | 2958 | 1.180966452 | 0 | 15715 | 2986 | 1.167335549 | 0 | 15743 | 3014 | 1.15176073 | 0 | 15771 | 3042 | 1.141399815 | -1.233050933 |
| 15688 | 2959 | 1.180423923 | 0 | 15716 | 2987 | 1.167022469 | 0 | 15744 | 3015 | 1.151699772 | 0 | 15772 | 3043 | 1.141271799 | 0 |
| 15689 | 2960 | 1.180423923 | 0 | 15717 | 2988 | 1.166309714 | 0 | 15745 | 3016 | 1.151170108 | 0 | 15773 | 3044 | 1.140495976 | 0 |
| 15690 | 2961 | 1.180423923 | 0 | 15718 | 2989 | 1.165647932 | 0 | 15746 | 3017 | 1.150753252 | 0 | 15774 | 3045 | 1.140495976 | 0 |
| 15691 | 2962 | 1.179658646 | 0 | 15719 | 2990 | 1.164629656 | 0 | 15747 | 3018 | 1.150041294 | -1.472193938 | 15775 | 3046 | 1.140129328 | 0 |
| 15692 | 2963 | 1.179188376 | -0.225225596 | 15720 | 2991 | 1.164629656 | 0 | 15748 | 3019 | 1.149906399 | 0 | 15776 | 3047 | 1.140061464 | -0.385478274 |
| 15693 | 2964 | 1.178964108 | 0 | 15721 | 2992 | 1.164629656 | 0 | 15749 | 3020 | 1.14870951 | 0 | 15777 | 3048 | 1.139658378 | 0 |
| 15694 | 2965 | 1.178763139 | 0 | 15722 | 2993 | 1.164629656 | 0 | 15750 | 3021 | 1.148089405 | 0 | 15778 | 3049 | 1.138544088 | 0 |
| 15695 | 2966 | 1.178498002 | 0 | 15723 | 2994 | 1.164629656 | 0 | 15751 | 3022 | 1.14725556 | 0 | 15779 | 3050 | 1.137020338 | 0 |
| 15696 | 2967 | 1.178445357 | 0 | 15724 | 2995 | 1.162249954 | 0 | 15752 | 3023 | 1.146862711 | 0 | 15780 | 3051 | 1.136790126 | 0 |
| 15697 | 2968 | 1.177891586 | 0 | 15725 | 2996 | 1.161940517 | 0 | 15753 | 3024 | 1.145324501 | 0 | 15781 | 3052 | 1.135795938 | 0 |
| 15698 | 2969 | 1.177891586 | 0 | 15726 | 2997 | 1.161685275 | 0 | 15754 | 3025 | 1.145324501 | -0.554515589 | 15782 | 3053 | 1.134666432 | 0 |
| 15699 | 2970 | 1.177891586 | 0 | 15727 | 2998 | 1.161538579 | 0 | 15755 | 3026 | 1.145095961 | -1.284203456 | 15783 | 3054 | 1.134666432 | 0 |
| 15700 | 2971 | 1.176059118 | 0 | 15728 | 2999 | 1.160220537 | 0 | 15756 | 3027 | 1.14442627 | 0 | 15784 | 3055 | 1.134666432 | 0 |
| 15701 | 2972 | 1.17509509 | 0 | 15729 | 3000 | 1.159934535 | 0 | 15757 | 3028 | 1.144260414 | -0.191793944 | 15785 | 3056 | 1.134666432 | 0 |
| 15702 | 2973 | 1.17509509 | 0 | 15730 | 3001 | 1.158800112 | 0 | 15758 | 3029 | 1.143154543 | 0 | 15786 | 3057 | 1.134666432 | 0 |
| 15703 | 2974 | 1.174613877 | 0 | 15731 | 3002 | 1.158618564 | 0 | 15759 | 3030 | 1.142938958 | -1.239784316 | 15787 | 3058 | 1.134666432 | -1.186538804 |
| 15704 | 2975 | 1.174433559 | 0 | 15732 | 3003 | 1.157474725 | 0 | 15760 | 3031 | 1.142635362 | 0 | 15788 | 3059 | 1.133289904 | 0 |
| 15705 | 2976 | 1.173584498 | 0 | 15733 | 3004 | 1.156155348 | 0 | 15761 | 3032 | 1.142635362 | 0 | 15789 | 3060 | 1.132500371 | 0 |
| 15706 | 2977 | 1.173584498 | 0 | 15734 | 3005 | 1.155855732 | 0 | 15762 | 3033 | 1.142398883 | 0 | 15790 | 3061 | 1.131062308 | 0 |
| 15707 | 2978 | 1.171677185 | 0 | 15735 | 3006 | 1.155019343 | -0.167233649 | 15763 | 3034 | 1.142353261 | 0 | 15791 | 3062 | 1.130415555 | 0 |
| 15708 | 2979 | 1.171210001 | 0 | 15736 | 3007 | 1.154616659 | 0 | 15764 | 3035 | 1.142353261 | 0 | 15792 | 3063 | 1.12995433 | -1.268855764 |
| 15709 | 2980 | 1.170878605 | 0 | 15737 | 3008 | 1.154561261 | 0 | 15765 | 3036 | 1.142176034 | 0 | 15793 | 3064 | 1.129433906 | 0 |
| 15710 | 2981 | 1.170878605 | -1.441811309 | 15738 | 3009 | 1.153816787 | 0 | 15766 | 3037 | 1.142176034 | 0 | 15794 | 3065 | 1.128506124 | 0 |
| 15711 | 2982 | 1.169621601 | 0 | 15739 | 3010 | 1.153019634 | 0 | 15767 | 3038 | 1.141671334 | 0 | 15795 | 3066 | 1.127284479 | 0 |
| 15712 | 2983 | 1.169215701 | 0 | 15740 | 3011 | 1.152395199 | 0 | 15768 | 3039 | 1.141615292 | 0 | 15796 | 3067 | 1.127069251 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 15797 | 3068 | 1.126841095 | 0 | 15825 | 3096 | 1.117057487 | 0 | 15853 | 3124 | 1.106637709 | 0 | 15881 | 3152 | 1.100512156 | 0 |
| 15798 | 3069 | 1.126634337 | 0 | 15826 | 3097 | 1.116441612 | 0 | 15854 | 3125 | 1.106637709 | 0 | 15882 | 3153 | 1.100512156 | -0.247145416 |
| 15799 | 3070 | 1.126416357 | 0 | 15827 | 3098 | 1.115070876 | 0 | 15855 | 3126 | 1.106637709 | 0 | 15883 | 3154 | 1.100297531 | 0 |
| 15800 | 3071 | 1.126274007 | 0 | 15828 | 3099 | 1.114695352 | 0 | 15856 | 3127 | 1.106637709 | 0 | 15884 | 3155 | 1.099904326 | 0 |
| 15801 | 3072 | 1.126066261 | 0 | 15829 | 3100 | 1.114640527 | 0 | 15857 | 3128 | 1.106637709 | 0 | 15885 | 3156 | 1.099236694 | 0 |
| 15802 | 3073 | 1.125942864 | 0 | 15830 | 3101 | 1.114463046 | 0 | 15858 | 3129 | 1.106637709 | 0 | 15886 | 3157 | 1.099213691 | 0 |
| 15803 | 3074 | 1.125685133 | 0 | 15831 | 3102 | 1.114036431 | 0 | 15859 | 3130 | 1.106637709 | 0 | 15887 | 3158 | 1.09895088 | 0 |
| 15804 | 3075 | 1.123750018 | -0.576090072 | 15832 | 3103 | 1.113899393 | 0 | 15860 | 3131 | 1.106637709 | -0.76929364 | 15888 | 3159 | 1.09895088 | 0 |
| 15805 | 3076 | 1.123236971 | 0 | 15833 | 3104 | 1.113126755 | -0.714112671 | 15861 | 3132 | 1.105748672 | -1.338028568 | 15889 | 3160 | 1.09895088 | -0.154717091 |
| 15806 | 3077 | 1.123236971 | 0 | 15834 | 3105 | 1.112996453 | 0 | 15862 | 3133 | 1.105531225 | 0 | 15890 | 3161 | 1.098609856 | 0 |
| 15807 | 3078 | 1.123236971 | 0 | 15835 | 3106 | 1.112886658 | 0 | 15863 | 3134 | 1.104801366 | 0 | 15891 | 3162 | 1.098609856 | 0 |
| 15808 | 3079 | 1.122431976 | 0 | 15836 | 3107 | 1.112711857 | 0 | 15864 | 3135 | 1.104333754 | 0 | 15892 | 3163 | 1.098237167 | 0 |
| 15809 | 3080 | 1.122431976 | 0 | 15837 | 3108 | 1.112711857 | 0 | 15865 | 3136 | 1.10409052 | 0 | 15893 | 3164 | 1.097546531 | -0.259870878 |
| 15810 | 3081 | 1.122431976 | 0 | 15838 | 3109 | 1.112262323 | 0 | 15866 | 3137 | 1.103789866 | 0 | 15894 | 3165 | 1.096877872 | 0 |
| 15811 | 3082 | 1.122431976 | 0 | 15839 | 3110 | 1.112100605 | 0 | 15867 | 3138 | 1.103408739 | 0 | 15895 | 3166 | 1.096632577 | 0 |
| 15812 | 3083 | 1.122212691 | 0 | 15840 | 3111 | 1.111966542 | 0 | 15868 | 3139 | 1.103092428 | 0 | 15896 | 3167 | 1.096576383 | 0 |
| 15813 | 3084 | 1.120680786 | -1.278129308 | 15841 | 3112 | 1.111889218 | 0 | 15869 | 3140 | 1.103033585 | 0 | 15897 | 3168 | 1.096390174 | 0 |
| 15814 | 3085 | 1.120635141 | -1.363887067 | 15842 | 3113 | 1.111002514 | 0 | 15870 | 3141 | 1.102737668 | 0 | 15898 | 3169 | 1.095913843 | 0 |
| 15815 | 3086 | 1.119943176 | -1.301932223 | 15843 | 3114 | 1.109940344 | -1.243112259 | 15871 | 3142 | 1.101730374 | 0 | 15899 | 3170 | 1.095913843 | -1.215746075 |
| 15816 | 3087 | 1.119704454 | 0 | 15844 | 3115 | 1.109842849 | 0 | 15872 | 3143 | 1.101463075 | 0 | 15900 | 3171 | 1.095472711 | 0 |
| 15817 | 3088 | 1.119602686 | 0 | 15845 | 3116 | 1.109582089 | 0 | 15873 | 3144 | 1.101242677 | 0 | 15901 | 3172 | 1.095356698 | 0 |
| 15818 | 3089 | 1.118872165 | 0 | 15846 | 3117 | 1.108068664 | 0 | 15874 | 3145 | 1.101242677 | 0 | 15902 | 3173 | 1.095356698 | 0 |
| 15819 | 3090 | 1.117633093 | 0 | 15847 | 3118 | 1.108068664 | 0 | 15875 | 3146 | 1.101057831 | -0.19587883 | 15903 | 3174 | 1.095219805 | -1.047527439 |
| 15820 | 3091 | 1.117633093 | 0 | 15848 | 3119 | 1.1079638 | 0 | 15876 | 3147 | 1.100960576 | 0 | 15904 | 3175 | 1.094993728 | 0 |
| 15821 | 3092 | 1.117633093 | 0 | 15849 | 3120 | 1.107514186 | 0 | 15877 | 3148 | 1.100900578 | 0 | 15905 | 3176 | 1.094448046 | 0 |
| 15822 | 3093 | 1.117633093 | 0 | 15850 | 3121 | 1.106637709 | 0 | 15878 | 3149 | 1.100808165 | 0 | 15906 | 3177 | 1.094114589 | 0 |
| 15823 | 3094 | 1.117633093 | 0 | 15851 | 3122 | 1.106637709 | 0 | 15879 | 3150 | 1.100740312 | 0 | 15907 | 3178 | 1.093943438 | 0 |
| 15824 | 3095 | 1.117103143 | 0 | 15852 | 3123 | 1.106637709 | 0 | 15880 | 3151 | 1.100740312 | 0 | 15908 | 3179 | 1.093273747 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 15909 | 3180 | 1.093273747 | -0.76929364 | 15937 | 3208 | 1.086081954 | 0 | 15965 | 3236 | 1.075352431 | 0 | 15993 | 3264 | 1.068373209 | 0 |
| 15910 | 3181 | 1.092809509 | 0 | 15938 | 3209 | 1.086081954 | 0 | 15966 | 3237 | 1.075229245 | -0.58321816 | 15994 | 3265 | 1.068259474 | 0 |
| 15911 | 3182 | 1.092701931 | 0 | 15939 | 3210 | 1.085933384 | 0 | 15967 | 3238 | 1.074790342 | 0 | 15995 | 3266 | 1.067983732 | 0 |
| 15912 | 3183 | 1.092581644 | 0 | 15940 | 3211 | 1.08544841 | 0 | 15968 | 3239 | 1.074578128 | 0 | 15996 | 3267 | 1.067549698 | -1.454220567 |
| 15913 | 3184 | 1.092581644 | 0 | 15941 | 3212 | 1.084448882 | -1.366390212 | 15969 | 3240 | 1.074453025 | 0 | 15997 | 3268 | 1.06738441 | 0 |
| 15914 | 3185 | 1.092529455 | 0 | 15942 | 3213 | 1.084361314 | 0 | 15970 | 3241 | 1.074370531 | 0 | 15998 | 3269 | 1.06722359 | 0 |
| 15915 | 3186 | 1.092468753 | 0 | 15943 | 3214 | 1.083973724 | 0 | 15971 | 3242 | 1.073968592 | 0 | 15999 | 3270 | 1.066593068 | 0 |
| 15916 | 3187 | 1.092262584 | 0 | 15944 | 3215 | 1.083774826 | -1.142874303 | 15972 | 3243 | 1.073968592 | -1.441811309 | 16000 | 3271 | 1.066480571 | 0 |
| 15917 | 3188 | 1.092207993 | 0 | 15945 | 3216 | 1.083289526 | 0 | 15973 | 3244 | 1.073637449 | 0 | 16001 | 3272 | 1.066480571 | 0 |
| 15918 | 3189 | 1.091914452 | 0 | 15946 | 3217 | 1.082637432 | 0 | 15974 | 3245 | 1.073508291 | 0 | 16002 | 3273 | 1.066209052 | 0 |
| 15919 | 3190 | 1.091697359 | 0 | 15947 | 3218 | 1.082637432 | 0 | 15975 | 3246 | 1.073286633 | 0 | 16003 | 3274 | 1.065764826 | 0 |
| 15920 | 3191 | 1.091200739 | 0 | 15948 | 3219 | 1.081691875 | 0 | 15976 | 3247 | 1.073009531 | -0.754229894 | 16004 | 3275 | 1.065704352 | 0 |
| 15921 | 3192 | 1.091125543 | 0 | 15949 | 3220 | 1.081655421 | 0 | 15977 | 3248 | 1.072255397 | 0 | 16005 | 3276 | 1.065245024 | 0 |
| 15922 | 3193 | 1.090422165 | 0 | 15950 | 3221 | 1.081655421 | 0 | 15978 | 3249 | 1.07219088 | 0 | 16006 | 3277 | 1.065245024 | -1.371353631 |
| 15923 | 3194 | 1.089902751 | 0 | 15951 | 3222 | 1.08030877 | 0 | 15979 | 3250 | 1.071875603 | 0 | 16007 | 3278 | 1.065083245 | 0 |
| 15924 | 3195 | 1.089902751 | -0.033431452 | 15952 | 3223 | 1.079715066 | 0 | 15980 | 3251 | 1.071572006 | 0 | 16008 | 3279 | 1.064926743 | 0 |
| 15925 | 3196 | 1.089299495 | 0 | 15953 | 3224 | 1.078808615 | 0 | 15981 | 3252 | 1.071279454 | 0 | 16009 | 3280 | 1.064628566 | 0 |
| 15926 | 3197 | 1.088366413 | -1.376260966 | 15954 | 3225 | 1.078715027 | 0 | 15982 | 3253 | 1.070997353 | -0.343324908 | 16010 | 3281 | 1.064215018 | 0 |
| 15927 | 3198 | 1.088154303 | 0 | 15955 | 3226 | 1.077599501 | 0 | 15983 | 3254 | 1.070208443 | 0 | 16011 | 3282 | 1.064085358 | 0 |
| 15928 | 3199 | 1.08797094 | 0 | 15956 | 3227 | 1.077313624 | 0 | 15984 | 3255 | 1.069997569 | -1.439708184 | 16012 | 3283 | 1.063918354 | 0 |
| 15929 | 3200 | 1.087841223 | 0 | 15957 | 3228 | 1.077024864 | 0 | 15985 | 3256 | 1.069914902 | 0 | 16013 | 3284 | 1.063603077 | 0 |
| 15930 | 3201 | 1.087841223 | 0 | 15958 | 3229 | 1.077024864 | 0 | 15986 | 3257 | 1.069792651 | 0 | 16014 | 3285 | 1.063603077 | 0 |
| 15931 | 3202 | 1.08766987 | 0 | 15959 | 3230 | 1.076674485 | 0 | 15987 | 3258 | 1.069273471 | 0 | 16015 | 3286 | 1.063454116 | 0 |
| 15932 | 3203 | 1.087487355 | 0 | 15960 | 3231 | 1.076674485 | 0 | 15988 | 3259 | 1.069100549 | 0 | 16016 | 3287 | 1.063454116 | 0 |
| 15933 | 3204 | 1.087084172 | 0 | 15961 | 3232 | 1.076240408 | 0 | 15989 | 3260 | 1.06902776 | 0 | 16017 | 3288 | 1.063381667 | 0 |
| 15934 | 3205 | 1.087084172 | 0 | 15962 | 3233 | 1.076169785 | 0 | 15990 | 3261 | 1.068849148 | 0 | 16018 | 3289 | 1.062934674 | 0 |
| 15935 | 3206 | 1.086620595 | 0 | 15963 | 3234 | 1.075878345 | 0 | 15991 | 3262 | 1.068606864 | 0 | 16019 | 3290 | 1.062547041 | 0 |
| 15936 | 3207 | 1.086196549 | 0 | 15964 | 3235 | 1.075380015 | 0 | 15992 | 3263 | 1.068606864 | 0 | 16020 | 3291 | 1.062434046 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16021 | 3292 | 1.062271176 | 0 | 16049 | 3320 | 1.055485186 | 0 | 16077 | 3348 | 1.048185948 | 0 | 16105 | 3376 | 1.042121225 | 0 |
| 16022 | 3293 | 1.061559334 | 0 | 16050 | 3321 | 1.055485186 | 0 | 16078 | 3349 | 1.047516257 | 0 | 16106 | 3377 | 1.042121225 | 0 |
| 16023 | 3294 | 1.061089064 | 0 | 16051 | 3322 | 1.055485186 | 0 | 16079 | 3350 | 1.047290708 | 0 | 16107 | 3378 | 1.041912379 | 0 |
| 16024 | 3295 | 1.060880218 | 0 | 16052 | 3323 | 1.055485186 | 0 | 16080 | 3351 | 1.047052019 | 0 | 16108 | 3379 | 1.041912379 | 0 |
| 16025 | 3296 | 1.060781526 | 0 | 16053 | 3324 | 1.055485186 | 0 | 16081 | 3352 | 1.046885015 | 0 | 16109 | 3380 | 1.041586577 | 0 |
| 16026 | 3297 | 1.060505988 | 0 | 16054 | 3325 | 1.055485186 | 0 | 16082 | 3353 | 1.046850817 | 0 | 16110 | 3381 | 1.041244747 | 0 |
| 16027 | 3298 | 1.060505988 | -0.423517317 | 16055 | 3326 | 1.055485186 | 0 | 16083 | 3354 | 1.046746572 | -1.525514685 | 16111 | 3382 | 1.040699265 | 0 |
| 16028 | 3299 | 1.060032814 | -0.626443314 | 16056 | 3327 | 1.055485186 | 0 | 16084 | 3355 | 1.046530344 | -0.992128303 | 16112 | 3383 | 1.04050803 | 0 |
| 16029 | 3300 | 1.060032814 | -0.92747331 | 16057 | 3328 | 1.055485186 | 0 | 16085 | 3356 | 1.04624453 | 0 | 16113 | 3384 | 1.039903444 | -1.481866821 |
| 16030 | 3301 | 1.059894305 | 0 | 16058 | 3329 | 1.055485186 | 0 | 16086 | 3357 | 1.045939868 | 0 | 16114 | 3385 | 1.039690919 | 0 |
| 16031 | 3302 | 1.059469567 | 0 | 16059 | 3330 | 1.053765206 | -1.528961485 | 16087 | 3358 | 1.045939868 | 0 | 16115 | 3386 | 1.039690919 | 0 |
| 16032 | 3303 | 1.059469567 | 0 | 16060 | 3331 | 1.052812597 | -1.036998572 | 16088 | 3359 | 1.045939868 | 0 | 16116 | 3387 | 1.039690919 | 0 |
| 16033 | 3304 | 1.059362841 | 0 | 16061 | 3332 | 1.052655896 | 0 | 16089 | 3360 | 1.045408296 | 0 | 16117 | 3388 | 1.03933855 | 0 |
| 16034 | 3305 | 1.059030467 | 0 | 16062 | 3333 | 1.052415955 | 0 | 16090 | 3361 | 1.044761321 | 0 | 16118 | 3389 | 1.039017072 | 0 |
| 16035 | 3306 | 1.059030467 | 0 | 16063 | 3334 | 1.052349473 | 0 | 16091 | 3362 | 1.044654339 | 0 | 16119 | 3390 | 1.038970098 | 0 |
| 16036 | 3307 | 1.058787822 | -1.243112259 | 16064 | 3335 | 1.052280047 | 0 | 16092 | 3363 | 1.044489802 | 0 | 16120 | 3391 | 1.038451847 | -1.318965562 |
| 16037 | 3308 | 1.058511641 | 0 | 16065 | 3336 | 1.051590143 | -0.874028991 | 16093 | 3364 | 1.044489802 | -1.20502221 | 16121 | 3392 | 1.03811109 | 0 |
| 16038 | 3309 | 1.057500478 | 0 | 16066 | 3337 | 1.051248133 | 0 | 16094 | 3365 | 1.044055725 | 0 | 16122 | 3393 | 1.037756419 | 0 |
| 16039 | 3310 | 1.055485186 | 0 | 16067 | 3338 | 1.051185206 | 0 | 16095 | 3366 | 1.044055725 | -1.313361685 | 16123 | 3394 | 1.037756419 | 0 |
| 16040 | 3311 | 1.055485186 | 0 | 16068 | 3339 | 1.050984685 | 0 | 16096 | 3367 | 1.043903314 | 0 | 16124 | 3395 | 1.037311217 | 0 |
| 16041 | 3312 | 1.055485186 | 0 | 16069 | 3340 | 1.050984685 | 0 | 16097 | 3368 | 1.043585963 | 0 | 16125 | 3396 | 1.037196401 | 0 |
| 16042 | 3313 | 1.055485186 | 0 | 16070 | 3341 | 1.050156353 | 0 | 16098 | 3369 | 1.043336297 | 0 | 16126 | 3397 | 1.037196401 | 0 |
| 16043 | 3314 | 1.055485186 | 0 | 16071 | 3342 | 1.050056435 | 0 | 16099 | 3370 | 1.04325073 | 0 | 16127 | 3398 | 1.037001781 | 0 |
| 16044 | 3315 | 1.055485186 | 0 | 16072 | 3343 | 1.049616253 | 0 | 16100 | 3371 | 1.043181404 | 0 | 16128 | 3399 | 1.036843076 | 0 |
| 16045 | 3316 | 1.055485186 | 0 | 16073 | 3344 | 1.049616253 | 0 | 16101 | 3372 | 1.043075928 | 0 | 16129 | 3400 | 1.036180031 | 0 |
| 16046 | 3317 | 1.055485186 | 0 | 16074 | 3345 | 1.049236237 | 0 | 16102 | 3373 | 1.042968629 | 0 | 16130 | 3401 | 1.036056635 | -1.329960946 |
| 16047 | 3318 | 1.055485186 | 0 | 16075 | 3346 | 1.049236237 | 0 | 16103 | 3374 | 1.042843706 | 0 | 16131 | 3402 | 1.035830498 | 0 |
| 16048 | 3319 | 1.055485186 | 0 | 16076 | 3347 | 1.049098388 | 0 | 16104 | 3375 | 1.04232374 | 0 | 16132 | 3403 | 1.0352818 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16133 | 3404 | 1.035078336 | 0 | 16161 | 3432 | 1.028211102 | 0 | 16189 | 3460 | 1.0238862 | 0 | 16217 | 3488 | 1.019946861 | 0 |
| 16134 | 3405 | 1.035044026 | -1.065360216 | 16162 | 3433 | 1.028211102 | 0 | 16190 | 3461 | 1.0238862 | 0 | 16218 | 3489 | 1.019946861 | -0.31772649 |
| 16135 | 3406 | 1.035022132 | 0 | 16163 | 3434 | 1.028046938 | 0 | 16191 | 3462 | 1.0238862 | -1.358837074 | 16219 | 3490 | 1.019909032 | -0.707254185 |
| 16136 | 3407 | 1.034995798 | 0 | 16164 | 3435 | 1.027989013 | 0 | 16192 | 3463 | 1.023770773 | 0 | 16220 | 3491 | 1.019135164 | 0 |
| 16137 | 3408 | 1.03470158 | -1.155224741 | 16165 | 3436 | 1.027989013 | 0 | 16193 | 3464 | 1.023770773 | -0.102038049 | 16221 | 3492 | 1.018968353 | 0 |
| 16138 | 3409 | 1.03455128 | 0 | 16166 | 3437 | 1.027791696 | 0 | 16194 | 3465 | 1.02351598 | 0 | 16222 | 3493 | 1.018968353 | 0 |
| 16139 | 3410 | 1.034295887 | 0 | 16167 | 3438 | 1.027456463 | 0 | 16195 | 3466 | 1.02351598 | 0 | 16223 | 3494 | 1.018968353 | 0 |
| 16140 | 3411 | 1.034087042 | -0.188631794 | 16168 | 3439 | 1.027456463 | 0 | 16196 | 3467 | 1.023300503 | 0 | 16224 | 3495 | 1.018762379 | 0 |
| 16141 | 3412 | 1.033765937 | 0 | 16169 | 3440 | 1.027456463 | 0 | 16197 | 3468 | 1.023017298 | 0 | 16225 | 3496 | 1.018682538 | 0 |
| 16142 | 3413 | 1.033765937 | -0.194556776 | 16170 | 3441 | 1.027456463 | 0 | 16198 | 3469 | 1.022955962 | 0 | 16226 | 3497 | 1.018640129 | 0 |
| 16143 | 3414 | 1.033093914 | 0 | 16171 | 3442 | 1.026840005 | -0.320817567 | 16199 | 3470 | 1.022955962 | 0 | 16227 | 3498 | 1.01850162 | 0 |
| 16144 | 3415 | 1.032535988 | 0 | 16172 | 3443 | 1.026761035 | 0 | 16200 | 3471 | 1.022955962 | -1.112612698 | 16228 | 3499 | 1.018022795 | 0 |
| 16145 | 3416 | 1.032398366 | 0 | 16173 | 3444 | 1.026761035 | 0 | 16201 | 3472 | 1.022860711 | 0 | 16229 | 3500 | 1.017901144 | 0 |
| 16146 | 3417 | 1.032004091 | 0 | 16174 | 3445 | 1.026595621 | 0 | 16202 | 3473 | 1.022790169 | 0 | 16230 | 3501 | 1.017901144 | 0 |
| 16147 | 3418 | 1.032004091 | 0 | 16175 | 3446 | 1.026595621 | 0 | 16203 | 3474 | 1.022692673 | 0 | 16231 | 3502 | 1.017696626 | 0 |
| 16148 | 3419 | 1.032004091 | 0 | 16176 | 3447 | 1.02652149 | 0 | 16204 | 3475 | 1.022583017 | 0 | 16232 | 3503 | 1.017696626 | 0 |
| 16149 | 3420 | 1.031616846 | -0.920561315 | 16177 | 3448 | 1.02619581 | 0 | 16205 | 3476 | 1.022484926 | 0 | 16233 | 3504 | 1.017395137 | 0 |
| 16150 | 3421 | 1.031446946 | -0.394686276 | 16178 | 3449 | 1.025521963 | 0 | 16206 | 3477 | 1.022425086 | 0 | 16234 | 3505 | 1.017183578 | 0 |
| 16151 | 3422 | 1.031351507 | -1.171163942 | 16179 | 3450 | 1.025521963 | 0 | 16207 | 3478 | 1.022316823 | -0.958349876 | 16235 | 3506 | 1.016855784 | 0 |
| 16152 | 3423 | 1.031011417 | 0 | 16180 | 3451 | 1.025521963 | 0 | 16208 | 3479 | 1.022178004 | 0 | 16236 | 3507 | 1.016855784 | 0 |
| 16153 | 3424 | 1.031011417 | -1.466285079 | 16181 | 3452 | 1.025399816 | 0 | 16209 | 3480 | 1.021876585 | 0 | 16237 | 3508 | 1.016732597 | 0 |
| 16154 | 3425 | 1.029724324 | 0 | 16182 | 3453 | 1.025102557 | 0 | 16210 | 3481 | 1.021237342 | -0.05218341 | 16238 | 3509 | 1.016732597 | 0 |
| 16155 | 3426 | 1.029156248 | 0 | 16183 | 3454 | 1.024995864 | 0 | 16211 | 3482 | 1.02072308 | 0 | 16239 | 3510 | 1.01656712 | 0 |
| 16156 | 3427 | 1.029156248 | 0 | 16184 | 3455 | 1.024780213 | -1.592708584 | 16212 | 3483 | 1.02072308 | 0 | 16240 | 3511 | 1.01656712 | 0 |
| 16157 | 3428 | 1.028926158 | 0 | 16185 | 3456 | 1.024704852 | -1.103564569 | 16213 | 3484 | 1.02072308 | 0 | 16241 | 3512 | 1.016387326 | 0 |
| 16158 | 3429 | 1.028750933 | 0 | 16186 | 3457 | 1.024450953 | 0 | 16214 | 3485 | 1.02072308 | -0.503025751 | 16242 | 3513 | 1.015976645 | 0 |
| 16159 | 3430 | 1.02865562 | -0.985179443 | 16187 | 3458 | 1.024450953 | 0 | 16215 | 3486 | 1.02072308 | -1.281177001 | 16243 | 3514 | 1.015976645 | 0 |
| 16160 | 3431 | 1.028501697 | 0 | 16188 | 3459 | 1.024450953 | 0 | 16216 | 3487 | 1.02072308 | -1.385912352 | 16244 | 3515 | 1.015976645 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16245 | 3516 | 1.015613674 | 0 | 16273 | 3544 | 1.009727696 | 0 | 16301 | 3572 | 1.005571736 | 0 | 16329 | 3600 | 1.001127524 | 0 |
| 16246 | 3517 | 1.01555724 | 0 | 16274 | 3545 | 1.009727696 | 0 | 16302 | 3573 | 1.005318577 | 0 | 16330 | 3601 | 1.001127524 | 0 |
| 16247 | 3518 | 1.015056529 | 0 | 16275 | 3546 | 1.009727696 | 0 | 16303 | 3574 | 1.005075683 | 0 | 16331 | 3602 | 1.001127524 | 0 |
| 16248 | 3519 | 1.014867335 | -1.351150245 | 16276 | 3547 | 1.009727696 | 0 | 16304 | 3575 | 1.004745295 | 0 | 16332 | 3603 | 1.001127524 | 0 |
| 16249 | 3520 | 1.014691115 | 0 | 16277 | 3548 | 1.009027785 | -1.441811309 | 16305 | 3576 | 1.004706894 | 0 | 16333 | 3604 | 1.001127524 | 0 |
| 16250 | 3521 | 1.014448335 | 0 | 16278 | 3549 | 1.008992227 | -1.42030719 | 16306 | 3577 | 1.004332664 | 0 | 16334 | 3605 | 1.001127524 | -1.259379872 |
| 16251 | 3522 | 1.014092501 | 0 | 16279 | 3550 | 1.008909044 | 0 | 16307 | 3578 | 1.004332664 | -0.858234723 | 16335 | 3606 | 1.000584316 | -0.216017594 |
| 16252 | 3523 | 1.013883656 | 0 | 16280 | 3551 | 1.008859974 | 0 | 16308 | 3579 | 1.003940524 | 0 | 16336 | 3607 | 1.000519694 | 0 |
| 16253 | 3524 | 1.013844262 | -0.414636503 | 16281 | 3552 | 1.008586317 | 0 | 16309 | 3580 | 1.003689741 | 0 | 16337 | 3608 | 1.00043762 | 0 |
| 16254 | 3525 | 1.013786552 | -1.278129308 | 16282 | 3553 | 1.008488624 | 0 | 16310 | 3581 | 1.003689741 | 0 | 16338 | 3609 | 1.000329922 | 0 |
| 16255 | 3526 | 1.013693883 | 0 | 16283 | 3554 | 1.008488624 | 0 | 16311 | 3582 | 1.003689741 | 0 | 16339 | 3610 | 1.000262395 | 0 |
| 16256 | 3527 | 1.013520685 | 0 | 16284 | 3555 | 1.008232705 | 0 | 16312 | 3583 | 1.003567387 | 0 | 16340 | 3611 | 0.999898098 | 0 |
| 16257 | 3528 | 1.01336198 | 0 | 16285 | 3556 | 1.008151308 | 0 | 16313 | 3584 | 1.003456186 | 0 | 16341 | 3612 | 0.999369244 | 0 |
| 16258 | 3529 | 1.013287507 | 0 | 16286 | 3557 | 1.007843552 | 0 | 16314 | 3585 | 1.003456186 | 0 | 16342 | 3613 | 0.999369244 | 0 |
| 16259 | 3530 | 1.013287507 | 0 | 16287 | 3558 | 1.007758103 | 0 | 16315 | 3586 | 1.003387518 | 0 | 16343 | 3614 | 0.999369244 | 0 |
| 16260 | 3531 | 1.013081338 | 0 | 16288 | 3559 | 1.00744793 | 0 | 16316 | 3587 | 1.003387518 | -0.040410768 | 16344 | 3615 | 0.999262262 | -1.271968999 |
| 16261 | 3532 | 1.012733206 | 0 | 16289 | 3560 | 1.00738648 | 0 | 16317 | 3588 | 1.003307175 | 0 | 16345 | 3616 | 0.99900383 | 0 |
| 16262 | 3533 | 1.012450554 | 0 | 16290 | 3561 | 1.007180507 | 0 | 16318 | 3589 | 1.003097117 | -1.468263644 | 16346 | 3617 | 0.998757562 | 0 |
| 16263 | 3534 | 1.012289913 | 0 | 16291 | 3562 | 1.007180507 | 0 | 16319 | 3590 | 1.003097117 | -1.468263644 | 16347 | 3618 | 0.99866227 | 0 |
| 16264 | 3535 | 1.011904615 | 0 | 16292 | 3563 | 1.007063304 | 0 | 16320 | 3591 | 1.002872849 | 0 | 16348 | 3619 | 0.99866227 | 0 |
| 16265 | 3536 | 1.011706262 | 0 | 16293 | 3564 | 1.006934796 | 0 | 16321 | 3592 | 1.002872849 | -1.299027232 | 16349 | 3620 | 0.998446685 | 0 |
| 16266 | 3537 | 1.01162005 | 0 | 16294 | 3565 | 1.006498726 | 0 | 16322 | 3593 | 1.002326681 | 0 | 16350 | 3621 | 0.998189782 | 0 |
| 16267 | 3538 | 1.011468357 | 0 | 16295 | 3566 | 1.006267164 | 0 | 16323 | 3594 | 1.002040867 | 0 | 16351 | 3622 | 0.998107083 | -1.431192333 |
| 16268 | 3539 | 1.011468357 | 0 | 16296 | 3567 | 1.006182415 | 0 | 16324 | 3595 | 1.001902358 | -1.175058986 | 16352 | 3623 | 0.997828473 | 0 |
| 16269 | 3540 | 1.011369643 | 0 | 16297 | 3568 | 1.006123572 | 0 | 16325 | 3596 | 1.001902358 | -1.175058986 | 16353 | 3624 | 0.997759433 | 0 |
| 16270 | 3541 | 1.011006915 | 0 | 16298 | 3569 | 1.005797402 | 0 | 16326 | 3597 | 1.001847747 | -0.808888002 | 16354 | 3625 | 0.997734581 | 0 |
| 16271 | 3542 | 1.010440238 | 0 | 16299 | 3570 | 1.005797402 | 0 | 16327 | 3598 | 1.001722041 | 0 | 16355 | 3626 | 0.997493239 | 0 |
| 16272 | 3543 | 1.010406812 | 0 | 16300 | 3571 | 1.00561113 | 0 | 16328 | 3599 | 1.001609806 | 0 | 16356 | 3627 | 0.997214935 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16357 | 3628 | 0.997138569 | -0.766819021 | 16385 | 3656 | 0.99333728 | 0 | 16413 | 3684 | 0.988538397 | 0 | 16441 | 3712 | 0.983791962 | 0 |
| 16358 | 3629 | 0.996890471 | 0 | 16386 | 3657 | 0.99333728 | 0 | 16414 | 3685 | 0.988538397 | 0 | 16442 | 3713 | 0.983791962 | -0.964690054 |
| 16359 | 3630 | 0.996810923 | 0 | 16387 | 3658 | 0.99333728 | 0 | 16415 | 3686 | 0.987584951 | 0 | 16443 | 3714 | 0.98353687 | 0 |
| 16360 | 3631 | 0.996810923 | 0 | 16388 | 3659 | 0.99333728 | 0 | 16416 | 3687 | 0.987522503 | 0 | 16444 | 3715 | 0.9832528 | 0 |
| 16361 | 3632 | 0.996707186 | 0 | 16389 | 3660 | 0.993101953 | -0.977099312 | 16417 | 3688 | 0.987488107 | 0 | 16445 | 3716 | 0.982934519 | -1.495056821 |
| 16362 | 3633 | 0.99656625 | 0 | 16390 | 3661 | 0.992992738 | 0 | 16418 | 3689 | 0.987411822 | 0 | 16446 | 3717 | 0.982669463 | 0 |
| 16363 | 3634 | 0.996507326 | 0 | 16391 | 3662 | 0.992838377 | 0 | 16419 | 3690 | 0.987274074 | 0 | 16447 | 3718 | 0.98257545 | 0 |
| 16364 | 3635 | 0.996507326 | 0 | 16392 | 3663 | 0.992516695 | 0 | 16420 | 3691 | 0.987220355 | 0 | 16448 | 3719 | 0.981698972 | 0 |
| 16365 | 3636 | 0.995899496 | 0 | 16393 | 3664 | 0.992203351 | 0 | 16421 | 3692 | 0.986908772 | 0 | 16449 | 3720 | 0.981698972 | 0 |
| 16366 | 3637 | 0.995899496 | 0 | 16394 | 3665 | 0.991502876 | 0 | 16422 | 3693 | 0.986864813 | 0 | 16450 | 3721 | 0.981698972 | 0 |
| 16367 | 3638 | 0.995756754 | 0 | 16395 | 3666 | 0.991131207 | 0 | 16423 | 3694 | 0.986769374 | 0 | 16451 | 3722 | 0.981698972 | 0 |
| 16368 | 3639 | 0.995756754 | 0 | 16396 | 3667 | 0.991027197 | 0 | 16424 | 3695 | 0.986662392 | -0.491328949 | 16452 | 3723 | 0.981505134 | 0 |
| 16369 | 3640 | 0.995716981 | 0 | 16397 | 3668 | 0.991027197 | 0 | 16425 | 3696 | 0.986541637 | 0 | 16453 | 3724 | 0.981438056 | 0 |
| 16370 | 3641 | 0.995487257 | 0 | 16398 | 3669 | 0.99093121 | 0 | 16426 | 3697 | 0.986541637 | 0 | 16454 | 3725 | 0.981383466 | -1.009502399 |
| 16371 | 3642 | 0.995487257 | 0 | 16399 | 3670 | 0.990544379 | 0 | 16427 | 3698 | 0.9862466 | 0 | 16455 | 3726 | 0.981299988 | 0 |
| 16372 | 3643 | 0.995487257 | -1.015142666 | 16400 | 3671 | 0.990314655 | 0 | 16428 | 3699 | 0.985849258 | 0 | 16456 | 3727 | 0.981156443 | 0 |
| 16373 | 3644 | 0.995118742 | -1.243112259 | 16401 | 3672 | 0.99005426 | 0 | 16429 | 3700 | 0.985285239 | 0 | 16457 | 3728 | 0.981082514 | -0.718757576 |
| 16374 | 3645 | 0.995004439 | 0 | 16402 | 3673 | 0.989983638 | 0 | 16430 | 3701 | 0.985197654 | 0 | 16458 | 3729 | 0.980985259 | 0 |
| 16375 | 3646 | 0.994584357 | 0 | 16403 | 3674 | 0.989983638 | 0 | 16431 | 3702 | 0.985105221 | 0 | 16459 | 3730 | 0.980851568 | 0 |
| 16376 | 3647 | 0.994584357 | 0 | 16404 | 3675 | 0.989860451 | 0 | 16432 | 3703 | 0.985040704 | 0 | 16460 | 3731 | 0.980420507 | 0 |
| 16377 | 3648 | 0.994487729 | 0 | 16405 | 3676 | 0.989860451 | 0 | 16433 | 3704 | 0.984904112 | 0 | 16461 | 3732 | 0.980234234 | 0 |
| 16378 | 3649 | 0.99421553 | 0 | 16406 | 3677 | 0.988538397 | 0 | 16434 | 3705 | 0.984756418 | 0 | 16462 | 3733 | 0.980105229 | 0 |
| 16379 | 3650 | 0.99421553 | 0 | 16407 | 3678 | 0.988538397 | 0 | 16435 | 3706 | 0.984756418 | -1.363887067 | 16463 | 3734 | 0.979764472 | 0 |
| 16380 | 3651 | 0.993828285 | 0 | 16408 | 3679 | 0.988538397 | 0 | 16436 | 3707 | 0.984677976 | 0 | 16464 | 3735 | 0.979764472 | 0 |
| 16381 | 3652 | 0.993653821 | 0 | 16409 | 3680 | 0.988538397 | 0 | 16437 | 3708 | 0.984421831 | 0 | 16465 | 3736 | 0.979764472 | 0 |
| 16382 | 3653 | 0.993598196 | 0 | 16410 | 3681 | 0.988538397 | 0 | 16438 | 3709 | 0.984231309 | 0 | 16466 | 3737 | 0.979764472 | 0 |
| 16383 | 3654 | 0.993530342 | 0 | 16411 | 3682 | 0.988538397 | 0 | 16439 | 3710 | 0.984129278 | -1.422506154 | 16467 | 3738 | 0.979764472 | -0.669909008 |
| 16384 | 3655 | 0.993490497 | 0 | 16412 | 3683 | 0.988538397 | 0 | 16440 | 3711 | 0.983966834 | 0 | 16468 | 3739 | 0.979479783 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16469 | 3740 | 0.979442892 | -1.411398273 | 16497 | 3768 | 0.97630394 | 0 | 16525 | 3796 | 0.970533975 | 0 | 16553 | 3824 | 0.965710867 | 0 |
| 16470 | 3741 | 0.979330395 | 0 | 16498 | 3769 | 0.975888149 | 0 | 16526 | 3797 | 0.970313577 | 0 | 16554 | 3825 | 0.965710867 | 0 |
| 16471 | 3742 | 0.979330395 | -1.281177001 | 16499 | 3770 | 0.975443099 | 0 | 16527 | 3798 | 0.969856184 | 0 | 16555 | 3826 | 0.965620661 | 0 |
| 16472 | 3743 | 0.979238374 | 0 | 16500 | 3771 | 0.975256185 | 0 | 16528 | 3799 | 0.969631413 | 0 | 16556 | 3827 | 0.965524033 | 0 |
| 16473 | 3744 | 0.979238374 | 0 | 16501 | 3772 | 0.97496559 | 0 | 16529 | 3800 | 0.969570558 | 0 | 16557 | 3828 | 0.965308556 | 0 |
| 16474 | 3745 | 0.979175997 | 0 | 16502 | 3773 | 0.974829255 | 0 | 16530 | 3801 | 0.969375237 | 0 | 16558 | 3829 | 0.965308556 | 0 |
| 16475 | 3746 | 0.979096841 | 0 | 16503 | 3774 | 0.974750112 | 0 | 16531 | 3802 | 0.969375237 | 0 | 16559 | 3830 | 0.965308556 | 0 |
| 16476 | 3747 | 0.978851129 | 0 | 16504 | 3775 | 0.974451935 | 0 | 16532 | 3803 | 0.969175852 | 0 | 16560 | 3831 | 0.965123946 | 0 |
| 16477 | 3748 | 0.978851129 | 0 | 16505 | 3776 | 0.974451935 | 0 | 16533 | 3804 | 0.968335011 | 0 | 16561 | 3832 | 0.965057301 | 0 |
| 16478 | 3749 | 0.978758579 | 0 | 16506 | 3777 | 0.974451935 | -0.673000085 | 16534 | 3805 | 0.968335011 | 0 | 16562 | 3833 | 0.96476055 | 0 |
| 16479 | 3750 | 0.978723414 | 0 | 16507 | 3778 | 0.974012144 | 0 | 16535 | 3806 | 0.968335011 | 0 | 16563 | 3834 | 0.96476055 | 0 |
| 16480 | 3751 | 0.978723414 | 0 | 16508 | 3779 | 0.97381514 | 0 | 16536 | 3807 | 0.968335011 | 0 | 16564 | 3835 | 0.96476055 | 0 |
| 16481 | 3752 | 0.978554176 | 0 | 16509 | 3780 | 0.97329843 | 0 | 16537 | 3808 | 0.968335011 | 0 | 16565 | 3836 | 0.964626239 | 0 |
| 16482 | 3753 | 0.978319232 | 0 | 16510 | 3781 | 0.973044679 | 0 | 16538 | 3809 | 0.968335011 | 0 | 16566 | 3837 | 0.964626239 | -0.94097578 |
| 16483 | 3754 | 0.978163877 | 0 | 16511 | 3782 | 0.973004889 | 0 | 16539 | 3810 | 0.967576418 | 0 | 16567 | 3838 | 0.964404717 | 0 |
| 16484 | 3755 | 0.977880329 | 0 | 16512 | 3783 | 0.97274413 | 0 | 16540 | 3811 | 0.967576418 | 0 | 16568 | 3839 | 0.964404717 | 0 |
| 16485 | 3756 | 0.977880329 | 0 | 16513 | 3784 | 0.972510951 | 0 | 16541 | 3812 | 0.967530016 | 0 | 16569 | 3840 | 0.964038069 | 0 |
| 16486 | 3757 | 0.977402031 | -1.324498051 | 16514 | 3785 | 0.972510951 | 0 | 16542 | 3813 | 0.967349098 | 0 | 16570 | 3841 | 0.963970205 | 0 |
| 16487 | 3758 | 0.977198471 | 0 | 16515 | 3786 | 0.972245084 | 0 | 16543 | 3814 | 0.967269257 | 0 | 16571 | 3842 | 0.963970205 | 0 |
| 16488 | 3759 | 0.977198471 | 0 | 16516 | 3787 | 0.972204029 | 0 | 16544 | 3815 | 0.967269257 | -1.259379872 | 16572 | 3843 | 0.963871513 | 0 |
| 16489 | 3760 | 0.977058579 | 0 | 16517 | 3788 | 0.972111508 | -0.309585187 | 16545 | 3816 | 0.967063284 | 0 | 16573 | 3844 | 0.963827837 | 0 |
| 16490 | 3761 | 0.976878784 | 0 | 16518 | 3789 | 0.971939135 | 0 | 16546 | 3817 | 0.966758622 | 0 | 16574 | 3845 | 0.963714813 | 0 |
| 16491 | 3762 | 0.976878784 | 0 | 16519 | 3790 | 0.971939135 | 0 | 16547 | 3818 | 0.966544103 | 0 | 16575 | 3846 | 0.963714813 | 0 |
| 16492 | 3763 | 0.97630394 | 0 | 16520 | 3791 | 0.971505057 | 0 | 16548 | 3819 | 0.966413351 | 0 | 16576 | 3847 | 0.96354671 | -0.404594565 |
| 16493 | 3764 | 0.97630394 | 0 | 16521 | 3792 | 0.971164301 | 0 | 16549 | 3820 | 0.966262002 | 0 | 16577 | 3848 | 0.963270295 | 0 |
| 16494 | 3765 | 0.97630394 | 0 | 16522 | 3793 | 0.970663673 | 0 | 16550 | 3821 | 0.966084775 | -0.458279424 | 16578 | 3849 | 0.963170925 | 0 |
| 16495 | 3766 | 0.97630394 | 0 | 16523 | 3794 | 0.970663673 | 0 | 16551 | 3822 | 0.966018768 | 0 | 16579 | 3850 | 0.963102484 | 0 |
| 16496 | 3767 | 0.97630394 | 0 | 16524 | 3795 | 0.970663673 | 0 | 16552 | 3823 | 0.965874412 | -0.352624931 | 16580 | 3851 | 0.963102484 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16581 | 3852 | 0.962731133 | 0 | 16609 | 3880 | 0.958575173 | 0 | 16637 | 3908 | 0.953409333 | 0 | 16665 | 3936 | 0.951022036 | 0 |
| 16582 | 3853 | 0.962731133 | 0 | 16610 | 3881 | 0.958067523 | 0 | 16638 | 3909 | 0.953289577 | 0 | 16666 | 3937 | 0.950749836 | 0 |
| 16583 | 3854 | 0.962209458 | 0 | 16611 | 3882 | 0.958029234 | 0 | 16639 | 3910 | 0.953210434 | 0 | 16667 | 3938 | 0.950749836 | 0 |
| 16584 | 3855 | 0.962209458 | 0 | 16612 | 3883 | 0.957984698 | 0 | 16640 | 3911 | 0.953180142 | -0.131235996 | 16668 | 3939 | 0.95048478 | 0 |
| 16585 | 3856 | 0.961994833 | -0.227931489 | 16613 | 3884 | 0.957984698 | 0 | 16641 | 3912 | 0.952822845 | 0 | 16669 | 3940 | 0.949785808 | 0 |
| 16586 | 3857 | 0.961954914 | 0 | 16614 | 3885 | 0.957577941 | 0 | 16642 | 3913 | 0.952822845 | 0 | 16670 | 3941 | 0.949569687 | 0 |
| 16587 | 3858 | 0.961910419 | 0 | 16615 | 3886 | 0.957504163 | 0 | 16643 | 3914 | 0.952822845 | 0 | 16671 | 3942 | 0.949569687 | 0 |
| 16588 | 3859 | 0.961386151 | 0 | 16616 | 3887 | 0.956998785 | 0 | 16644 | 3915 | 0.952822845 | 0 | 16672 | 3943 | 0.949490645 | 0 |
| 16589 | 3860 | 0.960698867 | 0 | 16617 | 3888 | 0.956875389 | 0 | 16645 | 3916 | 0.952822845 | 0 | 16673 | 3944 | 0.949386273 | 0 |
| 16590 | 3861 | 0.960509673 | 0 | 16618 | 3889 | 0.95595103 | 0 | 16646 | 3917 | 0.952822845 | 0 | 16674 | 3945 | 0.949029855 | 0 |
| 16591 | 3862 | 0.960509673 | 0 | 16619 | 3890 | 0.95595103 | 0 | 16647 | 3918 | 0.952822845 | 0 | 16675 | 3946 | 0.949029855 | 0 |
| 16592 | 3863 | 0.96021712 | 0 | 16620 | 3891 | 0.955689485 | 0 | 16648 | 3919 | 0.952822845 | -1.358837074 | 16676 | 3947 | 0.949029855 | 0 |
| 16593 | 3864 | 0.960101693 | 0 | 16621 | 3892 | 0.955630793 | 0 | 16649 | 3920 | 0.952374887 | 0 | 16677 | 3948 | 0.949029855 | 0 |
| 16594 | 3865 | 0.959956079 | 0 | 16622 | 3893 | 0.955114641 | 0 | 16650 | 3921 | 0.952374887 | 0 | 16678 | 3949 | 0.949029855 | 0 |
| 16595 | 3866 | 0.959913524 | 0 | 16623 | 3894 | 0.9550586 | 0 | 16651 | 3922 | 0.952374887 | 0 | 16679 | 3950 | 0.949029855 | -0.913537532 |
| 16596 | 3867 | 0.959835826 | 0 | 16624 | 3895 | 0.954619308 | 0 | 16652 | 3923 | 0.952374887 | -0.635491443 | 16680 | 3951 | 0.948590952 | 0 |
| 16597 | 3868 | 0.959835826 | 0 | 16625 | 3896 | 0.954458607 | 0 | 16653 | 3924 | 0.952326224 | 0 | 16681 | 3952 | 0.948519821 | 0 |
| 16598 | 3869 | 0.95940319 | -1.243112259 | 16626 | 3897 | 0.954458607 | 0 | 16654 | 3925 | 0.952265699 | 0 | 16682 | 3953 | 0.948037182 | 0 |
| 16599 | 3870 | 0.959249021 | 0 | 16627 | 3898 | 0.954458607 | 0 | 16655 | 3926 | 0.952188375 | -1.262561531 | 16683 | 3954 | 0.948037182 | 0 |
| 16600 | 3871 | 0.959249021 | -1.33266684 | 16628 | 3899 | 0.954027546 | 0 | 16656 | 3927 | 0.952086128 | 0 | 16684 | 3955 | 0.948037182 | -0.591223815 |
| 16601 | 3872 | 0.959191631 | 0 | 16629 | 3900 | 0.954027546 | 0 | 16657 | 3928 | 0.951944594 | 0 | 16685 | 3956 | 0.948037182 | -0.989163824 |
| 16602 | 3873 | 0.959066179 | 0 | 16630 | 3901 | 0.954027546 | -1.284203456 | 16658 | 3929 | 0.951735749 | -1.506052205 | 16686 | 3957 | 0.947851308 | 0 |
| 16603 | 3874 | 0.958575173 | 0 | 16631 | 3902 | 0.953887292 | 0 | 16659 | 3930 | 0.951642161 | 0 | 16687 | 3958 | 0.947729572 | 0 |
| 16604 | 3875 | 0.958575173 | 0 | 16632 | 3903 | 0.953776291 | 0 | 16660 | 3931 | 0.951589053 | 0 | 16688 | 3959 | 0.947579789 | 0 |
| 16605 | 3876 | 0.958575173 | 0 | 16633 | 3904 | 0.953611754 | 0 | 16661 | 3932 | 0.951396589 | 0 | 16689 | 3960 | 0.94731666 | 0 |
| 16606 | 3877 | 0.958575173 | 0 | 16634 | 3905 | 0.953449532 | 0 | 16662 | 3933 | 0.951396589 | 0 | 16690 | 3961 | 0.94731666 | 0 |
| 16607 | 3878 | 0.958575173 | 0 | 16635 | 3906 | 0.953409333 | 0 | 16663 | 3934 | 0.951396589 | 0 | 16691 | 3962 | 0.947145712 | 0 |
| 16608 | 3879 | 0.958575173 | 0 | 16636 | 3907 | 0.953409333 | 0 | 16664 | 3935 | 0.951396589 | 0 | 16692 | 3963 | 0.947025724 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16693 | 3964 | 0.946936866 | 0 | 16721 | 3992 | 0.944334734 | 0 | 16749 | 4020 | 0.941182765 | 0 | 16777 | 4048 | 0.937845689 | 0 |
| 16694 | 3965 | 0.946733211 | 0 | 16722 | 3993 | 0.944334734 | 0 | 16750 | 4021 | 0.941113747 | -0.319393649 | 16778 | 4049 | 0.937845689 | 0 |
| 16695 | 3966 | 0.946733211 | 0 | 16723 | 3994 | 0.944334734 | 0 | 16751 | 4022 | 0.941011883 | 0 | 16779 | 4050 | 0.937532571 | 0 |
| 16696 | 3967 | 0.94667595 | -0.790952701 | 16724 | 3995 | 0.944334734 | 0 | 16752 | 4023 | 0.940765615 | 0 | 16780 | 4051 | 0.937532571 | -1.393012692 |
| 16697 | 3968 | 0.94663327 | 0 | 16725 | 3996 | 0.944334734 | 0 | 16753 | 4024 | 0.940765615 | 0 | 16781 | 4052 | 0.937385874 | 0 |
| 16698 | 3969 | 0.946340717 | 0 | 16726 | 3997 | 0.944334734 | 0 | 16754 | 4025 | 0.940530671 | 0 | 16782 | 4053 | 0.937385874 | 0 |
| 16699 | 3970 | 0.946340717 | 0 | 16727 | 3998 | 0.944334734 | -0.520292644 | 16755 | 4026 | 0.940530671 | 0 | 16783 | 4054 | 0.937177029 | 0 |
| 16700 | 3971 | 0.946340717 | 0 | 16728 | 3999 | 0.944089023 | 0 | 16756 | 4027 | 0.940233717 | 0 | 16784 | 4055 | 0.937177029 | 0 |
| 16701 | 3972 | 0.946340717 | 0 | 16729 | 4000 | 0.943910411 | 0 | 16757 | 4028 | 0.940233717 | 0 | 16785 | 4056 | 0.936855924 | 0 |
| 16702 | 3973 | 0.946340717 | 0 | 16730 | 4001 | 0.943910411 | -1.233050933 | 16758 | 4029 | 0.940176434 | 0 | 16786 | 4057 | 0.936795399 | 0 |
| 16703 | 3974 | 0.946058616 | 0 | 16731 | 4002 | 0.943511427 | 0 | 16759 | 4030 | 0.940091768 | -1.080083473 | 16787 | 4058 | 0.936620598 | 0 |
| 16704 | 3975 | 0.946019136 | 0 | 16732 | 4003 | 0.943511427 | 0 | 16760 | 4031 | 0.939953918 | 0 | 16788 | 4059 | 0.936620598 | -0.676069317 |
| 16705 | 3976 | 0.945894142 | 0 | 16733 | 4004 | 0.943258415 | 0 | 16761 | 4032 | 0.939886476 | 0 | 16789 | 4060 | 0.936298779 | 0 |
| 16706 | 3977 | 0.945610196 | 0 | 16734 | 4005 | 0.943063007 | 0 | 16762 | 4033 | 0.939689829 | 0 | 16790 | 4061 | 0.936150327 | -0.271968999 |
| 16707 | 3978 | 0.945610196 | 0 | 16735 | 4006 | 0.942780906 | 0 | 16763 | 4034 | 0.939689829 | 0 | 16791 | 4062 | 0.936009345 | 0 |
| 16708 | 3979 | 0.945610196 | 0 | 16736 | 4007 | 0.942780906 | 0 | 16764 | 4035 | 0.939391857 | 0 | 16792 | 4063 | 0.936009345 | 0 |
| 16709 | 3980 | 0.945523606 | 0 | 16737 | 4008 | 0.942780906 | 0 | 16765 | 4036 | 0.939146622 | 0 | 16793 | 4064 | 0.936009345 | 0 |
| 16710 | 3981 | 0.945269707 | 0 | 16738 | 4009 | 0.942780906 | 0 | 16766 | 4037 | 0.938979617 | 0 | 16794 | 4065 | 0.935875283 | 0 |
| 16711 | 3982 | 0.945159605 | -1.545796712 | 16739 | 4010 | 0.942780906 | 0 | 16767 | 4038 | 0.938979617 | 0 | 16795 | 4066 | 0.935747643 | 0 |
| 16712 | 3983 | 0.945072703 | 0 | 16740 | 4011 | 0.942511242 | 0 | 16768 | 4039 | 0.93866434 | 0 | 16796 | 4067 | 0.935747643 | 0 |
| 16713 | 3984 | 0.94494427 | 0 | 16741 | 4012 | 0.942253209 | 0 | 16769 | 4040 | 0.93866434 | 0 | 16797 | 4068 | 0.935625975 | 0 |
| 16714 | 3985 | 0.944853915 | 0 | 16742 | 4013 | 0.942128322 | 0 | 16770 | 4041 | 0.93866434 | -0.929298079 | 16798 | 4069 | 0.935625975 | -0.754229894 |
| 16715 | 3986 | 0.944694101 | 0 | 16743 | 4014 | 0.941925996 | 0 | 16771 | 4042 | 0.938515379 | 0 | 16799 | 4070 | 0.935509869 | 0 |
| 16716 | 3987 | 0.944632911 | -1.385912352 | 16744 | 4015 | 0.941925996 | 0 | 16772 | 4043 | 0.938371787 | 0 | 16800 | 4071 | 0.935509869 | 0 |
| 16717 | 3988 | 0.944589527 | 0 | 16745 | 4016 | 0.941769154 | 0 | 16773 | 4044 | 0.938371787 | 0 | 16801 | 4072 | 0.935363074 | 0 |
| 16718 | 3989 | 0.944512106 | -1.134441135 | 16746 | 4017 | 0.941182765 | 0 | 16774 | 4045 | 0.938188192 | 0 | 16802 | 4073 | 0.935191355 | 0 |
| 16719 | 3990 | 0.944334734 | 0 | 16747 | 4018 | 0.941182765 | 0 | 16775 | 4046 | 0.938188192 | 0 | 16803 | 4074 | 0.935191355 | 0 |
| 16720 | 3991 | 0.944334734 | 0 | 16748 | 4019 | 0.941182765 | 0 | 16776 | 4047 | 0.938099588 | 0 | 16804 | 4075 | 0.935094078 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16805 | 4076 | 0.934586428 | -1.456254737 | 16833 | 4104 | 0.93054645 | 0 | 16861 | 4132 | 0.928242495 | -1.101272772 | 16889 | 4160 | 0.923367865 | 0 |
| 16806 | 4077 | 0.934441494 | 0 | 16834 | 4105 | 0.93054645 | 0 | 16862 | 4133 | 0.927969027 | 0 | 16890 | 4161 | 0.923367865 | -0.911170799 |
| 16807 | 4078 | 0.934372858 | 0 | 16835 | 4106 | 0.93054645 | 0 | 16863 | 4134 | 0.927969027 | 0 | 16891 | 4162 | 0.923247211 | 0 |
| 16808 | 4079 | 0.934180734 | 0 | 16836 | 4107 | 0.93054645 | 0 | 16864 | 4135 | 0.927906354 | 0 | 16892 | 4163 | 0.923122432 | 0 |
| 16809 | 4080 | 0.93412091 | 0 | 16837 | 4108 | 0.93054645 | 0 | 16865 | 4136 | 0.927771396 | 0 | 16893 | 4164 | 0.923036848 | 0 |
| 16810 | 4081 | 0.933952698 | 0 | 16838 | 4109 | 0.93054645 | 0 | 16866 | 4137 | 0.927698607 | 0 | 16894 | 4165 | 0.922993312 | -1.014207694 |
| 16811 | 4082 | 0.933659685 | 0 | 16839 | 4110 | 0.93054645 | 0 | 16867 | 4138 | 0.92726874 | 0 | 16895 | 4166 | 0.922859621 | -1.483775811 |
| 16812 | 4083 | 0.933572904 | 0 | 16840 | 4111 | 0.93054645 | 0 | 16868 | 4139 | 0.92726874 | 0 | 16896 | 4167 | 0.922273924 | 0 |
| 16813 | 4084 | 0.933572904 | 0 | 16841 | 4112 | 0.93054645 | 0 | 16869 | 4140 | 0.92726874 | 0 | 16897 | 4168 | 0.922273924 | 0 |
| 16814 | 4085 | 0.93349083 | 0 | 16842 | 4113 | 0.93054645 | 0 | 16870 | 4141 | 0.927166709 | 0 | 16898 | 4169 | 0.922145908 | -1.542481471 |
| 16815 | 4086 | 0.93341309 | -1.304817911 | 16843 | 4114 | 0.93054645 | 0 | 16871 | 4142 | 0.926881496 | 0 | 16899 | 4170 | 0.92205834 | 0 |
| 16816 | 4087 | 0.933269308 | 0 | 16844 | 4115 | 0.93054645 | -1.460294715 | 16872 | 4143 | 0.926686029 | 0 | 16900 | 4171 | 0.921591607 | 0 |
| 16817 | 4088 | 0.933269308 | 0 | 16845 | 4116 | 0.93054645 | -1.182745815 | 16873 | 4144 | 0.92639049 | 0 | 16901 | 4172 | 0.921338448 | 0 |
| 16818 | 4089 | 0.933269308 | 0 | 16846 | 4117 | 0.93054645 | 0 | 16874 | 4145 | 0.926225076 | -0.732222329 | 16902 | 4173 | 0.921286089 | 0 |
| 16819 | 4090 | 0.933078786 | 0 | 16847 | 4118 | 0.93054645 | 0 | 16875 | 4146 | 0.926137331 | 0 | 16903 | 4174 | 0.921206424 | 0 |
| 16820 | 4091 | 0.932965924 | -1.077663999 | 16848 | 4119 | 0.93054645 | 0 | 16876 | 4147 | 0.925851329 | 0 | 16904 | 4175 | 0.920786613 | 0 |
| 16821 | 4092 | 0.932862693 | 0 | 16849 | 4120 | 0.93054645 | 0 | 16877 | 4148 | 0.925851329 | 0 | 16905 | 4176 | 0.920786613 | 0 |
| 16822 | 4093 | 0.932814311 | 0 | 16850 | 4121 | 0.93054645 | 0 | 16878 | 4149 | 0.925639115 | 0 | 16906 | 4177 | 0.920607927 | 0 |
| 16823 | 4094 | 0.932814311 | 0 | 16851 | 4122 | 0.93054645 | 0 | 16879 | 4150 | 0.925525648 | 0 | 16907 | 4178 | 0.920422577 | 0 |
| 16824 | 4095 | 0.932639439 | 0 | 16852 | 4123 | 0.93054645 | 0 | 16880 | 4151 | 0.924556086 | 0 | 16908 | 4179 | 0.920327285 | 0 |
| 16825 | 4096 | 0.932078354 | 0 | 16853 | 4124 | 0.93054645 | 0 | 16881 | 4152 | 0.924556086 | 0 | 16909 | 4180 | 0.920258113 | -0.186538804 |
| 16826 | 4097 | 0.93054645 | 0 | 16854 | 4125 | 0.93054645 | -0.028930951 | 16882 | 4153 | 0.924556086 | 0 | 16910 | 4181 | 0.920164414 | 0 |
| 16827 | 4098 | 0.93054645 | 0 | 16855 | 4126 | 0.93054645 | -0.329960946 | 16883 | 4154 | 0.924386141 | 0 | 16911 | 4182 | 0.920116922 | 0 |
| 16828 | 4099 | 0.93054645 | 0 | 16856 | 4127 | 0.928576857 | 0 | 16884 | 4155 | 0.924206272 | 0 | 16912 | 4183 | 0.919822584 | 0 |
| 16829 | 4100 | 0.93054645 | 0 | 16857 | 4128 | 0.928502707 | -0.609122527 | 16885 | 4156 | 0.924206272 | 0 | 16913 | 4184 | 0.919643087 | -1.50965633 |
| 16830 | 4101 | 0.93054645 | 0 | 16858 | 4129 | 0.928290369 | 0 | 16886 | 4157 | 0.924206272 | 0 | 16914 | 4185 | 0.919551065 | 0 |
| 16831 | 4102 | 0.93054645 | 0 | 16859 | 4130 | 0.928290369 | 0 | 16887 | 4158 | 0.924015583 | 0 | 16915 | 4186 | 0.919551065 | 0 |
| 16832 | 4103 | 0.93054645 | 0 | 16860 | 4131 | 0.928242495 | 0 | 16888 | 4159 | 0.923367865 | 0 | 16916 | 4187 | 0.91934855 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 16917 | 4188 | 0.91914699 | 0 | 16945 | 4216 | 0.915823193 | 0 | 16973 | 4244 | 0.912817683 | 0 | 17001 | 4272 | 0.910024783 | 0 |
| 16918 | 4189 | 0.918964577 | 0 | 16946 | 4217 | 0.915722673 | 0 | 16974 | 4245 | 0.912817683 | 0 | 17002 | 4273 | 0.909762844 | 0 |
| 16919 | 4190 | 0.918902469 | 0 | 16947 | 4218 | 0.915722673 | 0 | 16975 | 4246 | 0.912817683 | 0 | 17003 | 4274 | 0.90962935 | 0 |
| 16920 | 4191 | 0.918647226 | 0 | 16948 | 4219 | 0.915722673 | -1.299027232 | 16976 | 4247 | 0.912817683 | 0 | 17004 | 4275 | 0.909357151 | 0 |
| 16921 | 4192 | 0.91850053 | -1.643036862 | 16949 | 4220 | 0.915654894 | 0 | 16977 | 4248 | 0.912550507 | 0 | 17005 | 4276 | 0.909357151 | 0 |
| 16922 | 4193 | 0.918425817 | 0 | 16950 | 4221 | 0.915540541 | 0 | 16978 | 4249 | 0.912394187 | 0 | 17006 | 4277 | 0.909357151 | 0 |
| 16923 | 4194 | 0.918425817 | 0 | 16951 | 4222 | 0.915306483 | 0 | 16979 | 4250 | 0.912394187 | 0 | 17007 | 4278 | 0.909357151 | 0 |
| 16924 | 4195 | 0.918425817 | -0.510054948 | 16952 | 4223 | 0.915306483 | 0 | 16980 | 4251 | 0.912394187 | 0 | 17008 | 4279 | 0.909357151 | 0 |
| 16925 | 4196 | 0.918380543 | 0 | 16953 | 4224 | 0.915306483 | 0 | 16981 | 4252 | 0.91232163 | -0.813072565 | 17009 | 4280 | 0.909357151 | 0 |
| 16926 | 4197 | 0.918311993 | 0 | 16954 | 4225 | 0.915306483 | 0 | 16982 | 4253 | 0.912219069 | 0 | 17010 | 4281 | 0.909357151 | -1.351150245 |
| 16927 | 4198 | 0.918196011 | 0 | 16955 | 4226 | 0.915034284 | 0 | 16983 | 4254 | 0.912150051 | 0 | 17011 | 4282 | 0.909006772 | 0 |
| 16928 | 4199 | 0.918196011 | 0 | 16956 | 4227 | 0.914941376 | 0 | 16984 | 4255 | 0.912063044 | 0 | 17012 | 4283 | 0.9088272 | 0 |
| 16929 | 4200 | 0.918137192 | 0 | 16957 | 4228 | 0.914866246 | 0 | 16985 | 4256 | 0.911797014 | 0 | 17013 | 4284 | 0.908644608 | 0 |
| 16930 | 4201 | 0.918101630 | 0 | 16958 | 4229 | 0.914752183 | -1.175058986 | 16986 | 4257 | 0.911797014 | 0 | 17014 | 4285 | 0.908644608 | -0.73507954 |
| 16931 | 4202 | 0.917957322 | 0 | 16959 | 4230 | 0.914669688 | -1.114845579 | 16987 | 4258 | 0.911661106 | 0 | 17015 | 4286 | 0.908270055 | 0 |
| 16932 | 4203 | 0.917709225 | 0 | 16960 | 4231 | 0.91445963 | 0 | 16988 | 4259 | 0.911661106 | -1.399998813 | 17016 | 4287 | 0.908270055 | -0.329960946 |
| 16933 | 4204 | 0.917581473 | 0 | 16961 | 4232 | 0.914156034 | 0 | 16989 | 4260 | 0.91108397 | 0 | 17017 | 4288 | 0.908105581 | 0 |
| 16934 | 4205 | 0.917503593 | 0 | 16962 | 4233 | 0.913904778 | 0 | 16990 | 4261 | 0.91108397 | 0 | 17018 | 4289 | 0.907882465 | 0 |
| 16935 | 4206 | 0.917182488 | 0 | 16963 | 4234 | 0.913904778 | 0 | 16991 | 4262 | 0.910992913 | 0 | 17019 | 4290 | 0.907882465 | 0 |
| 16936 | 4207 | 0.917182488 | 0 | 16964 | 4235 | 0.913732951 | 0 | 16992 | 4263 | 0.910992913 | 0 | 17020 | 4291 | 0.907738157 | 0 |
| 16937 | 4208 | 0.916902569 | 0 | 16965 | 4236 | 0.913732951 | 0 | 16993 | 4264 | 0.910992913 | -0.850116833 | 17021 | 4292 | 0.907683567 | 0 |
| 16938 | 4209 | 0.916902569 | -1.413642694 | 16966 | 4237 | 0.913608028 | 0 | 16994 | 4265 | 0.910802392 | 0 | 17022 | 4293 | 0.907683567 | -1.318965562 |
| 16939 | 4210 | 0.916845172 | 0 | 16967 | 4238 | 0.913608028 | 0 | 16995 | 4266 | 0.910651621 | 0 | 17023 | 4294 | 0.907562543 | 0 |
| 16940 | 4211 | 0.916758165 | 0 | 16968 | 4239 | 0.913608028 | -1.087262058 | 16996 | 4267 | 0.910651621 | -0.018862556 | 17024 | 4295 | 0.907422651 | 0 |
| 16941 | 4212 | 0.916610672 | 0 | 16969 | 4240 | 0.91351311 | -1.142874303 | 16997 | 4268 | 0.910476467 | 0 | 17025 | 4296 | 0.907422651 | 0 |
| 16942 | 4213 | 0.916438196 | -1.466285079 | 16970 | 4241 | 0.913287444 | 0 | 16998 | 4269 | 0.910343064 | 0 | 17026 | 4297 | 0.907422651 | 0 |
| 16943 | 4214 | 0.916306011 | 0 | 16971 | 4242 | 0.913133648 | -1.18464645 | 16999 | 4270 | 0.910238073 | -1.42030719 | 17027 | 4298 | 0.907344195 | 0 |
| 16944 | 4215 | 0.916306011 | 0 | 16972 | 4243 | 0.912817683 | 0 | 17000 | 4271 | 0.910153291 | 0 | 17028 | 4299 | 0.90729399 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17029 | 4300 | 0.907065354 | 0 | 17057 | 4328 | 0.903002701 | 0 | 17085 | 4356 | 0.900202433 | 0 | 17113 | 4384 | 0.895784344 | 0 |
| 17030 | 4301 | 0.907065354 | 0 | 17058 | 4329 | 0.902875023 | 0 | 17086 | 4357 | 0.900202433 | 0 | 17114 | 4385 | 0.895784344 | 0 |
| 17031 | 4302 | 0.907065354 | -1.182745815 | 17059 | 4330 | 0.902875023 | 0 | 17087 | 4358 | 0.900116494 | 0 | 17115 | 4386 | 0.895784344 | 0 |
| 17032 | 4303 | 0.906696839 | 0 | 17060 | 4331 | 0.902875023 | 0 | 17088 | 4359 | 0.900033834 | 0 | 17116 | 4387 | 0.895784344 | 0 |
| 17033 | 4304 | 0.90641277 | 0 | 17061 | 4332 | 0.902517726 | 0 | 17089 | 4360 | 0.899512216 | 0 | 17117 | 4388 | 0.895784344 | 0 |
| 17034 | 4305 | 0.906046122 | 0 | 17062 | 4333 | 0.902352249 | -0.465789025 | 17090 | 4361 | 0.899137986 | 0 | 17118 | 4389 | 0.895784344 | 0 |
| 17035 | 4306 | 0.905435729 | -1.07523097 | 17063 | 4334 | 0.902315211 | -1.105085742 | 17091 | 4362 | 0.898832037 | 0 | 17119 | 4390 | 0.895784344 | 0 |
| 17036 | 4307 | 0.905042382 | 0 | 17064 | 4335 | 0.901901268 | 0 | 17092 | 4363 | 0.898699083 | 0 | 17120 | 4391 | 0.895784344 | 0 |
| 17037 | 4308 | 0.904992345 | -0.970939004 | 17065 | 4336 | 0.901752257 | 0 | 17093 | 4364 | 0.898699083 | 0 | 17121 | 4392 | 0.895784344 | 0 |
| 17038 | 4309 | 0.90484105 | 0 | 17066 | 4337 | 0.901720124 | 0 | 17094 | 4365 | 0.898699083 | 0 | 17122 | 4393 | 0.895784344 | 0 |
| 17039 | 4310 | 0.904699793 | 0 | 17067 | 4338 | 0.901670322 | 0 | 17095 | 4366 | 0.898699083 | 0 | 17123 | 4394 | 0.895784344 | 0 |
| 17040 | 4311 | 0.904699793 | 0 | 17068 | 4339 | 0.901582754 | 0 | 17096 | 4367 | 0.898577244 | 0 | 17124 | 4395 | 0.895784344 | 0 |
| 17041 | 4312 | 0.904217511 | 0 | 17069 | 4340 | 0.901508242 | 0 | 17097 | 4368 | 0.898520066 | 0 | 17125 | 4396 | 0.895784344 | 0 |
| 17042 | 4313 | 0.904217511 | 0 | 17070 | 4341 | 0.901508242 | 0 | 17098 | 4369 | 0.898361766 | 0 | 17126 | 4397 | 0.895245851 | -0.351473261 |
| 17043 | 4314 | 0.904217511 | 0 | 17071 | 4342 | 0.901162672 | 0 | 17099 | 4370 | 0.898361766 | -1.351150245 | 17127 | 4398 | 0.895218487 | 0 |
| 17044 | 4315 | 0.904217511 | 0 | 17072 | 4343 | 0.901162672 | 0 | 17100 | 4371 | 0.898361766 | 0 | 17128 | 4399 | 0.895188195 | 0 |
| 17045 | 4316 | 0.904217511 | 0 | 17073 | 4344 | 0.901035852 | 0 | 17101 | 4372 | 0.898094426 | 0 | 17129 | 4400 | 0.894970296 | 0 |
| 17046 | 4317 | 0.904217511 | 0 | 17074 | 4345 | 0.901035852 | 0 | 17102 | 4373 | 0.897877333 | 0 | 17130 | 4401 | 0.894970296 | 0 |
| 17047 | 4318 | 0.904217511 | 0 | 17075 | 4346 | 0.901035852 | 0 | 17103 | 4374 | 0.897417031 | -1.37381423 | 17131 | 4402 | 0.894741619 | 0 |
| 17048 | 4319 | 0.904217511 | 0 | 17076 | 4347 | 0.901035852 | 0 | 17104 | 4375 | 0.897305517 | 0 | 17132 | 4403 | 0.894741619 | 0 |
| 17049 | 4320 | 0.904217511 | -0.031778794 | 17077 | 4348 | 0.900954577 | 0 | 17105 | 4376 | 0.897122694 | 0 | 17133 | 4404 | 0.894633894 | 0 |
| 17050 | 4321 | 0.903674303 | 0 | 17078 | 4349 | 0.900954577 | 0 | 17106 | 4377 | 0.897122694 | 0 | 17134 | 4405 | 0.89457123 | 0 |
| 17051 | 4322 | 0.90356296 | 0 | 17079 | 4350 | 0.900583226 | 0 | 17107 | 4378 | 0.896863337 | 0 | 17135 | 4406 | 0.894501346 | -1.178919407 |
| 17052 | 4323 | 0.903488217 | 0 | 17080 | 4351 | 0.900583226 | 0 | 17108 | 4379 | 0.896768023 | 0 | 17136 | 4407 | 0.894422918 | 0 |
| 17053 | 4324 | 0.903394204 | 0 | 17081 | 4352 | 0.900583226 | 0 | 17109 | 4380 | 0.896620329 | 0 | 17137 | 4408 | 0.894422918 | 0 |
| 17054 | 4325 | 0.903394204 | 0 | 17082 | 4353 | 0.900583226 | -1.080083473 | 17110 | 4381 | 0.896392174 | 0 | 17138 | 4409 | 0.894334277 | 0 |
| 17055 | 4326 | 0.903394204 | 0 | 17083 | 4354 | 0.900261646 | 0 | 17111 | 4382 | 0.896360713 | 0 | 17139 | 4410 | 0.894334277 | 0 |
| 17056 | 4327 | 0.903272365 | 0 | 17084 | 4355 | 0.900202433 | 0 | 17112 | 4383 | 0.895784344 | 0 | 17140 | 4411 | 0.894334277 | 0 |

FIG. 3 (Cont.)

| DNA SEQ ID NO | AA SEQ ID NO | Log 10 enrichment in the brain | Log 10 enrichment in the liver |
|---|---|---|---|
| 17141 | 4412 | 0.89423329 | 0 |
| 17142 | 4413 | 0.89423329 | 0 |
| 17143 | 4414 | 0.894117184 | 0 |
| 17144 | 4415 | 0.894117184 | 0 |
| 17145 | 4416 | 0.893823643 | 0 |
| 17146 | 4417 | 0.893823643 | 0 |
| 17147 | 4418 | 0.893222127 | 0 |
| 17148 | 4419 | 0.892950438 | 0 |
| 17149 | 4420 | 0.892950438 | 0 |
| 17150 | 4421 | 0.892913914 | 0 |
| 17151 | 4422 | 0.892757889 | 0 |
| 17152 | 4423 | 0.892757889 | 0 |
| 17153 | 4424 | 0.892757889 | 0 |
| 17154 | 4425 | 0.892757889 | -1.284203456 |
| 17155 | 4426 | 0.8924564 | 0 |
| 17156 | 4427 | 0.8924564 | -1.067021 |
| 17157 | 4428 | 0.892388748 | 0 |
| 17158 | 4429 | 0.892088198 | 0 |
| 17159 | 4430 | 0.892088198 | 0 |
| 17160 | 4431 | 0.891983055 | 0 |
| 17161 | 4432 | 0.891983055 | 0 |
| 17162 | 4433 | 0.891838747 | 0 |
| 17163 | 4434 | 0.891628384 | 0 |
| 17164 | 4435 | 0.891628384 | 0 |
| 17165 | 4436 | 0.891628384 | 0 |
| 17166 | 4437 | 0.891628384 | 0 |
| 17167 | 4438 | 0.891628384 | 0 |
| 17168 | 4439 | 0.891628384 | 0 |
| 17169 | 4440 | 0.891628384 | -1.271968999 |
| 17170 | 4441 | 0.891352729 | 0 |
| 17171 | 4442 | 0.891352729 | -1.42030719 |
| 17172 | 4443 | 0.891293151 | 0 |
| 17173 | 4444 | 0.891200718 | 0 |
| 17174 | 4445 | 0.890952088 | 0 |
| 17175 | 4446 | 0.89089909 | 0 |
| 17176 | 4447 | 0.89089909 | -0.520875982 |
| 17177 | 4448 | 0.890837079 | 0 |
| 17178 | 4449 | 0.890674938 | 0 |
| 17179 | 4450 | 0.890501809 | 0 |
| 17180 | 4451 | 0.890501809 | 0 |
| 17181 | 4452 | 0.890429227 | 0 |
| 17182 | 4453 | 0.890429227 | -0.481228622 |
| 17183 | 4454 | 0.890251855 | 0 |
| 17184 | 4455 | 0.890251855 | 0 |
| 17185 | 4456 | 0.890251855 | 0 |
| 17186 | 4457 | 0.890251855 | 0 |
| 17187 | 4458 | 0.890117793 | -1.381113469 |
| 17188 | 4459 | 0.890012903 | 0 |
| 17189 | 4460 | 0.890012903 | 0 |
| 17190 | 4461 | 0.890012903 | 0 |
| 17191 | 4462 | 0.889928599 | 0 |
| 17192 | 4463 | 0.889752379 | 0 |
| 17193 | 4464 | 0.889752379 | 0 |
| 17194 | 4465 | 0.88952639 | 0 |
| 17195 | 4466 | 0.889494254 | 0 |
| 17196 | 4467 | 0.889153765 | 0 |
| 17197 | 4468 | 0.889153765 | 0 |
| 17198 | 4469 | 0.889153765 | 0 |
| 17199 | 4470 | 0.889153765 | 0 |
| 17200 | 4471 | 0.889153765 | 0 |
| 17201 | 4472 | 0.889153765 | 0 |
| 17202 | 4473 | 0.889153765 | 0 |
| 17203 | 4474 | 0.889153765 | 0 |
| 17204 | 4475 | 0.889153765 | 0 |
| 17205 | 4476 | 0.889153765 | 0 |
| 17206 | 4477 | 0.889153765 | 0 |
| 17207 | 4478 | 0.889153765 | 0 |
| 17208 | 4479 | 0.888620561 | 0 |
| 17209 | 4480 | 0.888537307 | 0 |
| 17210 | 4481 | 0.888537307 | -0.429962036 |
| 17211 | 4482 | 0.888423244 | 0 |
| 17212 | 4483 | 0.888142601 | -1.361369411 |
| 17213 | 4484 | 0.888142601 | -1.361369411 |
| 17214 | 4485 | 0.887994099 | 0 |
| 17215 | 4486 | 0.887868235 | 0 |
| 17216 | 4487 | 0.887794469 | 0 |
| 17217 | 4488 | 0.887794469 | 0 |
| 17218 | 4489 | 0.887794469 | 0 |
| 17219 | 4490 | 0.887511818 | 0 |
| 17220 | 4491 | 0.887321296 | 0 |
| 17221 | 4492 | 0.887321296 | 0 |
| 17222 | 4493 | 0.887247568 | 0 |
| 17223 | 4494 | 0.887247568 | 0 |
| 17224 | 4495 | 0.887080756 | 0 |
| 17225 | 4496 | 0.886965878 | 0 |
| 17226 | 4497 | 0.886640964 | 0 |
| 17227 | 4498 | 0.886342787 | 0 |
| 17228 | 4499 | 0.885964317 | 0 |
| 17229 | 4500 | 0.885964317 | 0 |
| 17230 | 4501 | 0.885734105 | 0 |
| 17231 | 4502 | 0.88531891 | 0 |
| 17232 | 4503 | 0.885223471 | 0 |
| 17233 | 4504 | 0.885108411 | -0.459719871 |
| 17234 | 4505 | 0.885041529 | 0 |
| 17235 | 4506 | 0.884997805 | 0 |
| 17236 | 4507 | 0.884788959 | 0 |
| 17237 | 4508 | 0.884503333 | 0 |
| 17238 | 4509 | 0.884014125 | 0 |
| 17239 | 4510 | 0.884014125 | 0 |
| 17240 | 4511 | 0.883970308 | 0 |
| 17241 | 4512 | 0.883803046 | -1.293158298 |
| 17242 | 4513 | 0.883324221 | 0 |
| 17243 | 4514 | 0.8831218 | 0 |
| 17244 | 4515 | 0.8831218 | 0 |
| 17245 | 4516 | 0.882904815 | 0 |
| 17246 | 4517 | 0.882854459 | -0.523780972 |
| 17247 | 4518 | 0.882622897 | 0 |
| 17248 | 4519 | 0.882420382 | 0 |
| 17249 | 4520 | 0.882420382 | 0 |
| 17250 | 4521 | 0.882420382 | -0.804055746 |
| 17251 | 4522 | 0.88224177 | 0 |
| 17252 | 4523 | 0.88224177 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17253 | 4524 | 0.882133965 | 0 | 17281 | 4552 | 0.879393927 | 0 | 17309 | 4580 | 0.876564637 | 0 | 17337 | 4608 | 0.873144978 | 0 |
| 17254 | 4525 | 0.881328427 | 0 | 17282 | 4553 | 0.879393927 | 0 | 17310 | 4581 | 0.876564637 | 0 | 17338 | 4609 | 0.873144978 | 0 |
| 17255 | 4526 | 0.881061087 | 0 | 17283 | 4554 | 0.879393927 | 0 | 17311 | 4582 | 0.876564637 | 0 | 17339 | 4610 | 0.872921461 | 0 |
| 17256 | 4527 | 0.881061087 | 0 | 17284 | 4555 | 0.879393927 | 0 | 17312 | 4583 | 0.876564637 | 0 | 17340 | 4611 | 0.872921461 | -1.052697673 |
| 17257 | 4528 | 0.880953335 | 0 | 17285 | 4556 | 0.878322917 | 0 | 17313 | 4584 | 0.876388417 | 0 | 17341 | 4612 | 0.872820696 | 0 |
| 17258 | 4529 | 0.880953335 | 0 | 17286 | 4557 | 0.878091694 | 0 | 17314 | 4585 | 0.876388417 | -0.173265614 | 17342 | 4613 | 0.872554503 | 0 |
| 17259 | 4530 | 0.880858666 | -0.818981424 | 17287 | 4558 | 0.877934113 | 0 | 17315 | 4586 | 0.876188787 | 0 | 17343 | 4614 | 0.872554503 | 0 |
| 17260 | 4531 | 0.880774833 | 0 | 17288 | 4559 | 0.877934113 | 0 | 17316 | 4587 | 0.876188787 | -0.289343095 | 17344 | 4615 | 0.872554503 | 0 |
| 17261 | 4532 | 0.880774833 | 0 | 17289 | 4560 | 0.877840099 | 0 | 17317 | 4588 | 0.876188787 | -0.782258617 | 17345 | 4616 | 0.872554503 | 0 |
| 17262 | 4533 | 0.880774833 | 0 | 17290 | 4561 | 0.877840099 | 0 | 17318 | 4589 | 0.876078686 | 0 | 17346 | 4617 | 0.872554503 | 0 |
| 17263 | 4534 | 0.880572475 | 0 | 17291 | 4562 | 0.877733143 | 0 | 17319 | 4590 | 0.875960752 | 0 | 17347 | 4618 | 0.872554503 | 0 |
| 17264 | 4535 | 0.880572475 | 0 | 17292 | 4563 | 0.877610375 | 0 | 17320 | 4591 | 0.875697782 | 0 | 17348 | 4619 | 0.872554503 | -1.108112197 |
| 17265 | 4536 | 0.880572475 | 0 | 17293 | 4564 | 0.877610375 | 0 | 17321 | 4592 | 0.875391185 | 0 | 17349 | 4620 | 0.872215343 | 0 |
| 17266 | 4537 | 0.880467585 | 0 | 17294 | 4565 | 0.877610375 | -1.212200794 | 17322 | 4593 | 0.875217987 | 0 | 17350 | 4621 | 0.872215343 | 0 |
| 17267 | 4538 | 0.879393927 | 0 | 17295 | 4566 | 0.877387945 | 0 | 17323 | 4594 | 0.875029122 | 0 | 17351 | 4622 | 0.872143434 | 0 |
| 17268 | 4539 | 0.879393927 | 0 | 17296 | 4567 | 0.877387945 | -0.763330693 | 17324 | 4595 | 0.875029122 | 0 | 17352 | 4623 | 0.872032828 | 0 |
| 17269 | 4540 | 0.879393927 | 0 | 17297 | 4568 | 0.877300938 | 0 | 17325 | 4596 | 0.874595044 | 0 | 17353 | 4624 | 0.872032828 | 0 |
| 17270 | 4541 | 0.879393927 | 0 | 17298 | 4569 | 0.877300938 | 0 | 17326 | 4597 | 0.874430508 | 0 | 17354 | 4625 | 0.872032828 | 0 |
| 17271 | 4542 | 0.879393927 | 0 | 17299 | 4570 | 0.877300938 | 0 | 17327 | 4598 | 0.874065094 | 0 | 17355 | 4626 | 0.871679791 | 0 |
| 17272 | 4543 | 0.879393927 | 0 | 17300 | 4571 | 0.877300938 | 0 | 17328 | 4599 | 0.874065094 | 0 | 17356 | 4627 | 0.871679791 | 0 |
| 17273 | 4544 | 0.879393927 | 0 | 17301 | 4572 | 0.877206041 | 0 | 17329 | 4600 | 0.87375366 | 0 | 17357 | 4628 | 0.871608671 | 0 |
| 17274 | 4545 | 0.879393927 | 0 | 17302 | 4573 | 0.877206041 | -1.123664044 | 17330 | 4601 | 0.873641598 | 0 | 17358 | 4629 | 0.871424998 | 0 |
| 17275 | 4546 | 0.879393927 | 0 | 17303 | 4574 | 0.877102131 | 0 | 17331 | 4602 | 0.873641598 | 0 | 17359 | 4630 | 0.871424998 | 0 |
| 17276 | 4547 | 0.879393927 | 0 | 17304 | 4575 | 0.877102131 | -0.006654556 | 17332 | 4603 | 0.873641598 | 0 | 17360 | 4631 | 0.871152798 | 0 |
| 17277 | 4548 | 0.879393927 | 0 | 17305 | 4576 | 0.876987858 | 0 | 17333 | 4604 | 0.873403564 | -0.320157043 | 17361 | 4632 | 0.87096076 | 0 |
| 17278 | 4549 | 0.879393927 | 0 | 17306 | 4577 | 0.876987858 | 0 | 17334 | 4605 | 0.873295409 | 0 | 17362 | 4633 | 0.87096076 | 0 |
| 17279 | 4550 | 0.879393927 | 0 | 17307 | 4578 | 0.876861591 | 0 | 17335 | 4606 | 0.873251046 | 0 | 17363 | 4634 | 0.870818017 | 0 |
| 17280 | 4551 | 0.879393927 | 0 | 17308 | 4579 | 0.876861591 | 0 | 17336 | 4607 | 0.873144978 | 0 | 17364 | 4635 | 0.870707748 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17365 | 4636 | 0.870620003 | 0 | 17393 | 4664 | 0.86775562 | 0 | 17421 | 4692 | 0.866192471 | 0 | 17449 | 4720 | 0.86359966 | 0 |
| 17366 | 4637 | 0.870439085 | 0 | 17394 | 4665 | 0.867716226 | 0 | 17422 | 4693 | 0.866192471 | -1.047527439 | 17450 | 4721 | 0.86359966 | 0 |
| 17367 | 4638 | 0.870439085 | 0 | 17395 | 4666 | 0.867687168 | 0 | 17423 | 4694 | 0.866088461 | 0 | 17451 | 4722 | 0.86359966 | 0 |
| 17368 | 4639 | 0.870359244 | 0 | 17396 | 4667 | 0.867494704 | 0 | 17424 | 4695 | 0.866088461 | 0 | 17452 | 4723 | 0.86359966 | 0 |
| 17369 | 4640 | 0.870359244 | 0 | 17397 | 4668 | 0.867494704 | 0 | 17425 | 4696 | 0.866088461 | 0 | 17453 | 4724 | 0.86359966 | 0 |
| 17370 | 4641 | 0.870180005 | 0 | 17398 | 4669 | 0.867494704 | 0 | 17426 | 4697 | 0.865992473 | 0 | 17454 | 4725 | 0.86359966 | 0 |
| 17371 | 4642 | 0.869848609 | 0 | 17399 | 4670 | 0.867494704 | 0 | 17427 | 4698 | 0.865542815 | -1.474145827 | 17455 | 4726 | 0.86359966 | 0 |
| 17372 | 4643 | 0.869848609 | 0 | 17400 | 4671 | 0.867494704 | 0 | 17428 | 4699 | 0.865428271 | 0 | 17456 | 4727 | 0.86359966 | -1.313361685 |
| 17373 | 4644 | 0.869848609 | 0 | 17401 | 4672 | 0.867494704 | 0 | 17429 | 4700 | 0.865428271 | 0 | 17457 | 4728 | 0.86359966 | -0.61439168 |
| 17374 | 4645 | 0.869351989 | 0 | 17402 | 4673 | 0.867494704 | 0 | 17430 | 4701 | 0.865428271 | 0 | 17458 | 4729 | 0.863065144 | 0 |
| 17375 | 4646 | 0.869351989 | 0 | 17403 | 4674 | 0.867494704 | 0 | 17431 | 4702 | 0.865428271 | -0.847376796 | 17459 | 4730 | 0.863036007 | -1.234744091 |
| 17376 | 4647 | 0.869276793 | 0 | 17404 | 4675 | 0.867494704 | -0.818981424 | 17432 | 4703 | 0.865279718 | 0 | 17460 | 4731 | 0.862878839 | 0 |
| 17377 | 4648 | 0.869276793 | 0 | 17405 | 4676 | 0.867159471 | 0 | 17433 | 4704 | 0.865279718 | 0 | 17461 | 4732 | 0.862762062 | 0 |
| 17378 | 4649 | 0.869174762 | 0 | 17406 | 4677 | 0.867159471 | 0 | 17434 | 4705 | 0.865153488 | 0 | 17462 | 4733 | 0.862688234 | 0 |
| 17379 | 4650 | 0.869174762 | 0 | 17407 | 4678 | 0.867159471 | 0 | 17435 | 4706 | 0.865153488 | -0.550255868 | 17463 | 4734 | 0.862688234 | 0 |
| 17380 | 4651 | 0.869174762 | 0 | 17408 | 4679 | 0.867060192 | 0 | 17436 | 4707 | 0.865044901 | 0 | 17464 | 4735 | 0.862600133 | 0 |
| 17381 | 4652 | 0.869028412 | 0 | 17409 | 4680 | 0.86687737 | 0 | 17437 | 4708 | 0.864950499 | 0 | 17465 | 4736 | 0.862360588 | 0 |
| 17382 | 4653 | 0.869028412 | 0 | 17410 | 4681 | 0.86687737 | 0 | 17438 | 4709 | 0.864670671 | 0 | 17466 | 4737 | 0.862360588 | -0.649958781 |
| 17383 | 4654 | 0.868800854 | 0 | 17411 | 4682 | 0.86687737 | 0 | 17439 | 4710 | 0.864570151 | 0 | 17467 | 4738 | 0.862191897 | 0 |
| 17384 | 4655 | 0.868800854 | 0 | 17412 | 4683 | 0.86687737 | -1.070323636 | 17440 | 4711 | 0.864486881 | 0 | 17468 | 4739 | 0.862089069 | 0 |
| 17385 | 4656 | 0.868632097 | 0 | 17413 | 4684 | 0.866776664 | 0 | 17441 | 4712 | 0.86359966 | 0 | 17469 | 4740 | 0.862051372 | 0 |
| 17386 | 4657 | 0.868632097 | 0 | 17414 | 4685 | 0.866712896 | 0 | 17442 | 4713 | 0.86359966 | 0 | 17470 | 4741 | 0.861830637 | 0 |
| 17387 | 4658 | 0.868398543 | 0 | 17415 | 4686 | 0.866712896 | 0 | 17443 | 4714 | 0.86359966 | 0 | 17471 | 4742 | 0.86166516 | 0 |
| 17388 | 4659 | 0.868185706 | 0 | 17416 | 4687 | 0.866712896 | 0 | 17444 | 4715 | 0.86359966 | 0 | 17472 | 4743 | 0.86166516 | 0 |
| 17389 | 4660 | 0.867964466 | 0 | 17417 | 4688 | 0.866712896 | -1.268855764 | 17445 | 4716 | 0.86359966 | 0 | 17473 | 4744 | 0.86166516 | 0 |
| 17390 | 4661 | 0.867964466 | 0 | 17418 | 4689 | 0.86642895 | 0 | 17446 | 4717 | 0.86359966 | 0 | 17474 | 4745 | 0.8615365 | 0 |
| 17391 | 4662 | 0.867812055 | 0 | 17419 | 4690 | 0.86642895 | 0 | 17447 | 4718 | 0.86359966 | 0 | 17475 | 4746 | 0.861465531 | 0 |
| 17392 | 4663 | 0.867812055 | 0 | 17420 | 4691 | 0.86642895 | 0 | 17448 | 4719 | 0.86359966 | 0 | 17476 | 4747 | 0.861219958 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17477 | 4748 | 0.861219958 | 0 | 17505 | 4776 | 0.858853225 | 0 | 17533 | 4804 | 0.857259482 | 0 | 17561 | 4832 | 0.854391658 | 0 |
| 17478 | 4749 | 0.861219958 | 0 | 17506 | 4777 | 0.858853225 | 0 | 17534 | 4805 | 0.857117533 | 0 | 17562 | 4833 | 0.854321036 | 0 |
| 17479 | 4750 | 0.861219958 | -0.242164018 | 17507 | 4778 | 0.858664442 | 0 | 17535 | 4806 | 0.857002655 | 0 | 17563 | 4834 | 0.854321036 | 0 |
| 17480 | 4751 | 0.861219958 | -1.212200794 | 17508 | 4779 | 0.858664442 | 0 | 17536 | 4807 | 0.857002655 | 0 | 17564 | 4835 | 0.854158104 | 0 |
| 17481 | 4752 | 0.861022237 | 0 | 17509 | 4780 | 0.858578859 | 0 | 17537 | 4808 | 0.857002655 | 0 | 17565 | 4836 | 0.854158104 | 0 |
| 17482 | 4753 | 0.860910522 | 0 | 17510 | 4781 | 0.858460021 | 0 | 17538 | 4809 | 0.857002655 | 0 | 17566 | 4837 | 0.853958014 | 0 |
| 17483 | 4754 | 0.860910522 | 0 | 17511 | 4782 | 0.858460021 | 0 | 17539 | 4810 | 0.856907779 | 0 | 17567 | 4838 | 0.853958014 | 0 |
| 17484 | 4755 | 0.860788683 | 0 | 17512 | 4783 | 0.858460021 | 0 | 17540 | 4811 | 0.856760236 | 0 | 17568 | 4839 | 0.853839823 | 0 |
| 17485 | 4756 | 0.860723527 | 0 | 17513 | 4784 | 0.858460021 | -0.013867204 | 17541 | 4812 | 0.856566397 | 0 | 17569 | 4840 | 0.85370642 | 0 |
| 17486 | 4757 | 0.860508583 | 0 | 17514 | 4785 | 0.858351325 | 0 | 17542 | 4813 | 0.856444729 | 0 | 17570 | 4841 | 0.853633065 | 0 |
| 17487 | 4758 | 0.860508583 | 0 | 17515 | 4786 | 0.858283872 | -1.262561531 | 17543 | 4814 | 0.855912831 | 0 | 17571 | 4842 | 0.853633065 | -1.406874331 |
| 17488 | 4759 | 0.860508583 | -1.098968817 | 17516 | 4787 | 0.857995783 | 0 | 17544 | 4815 | 0.855912831 | 0 | 17572 | 4843 | 0.853380495 | 0 |
| 17489 | 4760 | 0.860312025 | 0 | 17517 | 4788 | 0.857995783 | 0 | 17545 | 4816 | 0.855912831 | 0 | 17573 | 4844 | 0.853380495 | 0 |
| 17490 | 4761 | 0.860258917 | 0 | 17518 | 4789 | 0.857995783 | 0 | 17546 | 4817 | 0.855912831 | 0 | 17574 | 4845 | 0.853380495 | 0 |
| 17491 | 4762 | 0.860258917 | 0 | 17519 | 4790 | 0.857995783 | 0 | 17547 | 4818 | 0.855912831 | 0 | 17575 | 4846 | 0.853380495 | 0 |
| 17492 | 4763 | 0.860166484 | 0 | 17520 | 4791 | 0.857995783 | -0.028930951 | 17548 | 4819 | 0.855912831 | 0 | 17576 | 4847 | 0.853380495 | -0.458279424 |
| 17493 | 4764 | 0.860166484 | 0 | 17521 | 4792 | 0.857821821 | 0 | 17549 | 4820 | 0.855912831 | 0 | 17577 | 4848 | 0.853064989 | -1.310532394 |
| 17494 | 4765 | 0.860088772 | -0.26572005 | 17522 | 4793 | 0.857770117 | 0 | 17550 | 4821 | 0.855912831 | 0 | 17578 | 4849 | 0.852941592 | 0 |
| 17495 | 4766 | 0.859965376 | 0 | 17523 | 4794 | 0.857674678 | 0 | 17551 | 4822 | 0.855295497 | 0 | 17579 | 4850 | 0.852941592 | 0 |
| 17496 | 4767 | 0.859832989 | 0 | 17524 | 4795 | 0.857674678 | 0 | 17552 | 4823 | 0.855220729 | 0 | 17580 | 4851 | 0.852941592 | 0 |
| 17497 | 4768 | 0.859832989 | 0 | 17525 | 4796 | 0.857588568 | 0 | 17553 | 4824 | 0.855125353 | 0 | 17581 | 4852 | 0.852659674 | 0 |
| 17498 | 4769 | 0.859615279 | 0 | 17526 | 4797 | 0.857588568 | 0 | 17554 | 4825 | 0.854999488 | 0 | 17582 | 4853 | 0.852659674 | 0 |
| 17499 | 4770 | 0.859537007 | 0 | 17527 | 4798 | 0.857439351 | 0 | 17555 | 4826 | 0.854825736 | 0 | 17583 | 4854 | 0.852659674 | 0 |
| 17500 | 4771 | 0.859483094 | 0 | 17528 | 4799 | 0.857439351 | 0 | 17556 | 4827 | 0.854711463 | 0 | 17584 | 4855 | 0.852659674 | 0 |
| 17501 | 4772 | 0.859190541 | 0 | 17529 | 4800 | 0.857439351 | 0 | 17557 | 4828 | 0.854711463 | 0 | 17585 | 4856 | 0.852463294 | 0 |
| 17502 | 4773 | 0.859190541 | 0 | 17530 | 4801 | 0.857439351 | -0.609122527 | 17558 | 4829 | 0.854711463 | -0.684549534 | 17586 | 4857 | 0.852463294 | 0 |
| 17503 | 4774 | 0.859190541 | 0 | 17531 | 4802 | 0.857314536 | 0 | 17559 | 4830 | 0.854570344 | 0 | 17587 | 4858 | 0.852463294 | 0 |
| 17504 | 4775 | 0.858904539 | 0 | 17532 | 4803 | 0.857314536 | 0 | 17560 | 4831 | 0.854570344 | 0 | 17588 | 4859 | 0.852463294 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17589 | 4860 | 0.852410438 | 0 | 17617 | 4888 | 0.850026853 | 0 | 17645 | 4916 | 0.847424721 | -1.316172662 | 17673 | 4944 | 0.845116254 | 0 |
| 17590 | 4861 | 0.85231865 | 0 | 17618 | 4889 | 0.849938948 | 0 | 17646 | 4917 | 0.847209244 | 0 | 17674 | 4945 | 0.844991188 | 0 |
| 17591 | 4862 | 0.85231865 | 0 | 17619 | 4890 | 0.849723257 | 0 | 17647 | 4918 | 0.847209244 | 0 | 17675 | 4946 | 0.844991188 | -0.02606431 |
| 17592 | 4863 | 0.85231865 | 0 | 17620 | 4891 | 0.849723257 | 0 | 17648 | 4919 | 0.847209244 | 0 | 17676 | 4947 | 0.844868817 | -0.309585187 |
| 17593 | 4864 | 0.852119842 | 0 | 17621 | 4892 | 0.849430704 | 0 | 17649 | 4920 | 0.847209244 | 0 | 17677 | 4948 | 0.844631821 | 0 |
| 17594 | 4865 | 0.852119842 | 0 | 17622 | 4893 | 0.84924151 | 0 | 17650 | 4921 | 0.847000398 | 0 | 17678 | 4949 | 0.844631821 | 0 |
| 17595 | 4866 | 0.852119842 | -0.4875688 | 17623 | 4894 | 0.84924151 | -1.039654816 | 17651 | 4922 | 0.847000398 | 0 | 17679 | 4950 | 0.844631821 | 0 |
| 17596 | 4867 | 0.851989639 | 0 | 17624 | 4895 | 0.84924151 | -1.340684812 | 17652 | 4923 | 0.846949187 | 0 | 17680 | 4951 | 0.844360302 | 0 |
| 17597 | 4868 | 0.851897754 | 0 | 17625 | 4896 | 0.849011298 | 0 | 17653 | 4924 | 0.846864703 | 0 | 17681 | 4952 | 0.844360302 | 0 |
| 17598 | 4869 | 0.851897754 | 0 | 17626 | 4897 | 0.849011298 | 0 | 17654 | 4925 | 0.84669891 | -1.243112259 | 17682 | 4953 | 0.844294505 | 0 |
| 17599 | 4870 | 0.851829442 | 0 | 17627 | 4898 | 0.848787781 | -1.353727668 | 17655 | 4926 | 0.846601414 | 0 | 17683 | 4954 | 0.844294505 | 0 |
| 17600 | 4871 | 0.851776662 | 0 | 17628 | 4899 | 0.848725108 | 0 | 17656 | 4927 | 0.846601414 | 0 | 17684 | 4955 | 0.844294505 | 0 |
| 17601 | 4872 | 0.851365204 | 0 | 17629 | 4900 | 0.848359694 | 0 | 17657 | 4928 | 0.846601414 | 0 | 17685 | 4956 | 0.844294505 | -1.031636844 |
| 17602 | 4873 | 0.851365204 | 0 | 17630 | 4901 | 0.848359694 | 0 | 17658 | 4929 | 0.846537221 | 0 | 17686 | 4957 | 0.844186619 | -1.212200794 |
| 17603 | 4874 | 0.851365204 | 0 | 17631 | 4902 | 0.848359694 | 0 | 17659 | 4930 | 0.846537221 | 0 | 17687 | 4958 | 0.84397727 | 0 |
| 17604 | 4875 | 0.851365204 | 0 | 17632 | 4903 | 0.848359694 | 0 | 17660 | 4931 | 0.846225564 | 0 | 17688 | 4959 | 0.84397727 | 0 |
| 17605 | 4876 | 0.851365204 | 0 | 17633 | 4904 | 0.848359694 | 0 | 17661 | 4932 | 0.846225564 | 0 | 17689 | 4960 | 0.843776068 | 0 |
| 17606 | 4877 | 0.851365204 | -0.20502221 | 17634 | 4905 | 0.848087494 | 0 | 17662 | 4933 | 0.845870893 | 0 | 17690 | 4961 | 0.843776068 | 0 |
| 17607 | 4878 | 0.851365204 | -0.630990942 | 17635 | 4906 | 0.848011562 | 0 | 17663 | 4934 | 0.845645344 | 0 | 17691 | 4962 | 0.843776068 | 0 |
| 17608 | 4879 | 0.850862839 | 0 | 17636 | 4907 | 0.848011562 | -1.443904299 | 17664 | 4935 | 0.84553566 | 0 | 17692 | 4963 | 0.843776068 | 0 |
| 17609 | 4880 | 0.850781867 | 0 | 17637 | 4908 | 0.847919456 | 0 | 17665 | 4936 | 0.84537484 | 0 | 17693 | 4964 | 0.843396274 | 0 |
| 17610 | 4881 | 0.850669776 | 0 | 17638 | 4909 | 0.847876876 | 0 | 17666 | 4937 | 0.84537484 | 0 | 17694 | 4965 | 0.843396274 | 0 |
| 17611 | 4882 | 0.850504362 | 0 | 17639 | 4910 | 0.847876876 | 0 | 17667 | 4938 | 0.84537484 | 0 | 17695 | 4966 | 0.843396274 | 0 |
| 17612 | 4883 | 0.850388163 | 0 | 17640 | 4911 | 0.847876876 | 0 | 17668 | 4939 | 0.84537484 | 0 | 17696 | 4967 | 0.843242078 | 0 |
| 17613 | 4884 | 0.850388163 | 0 | 17641 | 4912 | 0.847761079 | 0 | 17669 | 4940 | 0.84537484 | -1.290193819 | 17697 | 4968 | 0.84312959 | 0 |
| 17614 | 4885 | 0.850104551 | 0 | 17642 | 4913 | 0.847679514 | 0 | 17670 | 4941 | 0.845116254 | 0 | 17698 | 4969 | 0.84312959 | 0 |
| 17615 | 4886 | 0.850104551 | 0 | 17643 | 4914 | 0.847679514 | 0 | 17671 | 4942 | 0.845116254 | 0 | 17699 | 4970 | 0.843043905 | 0 |
| 17616 | 4887 | 0.850026853 | 0 | 17644 | 4915 | 0.847424721 | 0 | 17672 | 4943 | 0.845116254 | 0 | 17700 | 4971 | 0.843043905 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17701 | 4972 | 0.843043905 | 0 | 17729 | 5000 | 0.841255834 | 0 | 17757 | 5028 | 0.839276704 | 0 | 17785 | 5056 | 0.836865407 | -0.022496841 |
| 17702 | 4973 | 0.843043905 | -1.262561531 | 17730 | 5001 | 0.841255834 | 0 | 17758 | 5029 | 0.839276704 | 0 | 17786 | 5057 | 0.836749672 | 0 |
| 17703 | 4974 | 0.842877094 | 0 | 17731 | 5002 | 0.841255834 | 0 | 17759 | 5030 | 0.839276704 | 0 | 17787 | 5058 | 0.836749672 | 0 |
| 17704 | 4975 | 0.842877094 | 0 | 17732 | 5003 | 0.841146039 | -1.361369411 | 17760 | 5031 | 0.839099332 | 0 | 17788 | 5059 | 0.836641947 | 0 |
| 17705 | 4976 | 0.842779816 | 0 | 17733 | 5004 | 0.841092319 | 0 | 17761 | 5032 | 0.838932777 | -1.036998572 | 17789 | 5060 | 0.836641947 | 0 |
| 17706 | 4977 | 0.842716095 | 0 | 17734 | 5005 | 0.840935676 | 0 | 17762 | 5033 | 0.838879492 | 0 | 17790 | 5061 | 0.836541427 | 0 |
| 17707 | 4978 | 0.842716095 | 0 | 17735 | 5006 | 0.840935676 | 0 | 17763 | 5034 | 0.838776076 | 0 | 17791 | 5062 | 0.836198654 | 0 |
| 17708 | 4979 | 0.842637681 | 0 | 17736 | 5007 | 0.840935676 | 0 | 17764 | 5035 | 0.838357075 | 0 | 17792 | 5063 | 0.836198654 | 0 |
| 17709 | 4980 | 0.842637681 | 0 | 17737 | 5008 | 0.840935676 | 0 | 17765 | 5036 | 0.838357075 | 0 | 17793 | 5064 | 0.836055911 | 0 |
| 17710 | 4981 | 0.842591279 | 0 | 17738 | 5009 | 0.840815021 | 0 | 17766 | 5037 | 0.838232188 | 0 | 17794 | 5065 | 0.836055911 | 0 |
| 17711 | 4982 | 0.842591279 | -0.275603284 | 17739 | 5010 | 0.840736777 | 0 | 17767 | 5038 | 0.838001242 | 0 | 17795 | 5066 | 0.835990342 | 0 |
| 17712 | 4983 | 0.842410361 | 0 | 17740 | 5011 | 0.840736777 | 0 | 17768 | 5039 | 0.838001242 | -1.121476158 | 17796 | 5067 | 0.835928234 | 0 |
| 17713 | 4984 | 0.842410361 | 0 | 17741 | 5012 | 0.840736777 | 0 | 17769 | 5040 | 0.837792397 | 0 | 17797 | 5068 | 0.835869318 | 0 |
| 17714 | 4985 | 0.842410361 | 0 | 17742 | 5013 | 0.840736777 | -1.385912352 | 17770 | 5041 | 0.837792397 | 0 | 17798 | 5069 | 0.83576013 | 0 |
| 17715 | 4986 | 0.842410361 | 0 | 17743 | 5014 | 0.840548431 | 0 | 17771 | 5042 | 0.837792397 | 0 | 17799 | 5070 | 0.835661123 | -0.377073491 |
| 17716 | 4987 | 0.842410361 | -0.147030263 | 17744 | 5015 | 0.840369819 | -1.409142192 | 17772 | 5043 | 0.837695293 | 0 | 17800 | 5071 | 0.83552879 | -1.485676446 |
| 17717 | 4988 | 0.84219424 | 0 | 17745 | 5016 | 0.840200206 | 0 | 17773 | 5044 | 0.837695293 | -0.55113058 | 17801 | 5072 | 0.835449778 | 0 |
| 17718 | 4989 | 0.842124547 | 0 | 17746 | 5017 | 0.840200206 | 0 | 17774 | 5045 | 0.837602624 | 0 | 17802 | 5073 | 0.835278384 | 0 |
| 17719 | 4990 | 0.842069604 | 0 | 17747 | 5018 | 0.840200206 | -0.098087895 | 17775 | 5046 | 0.837429426 | 0 | 17803 | 5074 | 0.833636437 | 0 |
| 17720 | 4991 | 0.841856767 | 0 | 17748 | 5019 | 0.840118564 | 0 | 17776 | 5047 | 0.837429426 | 0 | 17804 | 5075 | 0.833636437 | 0 |
| 17721 | 4992 | 0.841856767 | 0 | 17749 | 5020 | 0.840118564 | 0 | 17777 | 5048 | 0.837429426 | -1.182745815 | 17805 | 5076 | 0.833636437 | 0 |
| 17722 | 4993 | 0.841792441 | -1.450123419 | 17750 | 5021 | 0.840038928 | 0 | 17778 | 5049 | 0.837348378 | -1.493196885 | 17806 | 5077 | 0.833636437 | 0 |
| 17723 | 4994 | 0.841605366 | 0 | 17751 | 5022 | 0.839885386 | 0 | 17779 | 5050 | 0.837270721 | 0 | 17807 | 5078 | 0.833636437 | 0 |
| 17724 | 4995 | 0.841605366 | 0 | 17752 | 5023 | 0.839739036 | 0 | 17780 | 5051 | 0.837270721 | 0 | 17808 | 5079 | 0.833636437 | 0 |
| 17725 | 4996 | 0.841461774 | 0 | 17753 | 5024 | 0.839668402 | 0 | 17781 | 5052 | 0.837124765 | 0 | 17809 | 5080 | 0.833636437 | 0 |
| 17726 | 4997 | 0.841255834 | 0 | 17754 | 5025 | 0.839668402 | -1.281177001 | 17782 | 5053 | 0.836990079 | 0 | 17810 | 5081 | 0.833636437 | 0 |
| 17727 | 4998 | 0.841255834 | 0 | 17755 | 5026 | 0.83946598 | 0 | 17783 | 5054 | 0.836926562 | 0 | 17811 | 5082 | 0.833636437 | 0 |
| 17728 | 4999 | 0.841255834 | 0 | 17756 | 5027 | 0.83946598 | 0 | 17784 | 5055 | 0.836865407 | 0 | 17812 | 5083 | 0.833636437 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17813 | 5084 | 0.833636437 | 0 | 17841 | 5112 | 0.833636437 | 0 | 17869 | 5140 | 0.830308493 | 0 | 17897 | 5168 | 0.828068483 | 0 |
| 17814 | 5085 | 0.833636437 | 0 | 17842 | 5113 | 0.833636437 | 0 | 17870 | 5141 | 0.830308493 | 0 | 17898 | 5169 | 0.828008352 | 0 |
| 17815 | 5086 | 0.833636437 | 0 | 17843 | 5114 | 0.833636437 | -0.790952701 | 17871 | 5142 | 0.830175905 | 0 | 17899 | 5170 | 0.827687104 | 0 |
| 17816 | 5087 | 0.833636437 | 0 | 17844 | 5115 | 0.833636437 | -0.620690985 | 17872 | 5143 | 0.830175905 | 0 | 17900 | 5171 | 0.827618403 | 0 |
| 17817 | 5088 | 0.833636437 | 0 | 17845 | 5116 | 0.832141446 | 0 | 17873 | 5144 | 0.830032313 | -0.907596338 | 17901 | 5172 | 0.827476128 | 0 |
| 17818 | 5089 | 0.833636437 | 0 | 17846 | 5117 | 0.831902724 | 0 | 17874 | 5145 | 0.829706143 | 0 | 17902 | 5173 | 0.827476128 | 0 |
| 17819 | 5090 | 0.833636437 | 0 | 17847 | 5118 | 0.831902724 | 0 | 17875 | 5146 | 0.829519871 | 0 | 17903 | 5174 | 0.827476128 | 0 |
| 17820 | 5091 | 0.833636437 | 0 | 17848 | 5119 | 0.831792296 | 0 | 17876 | 5147 | 0.829519871 | -1.151146829 | 17904 | 5175 | 0.827476128 | 0 |
| 17821 | 5092 | 0.833636437 | 0 | 17849 | 5120 | 0.831710516 | -1.479949403 | 17877 | 5148 | 0.829419952 | 0 | 17905 | 5176 | 0.827476128 | -0.852160576 |
| 17822 | 5093 | 0.833636437 | 0 | 17850 | 5121 | 0.831621146 | 0 | 17878 | 5149 | 0.829419952 | -1.441811309 | 17906 | 5177 | 0.827249638 | 0 |
| 17823 | 5094 | 0.833636437 | 0 | 17851 | 5122 | 0.831523077 | 0 | 17879 | 5150 | 0.829315063 | 0 | 17907 | 5178 | 0.827249638 | 0 |
| 17824 | 5095 | 0.833636437 | 0 | 17852 | 5123 | 0.831470375 | 0 | 17880 | 5151 | 0.829315063 | 0 | 17908 | 5179 | 0.827249638 | 0 |
| 17825 | 5096 | 0.833636437 | 0 | 17853 | 5124 | 0.831470375 | 0 | 17881 | 5152 | 0.829088809 | 0 | 17909 | 5180 | 0.827249638 | 0 |
| 17826 | 5097 | 0.833636437 | 0 | 17854 | 5125 | 0.83135667 | 0 | 17882 | 5153 | 0.828837554 | 0 | 17910 | 5181 | 0.827005858 | 0 |
| 17827 | 5098 | 0.833636437 | 0 | 17855 | 5126 | 0.83135667 | -1.406874331 | 17883 | 5154 | 0.828837554 | 0 | 17911 | 5182 | 0.827005858 | 0 |
| 17828 | 5099 | 0.833636437 | 0 | 17856 | 5127 | 0.831230367 | 0 | 17884 | 5155 | 0.828837554 | -1.385912352 | 17912 | 5183 | 0.827005858 | 0 |
| 17829 | 5100 | 0.833636437 | 0 | 17857 | 5128 | 0.831161818 | 0 | 17885 | 5156 | 0.828701219 | 0 | 17913 | 5184 | 0.826832729 | 0 |
| 17830 | 5101 | 0.833636437 | 0 | 17858 | 5129 | 0.831161818 | 0 | 17886 | 5157 | 0.828701219 | 0 | 17914 | 5185 | 0.826742729 | 0 |
| 17831 | 5102 | 0.833636437 | 0 | 17859 | 5130 | 0.831161818 | 0 | 17887 | 5158 | 0.828701219 | 0 | 17915 | 5186 | 0.826742729 | 0 |
| 17832 | 5103 | 0.833636437 | 0 | 17860 | 5131 | 0.831089248 | 0 | 17888 | 5159 | 0.828556911 | 0 | 17916 | 5187 | 0.826650316 | 0 |
| 17833 | 5104 | 0.833636437 | 0 | 17861 | 5132 | 0.831089248 | 0 | 17889 | 5160 | 0.828556911 | 0 | 17917 | 5188 | 0.826457852 | 0 |
| 17834 | 5105 | 0.833636437 | 0 | 17862 | 5133 | 0.831089248 | 0 | 17890 | 5161 | 0.828455924 | 0 | 17918 | 5189 | 0.826457852 | 0 |
| 17835 | 5106 | 0.833636437 | 0 | 17863 | 5134 | 0.830930543 | 0 | 17891 | 5162 | 0.82840391 | 0 | 17919 | 5190 | 0.826457852 | -0.610140803 |
| 17836 | 5107 | 0.833636437 | 0 | 17864 | 5135 | 0.830750749 | 0 | 17892 | 5163 | 0.828241405 | 0 | 17920 | 5191 | 0.825983473 | 0 |
| 17837 | 5108 | 0.833636437 | 0 | 17865 | 5136 | 0.830750749 | -0.158689875 | 17893 | 5164 | 0.828241405 | 0 | 17921 | 5192 | 0.825811099 | 0 |
| 17838 | 5109 | 0.833636437 | 0 | 17866 | 5137 | 0.830651583 | 0 | 17894 | 5165 | 0.828127342 | 0 | 17922 | 5193 | 0.825811099 | 0 |
| 17839 | 5110 | 0.833636437 | 0 | 17867 | 5138 | 0.83054536 | 0 | 17895 | 5166 | 0.828127342 | 0 | 17923 | 5194 | 0.825568815 | 0 |
| 17840 | 5111 | 0.833636437 | 0 | 17868 | 5139 | 0.830431297 | 0 | 17896 | 5167 | 0.828068483 | 0 | 17924 | 5195 | 0.825568815 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 17925 | 5196 | 0.825568815 | 0 | 17953 | 5224 | 0.822912571 | 0 | 17981 | 5252 | 0.82140198 | 0 | 18009 | 5280 | 0.819395998 | 0 |
| 17926 | 5197 | 0.825441958 | 0 | 17954 | 5225 | 0.822571011 | 0 | 17982 | 5253 | 0.82140198 | 0 | 18010 | 5281 | 0.819395998 | 0 |
| 17927 | 5198 | 0.825441958 | 0 | 17955 | 5226 | 0.822571011 | 0 | 17983 | 5254 | 0.82140198 | 0 | 18011 | 5282 | 0.819395998 | 0 |
| 17928 | 5199 | 0.825441958 | 0 | 17956 | 5227 | 0.822571011 | 0 | 17984 | 5255 | 0.82140198 | -1.381113469 | 18012 | 5283 | 0.819395998 | 0 |
| 17929 | 5200 | 0.825311048 | 0 | 17957 | 5228 | 0.822571011 | 0 | 17985 | 5256 | 0.821107843 | 0 | 18013 | 5284 | 0.819395998 | 0 |
| 17930 | 5201 | 0.825244012 | 0 | 17958 | 5229 | 0.82245227 | 0 | 17986 | 5257 | 0.821047309 | 0 | 18014 | 5285 | 0.818995911 | 0 |
| 17931 | 5202 | 0.825244012 | 0 | 17959 | 5230 | 0.82245227 | 0 | 17987 | 5258 | 0.820955405 | 0 | 18015 | 5286 | 0.818995911 | 0 |
| 17932 | 5203 | 0.825203269 | 0 | 17960 | 5231 | 0.82245227 | 0 | 17988 | 5259 | 0.820799212 | 0 | 18016 | 5287 | 0.818995911 | -1.383519539 |
| 17933 | 5204 | 0.825175887 | 0 | 17961 | 5232 | 0.822355426 | 0 | 17989 | 5260 | 0.820799212 | 0 | 18017 | 5288 | 0.81891318 | 0 |
| 17934 | 5205 | 0.825036265 | 0 | 17962 | 5233 | 0.822355426 | 0 | 17990 | 5261 | 0.82067146 | 0 | 18018 | 5289 | 0.81891318 | 0 |
| 17935 | 5206 | 0.825036265 | 0 | 17963 | 5234 | 0.822206975 | 0 | 17991 | 5262 | 0.820474991 | 0 | 18019 | 5290 | 0.818787316 | 0 |
| 17936 | 5207 | 0.825036265 | 0 | 17964 | 5235 | 0.822206975 | 0 | 17992 | 5263 | 0.82033097 | 0 | 18020 | 5291 | 0.818787316 | 0 |
| 17937 | 5208 | 0.824588308 | 0 | 17965 | 5236 | 0.822206975 | 0 | 17993 | 5264 | 0.820133966 | 0 | 18021 | 5292 | 0.818696087 | 0 |
| 17938 | 5209 | 0.824428435 | -1.281177001 | 17966 | 5237 | 0.822206975 | -0.137270425 | 17994 | 5265 | 0.820133966 | 0 | 18022 | 5293 | 0.818696087 | 0 |
| 17939 | 5210 | 0.824091119 | 0 | 17967 | 5238 | 0.821950678 | 0 | 17995 | 5266 | 0.82003326 | 0 | 18023 | 5294 | 0.818696087 | 0 |
| 17940 | 5211 | 0.824091119 | 0 | 17968 | 5239 | 0.821950678 | 0 | 17996 | 5267 | 0.82003326 | 0 | 18024 | 5295 | 0.81857269 | 0 |
| 17941 | 5212 | 0.824091119 | 0 | 17969 | 5240 | 0.821950678 | 0 | 17997 | 5268 | 0.819956739 | 0 | 18025 | 5296 | 0.81857269 | 0 |
| 17942 | 5213 | 0.824091119 | 0 | 17970 | 5241 | 0.821950678 | 0 | 17998 | 5269 | 0.819956739 | 0 | 18026 | 5297 | 0.818319679 | 0 |
| 17943 | 5214 | 0.824091119 | 0 | 17971 | 5242 | 0.821875326 | 0 | 17999 | 5270 | 0.819848152 | 0 | 18027 | 5298 | 0.818124271 | 0 |
| 17944 | 5215 | 0.824091119 | 0 | 17972 | 5243 | 0.821818171 | 0 | 18000 | 5271 | 0.819848152 | 0 | 18028 | 5299 | 0.818124271 | 0 |
| 17945 | 5216 | 0.823728148 | 0 | 17973 | 5244 | 0.821818171 | 0 | 18001 | 5272 | 0.819848152 | 0 | 18029 | 5300 | 0.818124271 | 0 |
| 17946 | 5217 | 0.823728148 | 0 | 17974 | 5245 | 0.821818171 | 0 | 18002 | 5273 | 0.819848152 | 0 | 18030 | 5301 | 0.818124271 | 0 |
| 17947 | 5218 | 0.823728148 | 0 | 17975 | 5246 | 0.821818171 | 0 | 18003 | 5274 | 0.819774798 | 0 | 18031 | 5302 | 0.817923812 | 0 |
| 17948 | 5219 | 0.823728148 | 0 | 17976 | 5247 | 0.821818171 | 0 | 18004 | 5275 | 0.819774798 | 0 | 18032 | 5303 | 0.817923812 | -0.721337185 |
| 17949 | 5220 | 0.823728148 | -1.249692605 | 17977 | 5248 | 0.821737213 | 0 | 18005 | 5276 | 0.819721922 | 0 | 18033 | 5304 | 0.81784217 | 0 |
| 17950 | 5221 | 0.823233676 | 0 | 17978 | 5249 | 0.821737213 | 0 | 18006 | 5277 | 0.819395998 | 0 | 18034 | 5305 | 0.817648331 | 0 |
| 17951 | 5222 | 0.823233676 | 0 | 17979 | 5250 | 0.821643322 | 0 | 18007 | 5278 | 0.819395998 | 0 | 18035 | 5306 | 0.817648331 | 0 |
| 17952 | 5223 | 0.823233676 | 0 | 17980 | 5251 | 0.82140198 | 0 | 18008 | 5279 | 0.819395998 | 0 | 18036 | 5307 | 0.817648331 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18037 | 5308 | 0.817648331 | -0.11550013 | 18065 | 5336 | 0.815153031 | 0 | 18093 | 5364 | 0.813160851 | 0 | 18121 | 5392 | 0.811360042 | 0 |
| 18038 | 5309 | 0.817506936 | 0 | 18066 | 5337 | 0.814935938 | 0 | 18094 | 5365 | 0.813160851 | 0 | 18122 | 5393 | 0.811360042 | 0 |
| 18039 | 5310 | 0.817506936 | 0 | 18067 | 5338 | 0.814751093 | 0 | 18095 | 5366 | 0.813074278 | 0 | 18123 | 5394 | 0.811360042 | 0 |
| 18040 | 5311 | 0.817399238 | 0 | 18068 | 5339 | 0.814751093 | 0 | 18096 | 5367 | 0.812951838 | 0 | 18124 | 5395 | 0.811360042 | 0 |
| 18041 | 5312 | 0.817246021 | 0 | 18069 | 5340 | 0.814751093 | 0 | 18097 | 5368 | 0.812951838 | -0.344336071 | 18125 | 5396 | 0.811232327 | 0 |
| 18042 | 5313 | 0.817246021 | 0 | 18070 | 5341 | 0.814520146 | 0 | 18098 | 5369 | 0.812869398 | 0 | 18126 | 5397 | 0.811070609 | 0 |
| 18043 | 5314 | 0.817142259 | -1.33266684 | 18071 | 5342 | 0.814331282 | 0 | 18099 | 5370 | 0.812447138 | 0 | 18127 | 5398 | 0.810859222 | 0 |
| 18044 | 5315 | 0.817067335 | 0 | 18072 | 5343 | 0.814331282 | 0 | 18100 | 5371 | 0.812447138 | 0 | 18128 | 5399 | 0.810859222 | 0 |
| 18045 | 5316 | 0.816603097 | 0 | 18073 | 5344 | 0.814040881 | 0 | 18101 | 5372 | 0.812447138 | 0 | 18129 | 5400 | 0.810859222 | -0.058441548 |
| 18046 | 5317 | 0.816603097 | 0 | 18074 | 5345 | 0.814040881 | 0 | 18102 | 5373 | 0.812447138 | 0 | 18130 | 5401 | 0.810383977 | 0 |
| 18047 | 5318 | 0.816603097 | 0 | 18075 | 5346 | 0.813828043 | 0 | 18103 | 5374 | 0.812447138 | 0 | 18131 | 5402 | 0.810313008 | 0 |
| 18048 | 5319 | 0.816603097 | 0 | 18076 | 5347 | 0.813828043 | 0 | 18104 | 5375 | 0.812447138 | 0 | 18132 | 5403 | 0.810313008 | 0 |
| 18049 | 5320 | 0.816603097 | 0 | 18077 | 5348 | 0.813665356 | 0 | 18105 | 5376 | 0.812447138 | 0 | 18133 | 5404 | 0.810313008 | 0 |
| 18050 | 5321 | 0.816603097 | 0 | 18078 | 5349 | 0.813665356 | 0 | 18106 | 5377 | 0.812447138 | 0 | 18134 | 5405 | 0.810252618 | 0 |
| 18051 | 5322 | 0.816603097 | -0.841844307 | 18079 | 5350 | 0.813536961 | 0 | 18107 | 5378 | 0.812447138 | 0 | 18135 | 5406 | 0.81004904 | 0 |
| 18052 | 5323 | 0.816223635 | 0 | 18080 | 5351 | 0.813536961 | 0 | 18108 | 5379 | 0.812447138 | 0 | 18136 | 5407 | 0.81004904 | 0 |
| 18053 | 5324 | 0.81617501 | 0 | 18081 | 5352 | 0.813536961 | -0.947572785 | 18109 | 5380 | 0.812447138 | 0 | 18137 | 5408 | 0.809972519 | 0 |
| 18054 | 5325 | 0.816112092 | 0 | 18082 | 5353 | 0.813536961 | -1.42469404 | 18110 | 5381 | 0.812447138 | 0 | 18138 | 5409 | 0.809972519 | 0 |
| 18055 | 5326 | 0.816027492 | 0 | 18083 | 5354 | 0.813433051 | 0 | 18111 | 5382 | 0.812447138 | 0 | 18139 | 5410 | 0.809869715 | 0 |
| 18056 | 5327 | 0.81590767 | 0 | 18084 | 5355 | 0.81334723 | 0 | 18112 | 5383 | 0.812447138 | 0 | 18140 | 5411 | 0.809869715 | 0 |
| 18057 | 5328 | 0.81590767 | 0 | 18085 | 5356 | 0.813275154 | 0 | 18113 | 5384 | 0.812447138 | 0 | 18141 | 5412 | 0.809869715 | 0 |
| 18058 | 5329 | 0.81590767 | 0 | 18086 | 5357 | 0.813275154 | 0 | 18114 | 5385 | 0.812041823 | 0 | 18142 | 5413 | 0.809869715 | 0 |
| 18059 | 5330 | 0.815724847 | 0 | 18087 | 5358 | 0.813275154 | 0 | 18115 | 5386 | 0.811780531 | 0 | 18143 | 5414 | 0.809869715 | 0 |
| 18060 | 5331 | 0.815591934 | 0 | 18088 | 5359 | 0.813275154 | 0 | 18116 | 5387 | 0.811548907 | 0 | 18144 | 5415 | 0.809502757 | 0 |
| 18061 | 5332 | 0.815538215 | 0 | 18089 | 5360 | 0.813275154 | 0 | 18117 | 5388 | 0.811548907 | 0 | 18145 | 5416 | 0.809502757 | 0 |
| 18062 | 5333 | 0.815411617 | -0.591223815 | 18090 | 5361 | 0.813275154 | 0 | 18118 | 5389 | 0.811548907 | 0 | 18146 | 5417 | 0.809502757 | 0 |
| 18063 | 5334 | 0.815153031 | 0 | 18091 | 5362 | 0.813275154 | 0 | 18119 | 5390 | 0.811548907 | 0 | 18147 | 5418 | 0.809502757 | 0 |
| 18064 | 5335 | 0.815153031 | 0 | 18092 | 5363 | 0.813160851 | 0 | 18120 | 5391 | 0.811360042 | 0 | 18148 | 5419 | 0.809502757 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18149 | 5420 | 0.809502757 | 0 | 18177 | 5448 | 0.807700703 | 0 | 18205 | 5476 | 0.805607713 | 0 | 18233 | 5504 | 0.804429166 | 0 |
| 18150 | 5421 | 0.809502757 | -0.017349078 | 18178 | 5449 | 0.807700703 | 0 | 18206 | 5477 | 0.805607713 | 0 | 18234 | 5505 | 0.804429166 | 0 |
| 18151 | 5422 | 0.809502757 | -0.694042688 | 18179 | 5450 | 0.807700703 | 0 | 18207 | 5478 | 0.805607713 | 0 | 18235 | 5506 | 0.804347061 | -0.010447545 |
| 18152 | 5423 | 0.809241998 | 0 | 18180 | 5451 | 0.807700703 | 0 | 18208 | 5479 | 0.805607713 | 0 | 18236 | 5507 | 0.804252659 | 0 |
| 18153 | 5424 | 0.80919398 | 0 | 18181 | 5452 | 0.807700703 | 0 | 18209 | 5480 | 0.805607713 | 0 | 18237 | 5508 | 0.804252659 | -1.155224741 |
| 18154 | 5425 | 0.80919398 | 0 | 18182 | 5453 | 0.807700703 | 0 | 18210 | 5481 | 0.805607713 | 0 | 18238 | 5509 | 0.804102358 | 0 |
| 18155 | 5426 | 0.80919398 | 0 | 18183 | 5454 | 0.807483718 | 0 | 18211 | 5482 | 0.805607713 | 0 | 18239 | 5510 | 0.80401397 | 0 |
| 18156 | 5427 | 0.809124287 | 0 | 18184 | 5455 | 0.807483718 | 0 | 18212 | 5483 | 0.805607713 | 0 | 18240 | 5511 | 0.80401397 | 0 |
| 18157 | 5428 | 0.809124287 | 0 | 18185 | 5456 | 0.807421054 | 0 | 18213 | 5484 | 0.805607713 | 0 | 18241 | 5512 | 0.80401397 | 0 |
| 18158 | 5429 | 0.809124287 | 0 | 18186 | 5457 | 0.807421054 | -1.203208869 | 18214 | 5485 | 0.805607713 | 0 | 18242 | 5513 | 0.803860047 | 0 |
| 18159 | 5430 | 0.809124287 | 0 | 18187 | 5458 | 0.807307498 | 0 | 18215 | 5486 | 0.805607713 | 0 | 18243 | 5514 | 0.803860047 | 0 |
| 18160 | 5431 | 0.809013962 | 0 | 18188 | 5459 | 0.807307498 | 0 | 18216 | 5487 | 0.805607713 | -1.371353631 | 18244 | 5515 | 0.803860047 | 0 |
| 18161 | 5432 | 0.808930564 | -0.985179443 | 18189 | 5460 | 0.807207326 | 0 | 18217 | 5488 | 0.804946183 | 0 | 18245 | 5516 | 0.803673213 | 0 |
| 18162 | 5433 | 0.808812853 | 0 | 18190 | 5461 | 0.807207326 | 0 | 18218 | 5489 | 0.804832879 | 0 | 18246 | 5517 | 0.803673213 | 0 |
| 18163 | 5434 | 0.808812853 | 0 | 18191 | 5462 | 0.807161541 | 0 | 18219 | 5490 | 0.804832879 | 0 | 18247 | 5518 | 0.803673213 | 0 |
| 18164 | 5435 | 0.808733754 | 0 | 18192 | 5463 | 0.807161541 | 0 | 18220 | 5491 | 0.804832879 | -0.61953132 | 18248 | 5519 | 0.803524762 | 0 |
| 18165 | 5436 | 0.808703197 | 0 | 18193 | 5464 | 0.807038668 | 0 | 18221 | 5492 | 0.804760309 | 0 | 18249 | 5520 | 0.803388523 | 0 |
| 18166 | 5437 | 0.808634168 | 0 | 18194 | 5465 | 0.80684326 | 0 | 18222 | 5493 | 0.804760309 | 0 | 18250 | 5521 | 0.803351633 | 0 |
| 18167 | 5438 | 0.808552094 | 0 | 18195 | 5466 | 0.80684326 | 0 | 18223 | 5494 | 0.804760309 | 0 | 18251 | 5522 | 0.803351633 | 0 |
| 18168 | 5439 | 0.808504952 | 0 | 18196 | 5467 | 0.806578204 | 0 | 18224 | 5495 | 0.804760309 | 0 | 18252 | 5523 | 0.803351633 | 0 |
| 18169 | 5440 | 0.808504952 | 0 | 18197 | 5468 | 0.806578204 | 0 | 18225 | 5496 | 0.804672741 | 0 | 18253 | 5524 | 0.803147115 | 0 |
| 18170 | 5441 | 0.808330572 | 0 | 18198 | 5469 | 0.806484191 | 0 | 18226 | 5497 | 0.804672741 | 0 | 18254 | 5525 | 0.80290182 | 0 |
| 18171 | 5442 | 0.80814005 | 0 | 18199 | 5470 | 0.806341939 | 0 | 18227 | 5498 | 0.804672741 | 0 | 18255 | 5526 | 0.80290182 | 0 |
| 18172 | 5443 | 0.807974446 | 0 | 18200 | 5471 | 0.806286829 | 0 | 18228 | 5499 | 0.804672741 | 0 | 18256 | 5527 | 0.802846773 | 0 |
| 18173 | 5444 | 0.807974446 | 0 | 18201 | 5472 | 0.806286829 | 0 | 18229 | 5500 | 0.804564989 | 0 | 18257 | 5528 | 0.80275987 | 0 |
| 18174 | 5445 | 0.807974446 | 0 | 18202 | 5473 | 0.805607713 | 0 | 18230 | 5501 | 0.804564989 | -1.268855764 | 18258 | 5529 | 0.80275987 | 0 |
| 18175 | 5446 | 0.807974446 | 0 | 18203 | 5474 | 0.805607713 | 0 | 18231 | 5502 | 0.80450123 | 0 | 18259 | 5530 | 0.80275987 | 0 |
| 18176 | 5447 | 0.807974446 | 0 | 18204 | 5475 | 0.805607713 | 0 | 18232 | 5503 | 0.80450123 | 0 | 18260 | 5531 | 0.802602203 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18261 | 5532 | 0.802602203 | 0 | 18289 | 5560 | 0.801107212 | 0 | 18317 | 5588 | 0.798522817 | 0 | 18345 | 5616 | 0.796652871 | 0 |
| 18262 | 5533 | 0.802462917 | 0 | 18290 | 5561 | 0.800912592 | 0 | 18318 | 5589 | 0.798360676 | 0 | 18346 | 5617 | 0.796652871 | -1.117067039 |
| 18263 | 5534 | 0.802227973 | 0 | 18291 | 5562 | 0.800787525 | 0 | 18319 | 5590 | 0.798360676 | 0 | 18347 | 5618 | 0.796464334 | 0 |
| 18264 | 5535 | 0.802227973 | 0 | 18292 | 5563 | 0.800700379 | 0 | 18320 | 5591 | 0.79826735 | 0 | 18348 | 5619 | 0.796419692 | 0 |
| 18265 | 5536 | 0.802227973 | -1.236430674 | 18293 | 5564 | 0.800700379 | -0.531162926 | 18321 | 5592 | 0.797920885 | 0 | 18349 | 5620 | 0.796209939 | 0 |
| 18266 | 5537 | 0.802003589 | 0 | 18294 | 5565 | 0.800212681 | 0 | 18322 | 5593 | 0.797920885 | 0 | 18350 | 5621 | 0.796209939 | 0 |
| 18267 | 5538 | 0.801955089 | 0 | 18295 | 5566 | 0.800212681 | 0 | 18323 | 5594 | 0.797920885 | 0 | 18351 | 5622 | 0.796209939 | -1.464297457 |
| 18268 | 5539 | 0.801879841 | 0 | 18296 | 5567 | 0.800212681 | 0 | 18324 | 5595 | 0.797920885 | 0 | 18352 | 5623 | 0.79608143 | 0 |
| 18269 | 5540 | 0.801879841 | 0 | 18297 | 5568 | 0.800212681 | 0 | 18325 | 5596 | 0.797920885 | 0 | 18353 | 5624 | 0.795984468 | 0 |
| 18270 | 5541 | 0.801879841 | 0 | 18298 | 5569 | 0.800212681 | 0 | 18326 | 5597 | 0.797920885 | 0 | 18354 | 5625 | 0.795847876 | 0 |
| 18271 | 5542 | 0.801747292 | 0 | 18299 | 5570 | 0.800212681 | 0 | 18327 | 5598 | 0.797661217 | 0 | 18355 | 5626 | 0.795847876 | 0 |
| 18272 | 5543 | 0.801747292 | 0 | 18300 | 5571 | 0.800212681 | 0 | 18328 | 5599 | 0.797612108 | 0 | 18356 | 5627 | 0.795847876 | 0 |
| 18273 | 5544 | 0.801634268 | 0 | 18301 | 5572 | 0.800212681 | 0 | 18329 | 5600 | 0.797612108 | 0 | 18357 | 5628 | 0.795847876 | 0 |
| 18274 | 5545 | 0.801451753 | 0 | 18302 | 5573 | 0.800212681 | 0 | 18330 | 5601 | 0.797540091 | 0 | 18358 | 5629 | 0.795847876 | 0 |
| 18275 | 5546 | 0.801451753 | 0 | 18303 | 5574 | 0.799829874 | 0 | 18331 | 5602 | 0.797424264 | 0 | 18359 | 5630 | 0.795847876 | -1.381113469 |
| 18276 | 5547 | 0.801451753 | 0 | 18304 | 5575 | 0.799829874 | 0 | 18332 | 5603 | 0.797335187 | 0 | 18360 | 5631 | 0.795641118 | 0 |
| 18277 | 5548 | 0.801451753 | 0 | 18305 | 5576 | 0.799710316 | -1.363887067 | 18333 | 5604 | 0.797335187 | 0 | 18361 | 5632 | 0.795546387 | 0 |
| 18278 | 5549 | 0.801451753 | 0 | 18306 | 5577 | 0.799482161 | 0 | 18334 | 5605 | 0.797119603 | 0 | 18362 | 5633 | 0.795546387 | 0 |
| 18279 | 5550 | 0.801451753 | 0 | 18307 | 5578 | 0.799267535 | 0 | 18335 | 5606 | 0.797085435 | 0 | 18363 | 5634 | 0.795456796 | 0 |
| 18280 | 5551 | 0.801451753 | -0.169306657 | 18308 | 5579 | 0.799267535 | 0 | 18336 | 5607 | 0.797007541 | -1.259379872 | 18364 | 5635 | 0.795291445 | 0 |
| 18281 | 5552 | 0.801310772 | 0 | 18309 | 5580 | 0.799267535 | 0 | 18337 | 5608 | 0.79691363 | 0 | 18365 | 5636 | 0.795073042 | 0 |
| 18282 | 5553 | 0.801251664 | 0 | 18310 | 5581 | 0.799267535 | 0 | 18338 | 5609 | 0.79691363 | 0 | 18366 | 5637 | 0.794883848 | 0 |
| 18283 | 5554 | 0.801251664 | 0 | 18311 | 5582 | 0.799104787 | 0 | 18339 | 5610 | 0.79691363 | 0 | 18367 | 5638 | 0.794883848 | 0 |
| 18284 | 5555 | 0.801251664 | 0 | 18312 | 5583 | 0.799104787 | 0 | 18340 | 5611 | 0.796859039 | 0 | 18368 | 5639 | 0.794718371 | 0 |
| 18285 | 5556 | 0.801251664 | 0 | 18313 | 5584 | 0.799104787 | 0 | 18341 | 5612 | 0.796823349 | 0 | 18369 | 5640 | 0.794718371 | 0 |
| 18286 | 5557 | 0.801174042 | 0 | 18314 | 5585 | 0.798874331 | 0 | 18342 | 5613 | 0.796652871 | 0 | 18370 | 5641 | 0.794572414 | 0 |
| 18287 | 5558 | 0.801107212 | 0 | 18315 | 5586 | 0.798874331 | 0 | 18343 | 5614 | 0.796652871 | 0 | 18371 | 5642 | 0.794484313 | 0 |
| 18288 | 5559 | 0.801107212 | 0 | 18316 | 5587 | 0.798522817 | 0 | 18344 | 5615 | 0.796652871 | 0 | 18372 | 5643 | 0.794442716 | -1.42030719 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18373 | 5644 | 0.794326703 | 0 | 18401 | 5672 | 0.792243752 | 0 | 18429 | 5700 | 0.790884456 | 0 | 18457 | 5728 | 0.788824092 | 0 |
| 18374 | 5645 | 0.794222318 | -1.466285079 | 18402 | 5673 | 0.792243752 | 0 | 18430 | 5701 | 0.790884456 | 0 | 18458 | 5729 | 0.788824092 | 0 |
| 18375 | 5646 | 0.794127896 | 0 | 18403 | 5674 | 0.792243752 | 0 | 18431 | 5702 | 0.790783937 | 0 | 18459 | 5730 | 0.788669291 | 0 |
| 18376 | 5647 | 0.794127896 | 0 | 18404 | 5675 | 0.792243752 | 0 | 18432 | 5703 | 0.790783937 | 0 | 18460 | 5731 | 0.788669291 | 0 |
| 18377 | 5648 | 0.793963732 | 0 | 18405 | 5676 | 0.792243752 | 0 | 18433 | 5704 | 0.790783937 | 0 | 18461 | 5732 | 0.788669291 | 0 |
| 18378 | 5649 | 0.793825883 | 0 | 18406 | 5677 | 0.792243752 | 0 | 18434 | 5705 | 0.790601805 | 0 | 18462 | 5733 | 0.788669291 | 0 |
| 18379 | 5650 | 0.79370849 | 0 | 18407 | 5678 | 0.792243752 | 0 | 18435 | 5706 | 0.790530556 | 0 | 18463 | 5734 | 0.788669291 | 0 |
| 18380 | 5651 | 0.79370849 | -1.296102679 | 18408 | 5679 | 0.792243752 | 0 | 18436 | 5707 | 0.790530556 | 0 | 18464 | 5735 | 0.788669291 | 0 |
| 18381 | 5652 | 0.793519214 | -1.356289885 | 18409 | 5680 | 0.792243752 | 0 | 18437 | 5708 | 0.790530556 | 0 | 18465 | 5736 | 0.788669291 | -0.610140803 |
| 18382 | 5653 | 0.793441806 | -1.082489543 | 18410 | 5681 | 0.792243752 | 0 | 18438 | 5709 | 0.790452844 | 0 | 18466 | 5737 | 0.788439688 | 0 |
| 18383 | 5654 | 0.793373257 | 0 | 18411 | 5682 | 0.792243752 | 0 | 18439 | 5710 | 0.790367747 | 0 | 18467 | 5738 | 0.788439688 | 0 |
| 18384 | 5655 | 0.793373257 | 0 | 18412 | 5683 | 0.792243752 | 0 | 18440 | 5711 | 0.790055865 | 0 | 18468 | 5739 | 0.788439688 | -0.060339415 |
| 18385 | 5656 | 0.793373257 | 0 | 18413 | 5684 | 0.792243752 | 0 | 18441 | 5712 | 0.789927509 | 0 | 18469 | 5740 | 0.788313458 | 0 |
| 18386 | 5657 | 0.793373257 | -1.108112197 | 18414 | 5685 | 0.792243752 | 0 | 18442 | 5713 | 0.789783153 | 0 | 18470 | 5741 | 0.788313458 | -0.129771257 |
| 18387 | 5658 | 0.793312127 | 0 | 18415 | 5686 | 0.792243752 | 0 | 18443 | 5714 | 0.789783153 | 0 | 18471 | 5742 | 0.788178563 | 0 |
| 18388 | 5659 | 0.79320778 | 0 | 18416 | 5687 | 0.792243752 | 0 | 18444 | 5715 | 0.789619608 | 0 | 18472 | 5743 | 0.788178563 | 0 |
| 18389 | 5660 | 0.79320778 | 0 | 18417 | 5688 | 0.792243752 | 0 | 18445 | 5716 | 0.789619608 | 0 | 18473 | 5744 | 0.788107582 | 0 |
| 18390 | 5661 | 0.792913443 | 0 | 18418 | 5689 | 0.792243752 | 0 | 18446 | 5717 | 0.789432774 | 0 | 18474 | 5745 | 0.787878946 | 0 |
| 18391 | 5662 | 0.792243752 | 0 | 18419 | 5690 | 0.792243752 | 0 | 18447 | 5718 | 0.789432774 | 0 | 18475 | 5746 | 0.787878946 | 0 |
| 18392 | 5663 | 0.792243752 | 0 | 18420 | 5691 | 0.792243752 | -1.422506154 | 18448 | 5719 | 0.789217297 | 0 | 18476 | 5747 | 0.787878946 | 0 |
| 18393 | 5664 | 0.792243752 | 0 | 18421 | 5692 | 0.791281859 | 0 | 18449 | 5720 | 0.789054304 | 0 | 18477 | 5748 | 0.787623554 | 0 |
| 18394 | 5665 | 0.792243752 | 0 | 18422 | 5693 | 0.791281859 | 0 | 18450 | 5721 | 0.788966042 | 0 | 18478 | 5749 | 0.787623554 | 0 |
| 18395 | 5666 | 0.792243752 | 0 | 18423 | 5694 | 0.791177998 | 0 | 18451 | 5722 | 0.788966042 | 0 | 18479 | 5750 | 0.78753165 | 0 |
| 18396 | 5667 | 0.792243752 | 0 | 18424 | 5695 | 0.791048993 | 0 | 18452 | 5723 | 0.788966042 | 0 | 18480 | 5751 | 0.78753165 | 0 |
| 18397 | 5668 | 0.792243752 | 0 | 18425 | 5696 | 0.791048993 | 0 | 18453 | 5724 | 0.788966042 | 0 | 18481 | 5752 | 0.78753165 | 0 |
| 18398 | 5669 | 0.792243752 | 0 | 18426 | 5697 | 0.791048993 | 0 | 18454 | 5725 | 0.788872756 | 0 | 18482 | 5753 | 0.787336417 | 0 |
| 18399 | 5670 | 0.792243752 | 0 | 18427 | 5698 | 0.791048993 | -1.385912352 | 18455 | 5726 | 0.788872756 | 0 | 18483 | 5754 | 0.787336417 | 0 |
| 18400 | 5671 | 0.792243752 | 0 | 18428 | 5699 | 0.790972025 | 0 | 18456 | 5727 | 0.788872756 | 0 | 18484 | 5755 | 0.787336417 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18485 | 5756 | 0.787336417 | 0 | 18513 | 5784 | 0.785554816 | -1.485676446 | 18541 | 5812 | 0.784010434 | 0 | 18569 | 5840 | 0.782483914 | 0 |
| 18486 | 5757 | 0.787211314 | 0 | 18514 | 5785 | 0.785489424 | 0 | 18542 | 5813 | 0.783948653 | 0 | 18570 | 5841 | 0.782483914 | -0.478023482 |
| 18487 | 5758 | 0.786893033 | 0 | 18515 | 5786 | 0.785489424 | 0 | 18543 | 5814 | 0.783948653 | 0 | 18571 | 5842 | 0.782483914 | -1.080083473 |
| 18488 | 5759 | 0.786893033 | 0 | 18516 | 5787 | 0.785489424 | 0 | 18544 | 5815 | 0.78386482 | 0 | 18572 | 5843 | 0.782259531 | 0 |
| 18489 | 5760 | 0.786639874 | 0 | 18517 | 5788 | 0.785331757 | 0 | 18545 | 5816 | 0.78386482 | 0 | 18573 | 5844 | 0.782208259 | 0 |
| 18490 | 5761 | 0.786639874 | 0 | 18518 | 5789 | 0.785331757 | 0 | 18546 | 5817 | 0.78386482 | -1.321740616 | 18574 | 5845 | 0.782208259 | 0 |
| 18491 | 5762 | 0.786639874 | 0 | 18519 | 5790 | 0.785124011 | 0 | 18547 | 5818 | 0.783810584 | 0 | 18575 | 5846 | 0.782064509 | -1.539140728 |
| 18492 | 5763 | 0.786639874 | 0 | 18520 | 5791 | 0.785051958 | 0 | 18548 | 5819 | 0.783744567 | 0 | 18576 | 5847 | 0.781976264 | 0 |
| 18493 | 5764 | 0.786639874 | 0 | 18521 | 5792 | 0.785051958 | 0 | 18549 | 5820 | 0.783744567 | 0 | 18577 | 5848 | 0.781976264 | 0 |
| 18494 | 5765 | 0.786639874 | 0 | 18522 | 5793 | 0.784993258 | 0 | 18550 | 5821 | 0.783744567 | 0 | 18578 | 5849 | 0.781840991 | 0 |
| 18495 | 5766 | 0.786639874 | 0 | 18523 | 5794 | 0.784993258 | 0 | 18551 | 5822 | 0.783744567 | 0 | 18579 | 5850 | 0.781840991 | 0 |
| 18496 | 5767 | 0.786302558 | 0 | 18524 | 5795 | 0.784993258 | -1.304817911 | 18552 | 5823 | 0.783662462 | 0 | 18580 | 5851 | 0.781778318 | 0 |
| 18497 | 5768 | 0.786302558 | 0 | 18525 | 5796 | 0.784903388 | 0 | 18553 | 5824 | 0.783557572 | 0 | 18581 | 5852 | 0.781778318 | 0 |
| 18498 | 5769 | 0.786302558 | 0 | 18526 | 5797 | 0.784903388 | -1.077663999 | 18554 | 5825 | 0.783557572 | 0 | 18582 | 5853 | 0.781607437 | 0 |
| 18499 | 5770 | 0.786211787 | 0 | 18527 | 5798 | 0.784903388 | -1.378693995 | 18555 | 5826 | 0.783226933 | 0 | 18583 | 5854 | 0.781607437 | 0 |
| 18500 | 5771 | 0.786211787 | 0 | 18528 | 5799 | 0.78483782 | 0 | 18556 | 5827 | 0.783226933 | 0 | 18584 | 5855 | 0.781607437 | 0 |
| 18501 | 5772 | 0.786054177 | 0 | 18529 | 5800 | 0.784787869 | 0 | 18557 | 5828 | 0.783100372 | 0 | 18585 | 5856 | 0.781607437 | 0 |
| 18502 | 5773 | 0.785922032 | 0 | 18530 | 5801 | 0.784787869 | 0 | 18558 | 5829 | 0.783051991 | 0 | 18586 | 5857 | 0.781607437 | 0 |
| 18503 | 5774 | 0.785922032 | -0.187795808 | 18531 | 5802 | 0.784716796 | -1.589733953 | 18559 | 5830 | 0.782943729 | 0 | 18587 | 5858 | 0.781412904 | 0 |
| 18504 | 5775 | 0.785863655 | 0 | 18532 | 5803 | 0.784418414 | 0 | 18560 | 5831 | 0.782943729 | 0 | 18588 | 5859 | 0.781327337 | 0 |
| 18505 | 5776 | 0.785712884 | 0 | 18533 | 5804 | 0.784418414 | 0 | 18561 | 5832 | 0.782943729 | 0 | 18589 | 5860 | 0.781327337 | -0.371970089 |
| 18506 | 5777 | 0.785712884 | 0 | 18534 | 5805 | 0.784418414 | 0 | 18562 | 5833 | 0.782943729 | 0 | 18590 | 5861 | 0.781107386 | 0 |
| 18507 | 5778 | 0.785712884 | 0 | 18535 | 5806 | 0.784418414 | 0 | 18563 | 5834 | 0.782870126 | 0 | 18591 | 5862 | 0.781107386 | 0 |
| 18508 | 5779 | 0.785712884 | 0 | 18536 | 5807 | 0.784418414 | 0 | 18564 | 5835 | 0.782816835 | 0 | 18592 | 5863 | 0.780985238 | 0 |
| 18509 | 5780 | 0.785712884 | 0 | 18537 | 5808 | 0.784418414 | 0 | 18565 | 5836 | 0.78274483 | 0 | 18593 | 5864 | 0.780930086 | 0 |
| 18510 | 5781 | 0.785712884 | 0 | 18538 | 5809 | 0.784010434 | 0 | 18566 | 5837 | 0.78274483 | 0 | 18594 | 5865 | 0.780930086 | 0 |
| 18511 | 5782 | 0.785712884 | 0 | 18539 | 5810 | 0.784010434 | 0 | 18567 | 5838 | 0.78274483 | 0 | 18595 | 5866 | 0.780784129 | 0 |
| 18512 | 5783 | 0.785554816 | 0 | 18540 | 5811 | 0.784010434 | 0 | 18568 | 5839 | 0.782483914 | 0 | 18596 | 5867 | 0.780784129 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18597 | 5868 | 0.780700362 | 0 | 18625 | 5896 | 0.779278774 | 0 | 18653 | 5924 | 0.777685031 | -1.084882356 | 18681 | 5952 | 0.77564449 | 0 |
| 18598 | 5869 | 0.780661879 | 0 | 18626 | 5897 | 0.779278774 | 0 | 18654 | 5925 | 0.777520495 | 0 | 18682 | 5953 | 0.77564449 | 0 |
| 18599 | 5870 | 0.780557993 | 0 | 18627 | 5898 | 0.779278774 | -0.754229894 | 18655 | 5926 | 0.777457831 | 0 | 18683 | 5954 | 0.77564449 | 0 |
| 18600 | 5871 | 0.780557993 | 0 | 18628 | 5899 | 0.77868507 | 0 | 18656 | 5927 | 0.777457831 | 0 | 18684 | 5955 | 0.77564449 | 0 |
| 18601 | 5872 | 0.780557993 | 0 | 18629 | 5900 | 0.778640575 | 0 | 18657 | 5928 | 0.777318074 | 0 | 18685 | 5956 | 0.77564449 | 0 |
| 18602 | 5873 | 0.780557993 | -1.002828148 | 18630 | 5901 | 0.778640575 | 0 | 18658 | 5929 | 0.777318074 | 0 | 18686 | 5957 | 0.77564449 | 0 |
| 18603 | 5874 | 0.780390925 | 0 | 18631 | 5902 | 0.778528049 | 0 | 18659 | 5930 | 0.777318074 | 0 | 18687 | 5958 | 0.77564449 | 0 |
| 18604 | 5875 | 0.780160591 | 0 | 18632 | 5903 | 0.778528049 | -0.235307014 | 18660 | 5931 | 0.777318074 | 0 | 18688 | 5959 | 0.77564449 | 0 |
| 18605 | 5876 | 0.780160591 | 0 | 18633 | 5904 | 0.778455467 | 0 | 18661 | 5932 | 0.777155081 | 0 | 18689 | 5960 | 0.77564449 | 0 |
| 18606 | 5877 | 0.780077845 | 0 | 18634 | 5905 | 0.778455467 | 0 | 18662 | 5933 | 0.777155081 | 0 | 18690 | 5961 | 0.77564449 | 0 |
| 18607 | 5878 | 0.780077845 | 0 | 18635 | 5906 | 0.778455467 | 0 | 18663 | 5934 | 0.777062981 | 0 | 18691 | 5962 | 0.77564449 | 0 |
| 18608 | 5879 | 0.780077845 | 0 | 18636 | 5907 | 0.778455467 | 0 | 18664 | 5935 | 0.777062981 | 0 | 18692 | 5963 | 0.77564449 | -1.125840964 |
| 18609 | 5880 | 0.780077845 | 0 | 18637 | 5908 | 0.778455467 | 0 | 18665 | 5936 | 0.777062981 | 0 | 18693 | 5964 | 0.77564449 | -1.329960946 |
| 18610 | 5881 | 0.780077845 | -0.781459547 | 18638 | 5909 | 0.778455467 | 0 | 18666 | 5937 | 0.776731585 | 0 | 18694 | 5965 | 0.77564449 | -1.572998995 |
| 18611 | 5882 | 0.780009295 | 0 | 18639 | 5910 | 0.778455467 | 0 | 18667 | 5938 | 0.776731585 | 0 | 18695 | 5966 | 0.77564449 | -1.125840964 |
| 18612 | 5883 | 0.779278774 | 0 | 18640 | 5911 | 0.778367348 | 0 | 18668 | 5939 | 0.776731585 | 0 | 18696 | 5967 | 0.775210412 | 0 |
| 18613 | 5884 | 0.779278774 | 0 | 18641 | 5912 | 0.778367348 | 0 | 18669 | 5940 | 0.776731585 | 0 | 18697 | 5968 | 0.775210412 | 0 |
| 18614 | 5885 | 0.779278774 | 0 | 18642 | 5913 | 0.778258105 | 0 | 18670 | 5941 | 0.776283628 | 0 | 18698 | 5969 | 0.775210412 | 0 |
| 18615 | 5886 | 0.779278774 | 0 | 18643 | 5914 | 0.778119109 | 0 | 18671 | 5942 | 0.776283628 | 0 | 18699 | 5970 | 0.775210412 | 0 |
| 18616 | 5887 | 0.779278774 | 0 | 18644 | 5915 | 0.778034377 | 0 | 18672 | 5943 | 0.776097116 | 0 | 18700 | 5971 | 0.775210412 | 0 |
| 18617 | 5888 | 0.779278774 | 0 | 18645 | 5916 | 0.777936287 | 0 | 18673 | 5944 | 0.776097116 | 0 | 18701 | 5972 | 0.775041722 | 0 |
| 18618 | 5889 | 0.779278774 | 0 | 18646 | 5917 | 0.777936287 | 0 | 18674 | 5945 | 0.776097116 | 0 | 18702 | 5973 | 0.775041722 | 0 |
| 18619 | 5890 | 0.779278774 | 0 | 18647 | 5918 | 0.777936287 | -0.284203456 | 18675 | 5946 | 0.776097116 | 0 | 18703 | 5974 | 0.775041722 | 0 |
| 18620 | 5891 | 0.779278774 | 0 | 18648 | 5919 | 0.777821409 | 0 | 18676 | 5947 | 0.776097116 | 0 | 18704 | 5975 | 0.775041722 | 0 |
| 18621 | 5892 | 0.779278774 | 0 | 18649 | 5920 | 0.777778619 | 0 | 18677 | 5948 | 0.776097116 | -1.262561531 | 18705 | 5976 | 0.774896351 | 0 |
| 18622 | 5893 | 0.779278774 | 0 | 18650 | 5921 | 0.777685031 | 0 | 18678 | 5949 | 0.775994869 | 0 | 18706 | 5977 | 0.77483095 | 0 |
| 18623 | 5894 | 0.779278774 | 0 | 18651 | 5922 | 0.777685031 | 0 | 18679 | 5950 | 0.775930304 | 0 | 18707 | 5978 | 0.774658577 | 0 |
| 18624 | 5895 | 0.779278774 | 0 | 18652 | 5923 | 0.777685031 | 0 | 18680 | 5951 | 0.775930304 | -1.462300698 | 18708 | 5979 | 0.774658577 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18709 | 5980 | 0.774658577 | 0 | 18737 | 6008 | 0.772938596 | 0 | 18765 | 6036 | 0.770845607 | 0 | 18793 | 6064 | 0.768813341 | 0 |
| 18710 | 5981 | 0.774472304 | 0 | 18738 | 6009 | 0.772938596 | 0 | 18766 | 6037 | 0.770845607 | 0 | 18794 | 6065 | 0.768762656 | 0 |
| 18711 | 5982 | 0.774393521 | 0 | 18739 | 6010 | 0.772553413 | 0 | 18767 | 6038 | 0.770845607 | 0 | 18795 | 6066 | 0.768762656 | -0.031013902 |
| 18712 | 5983 | 0.774393521 | -1.299027232 | 18740 | 6011 | 0.77236678 | 0 | 18768 | 6039 | 0.770584691 | 0 | 18796 | 6067 | 0.76869563 | 0 |
| 18713 | 5984 | 0.774199249 | 0 | 18741 | 6012 | 0.77236678 | 0 | 18769 | 6040 | 0.770482636 | 0 | 18797 | 6068 | 0.76869563 | 0 |
| 18714 | 5985 | 0.774199249 | 0 | 18742 | 6013 | 0.77236678 | -1.404594565 | 18770 | 6041 | 0.770394392 | 0 | 18798 | 6069 | 0.768602842 | 0 |
| 18715 | 5986 | 0.774199249 | 0 | 18743 | 6014 | 0.77236678 | -1.404594565 | 18771 | 6042 | 0.770394392 | 0 | 18799 | 6070 | 0.768602842 | 0 |
| 18716 | 5987 | 0.774199249 | 0 | 18744 | 6015 | 0.772287968 | 0 | 18772 | 6043 | 0.770394392 | 0 | 18800 | 6071 | 0.768602842 | 0 |
| 18717 | 5988 | 0.774199249 | 0 | 18745 | 6016 | 0.772183958 | 0 | 18773 | 6044 | 0.770249458 | 0 | 18801 | 6072 | 0.768602842 | 0 |
| 18718 | 5989 | 0.774199249 | 0 | 18746 | 6017 | 0.772183958 | 0 | 18774 | 6045 | 0.770249458 | 0 | 18802 | 6073 | 0.768465905 | -1.51323079 |
| 18719 | 5990 | 0.774050747 | 0 | 18747 | 6018 | 0.772183958 | 0 | 18775 | 6046 | 0.770249458 | 0 | 18803 | 6074 | 0.768243475 | 0 |
| 18720 | 5991 | 0.773933544 | 0 | 18748 | 6019 | 0.772040366 | 0 | 18776 | 6047 | 0.770087014 | 0 | 18804 | 6075 | 0.768243475 | 0 |
| 18721 | 5992 | 0.773760346 | 0 | 18749 | 6020 | 0.772040366 | 0 | 18777 | 6048 | 0.770087014 | 0 | 18805 | 6076 | 0.768070553 | 0 |
| 18722 | 5993 | 0.773760346 | -1.246414895 | 18750 | 6021 | 0.771945923 | 0 | 18778 | 6049 | 0.770087014 | 0 | 18806 | 6077 | 0.768070553 | -0.622770612 |
| 18723 | 5994 | 0.773638507 | 0 | 18751 | 6022 | 0.771829287 | 0 | 18779 | 6050 | 0.770087014 | -1.406874331 | 18807 | 6078 | 0.767997764 | 0 |
| 18724 | 5995 | 0.773638507 | 0 | 18752 | 6023 | 0.771681593 | 0 | 18780 | 6051 | 0.76987555 | 0 | 18808 | 6079 | 0.767997764 | 0 |
| 18725 | 5996 | 0.773638507 | 0 | 18753 | 6024 | 0.77148853 | 0 | 18781 | 6052 | 0.76987555 | 0 | 18809 | 6080 | 0.767819152 | 0 |
| 18726 | 5997 | 0.773548133 | 0 | 18754 | 6025 | 0.77148853 | 0 | 18782 | 6053 | 0.769802883 | 0 | 18810 | 6081 | 0.767819152 | 0 |
| 18727 | 5998 | 0.773478428 | 0 | 18755 | 6026 | 0.771323116 | 0 | 18783 | 6054 | 0.769802883 | 0 | 18811 | 6082 | 0.767819152 | 0 |
| 18728 | 5999 | 0.773478428 | 0 | 18756 | 6027 | 0.771323116 | 0 | 18784 | 6055 | 0.769802883 | 0 | 18812 | 6083 | 0.767645191 | 0 |
| 18729 | 6000 | 0.773377943 | -1.518537917 | 18757 | 6028 | 0.771323116 | 0 | 18785 | 6056 | 0.769695157 | 0 | 18813 | 6084 | 0.767576868 | 0 |
| 18730 | 6001 | 0.773282048 | 0 | 18758 | 6029 | 0.771225401 | 0 | 18786 | 6057 | 0.769178448 | 0 | 18814 | 6085 | 0.767576868 | 0 |
| 18731 | 6002 | 0.772938596 | 0 | 18759 | 6030 | 0.771225401 | 0 | 18787 | 6058 | 0.769178448 | 0 | 18815 | 6086 | 0.767576868 | 0 |
| 18732 | 6003 | 0.772938596 | 0 | 18760 | 6031 | 0.771115104 | 0 | 18788 | 6059 | 0.769178448 | 0 | 18816 | 6087 | 0.767517664 | 0 |
| 18733 | 6004 | 0.772938596 | 0 | 18761 | 6032 | 0.770845607 | 0 | 18789 | 6060 | 0.769178448 | 0 | 18817 | 6088 | 0.767420168 | 0 |
| 18734 | 6005 | 0.772938596 | 0 | 18762 | 6033 | 0.770845607 | 0 | 18790 | 6061 | 0.769178448 | 0 | 18818 | 6089 | 0.767310511 | -1.493196885 |
| 18735 | 6006 | 0.772938596 | 0 | 18763 | 6034 | 0.770845607 | 0 | 18791 | 6062 | 0.769178448 | 0 | 18819 | 6090 | 0.767229479 | 0 |
| 18736 | 6007 | 0.772938596 | 0 | 18764 | 6035 | 0.770845607 | 0 | 18792 | 6063 | 0.769178448 | -1.366390212 | 18820 | 6091 | 0.767117734 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18821 | 6092 | 0.766689647 | 0 | 18849 | 6120 | 0.765450575 | 0 | 18877 | 6148 | 0.764000509 | 0 | 18905 | 6176 | 0.762351672 | 0 |
| 18822 | 6093 | 0.766689647 | 0 | 18850 | 6121 | 0.765450575 | 0 | 18878 | 6149 | 0.764000509 | 0 | 18906 | 6177 | 0.762280528 | 0 |
| 18823 | 6094 | 0.766689647 | 0 | 18851 | 6122 | 0.765450575 | 0 | 18879 | 6150 | 0.763896747 | 0 | 18907 | 6178 | 0.762280528 | 0 |
| 18824 | 6095 | 0.766689647 | 0 | 18852 | 6123 | 0.765450575 | 0 | 18880 | 6151 | 0.763896747 | 0 | 18908 | 6179 | 0.762280528 | 0 |
| 18825 | 6096 | 0.766689647 | 0 | 18853 | 6124 | 0.765371605 | 0 | 18881 | 6152 | 0.763795217 | 0 | 18909 | 6180 | 0.762142019 | 0 |
| 18826 | 6097 | 0.766689647 | 0 | 18854 | 6125 | 0.765313118 | 0 | 18882 | 6153 | 0.76359857 | 0 | 18910 | 6181 | 0.762008329 | 0 |
| 18827 | 6098 | 0.766689647 | 0 | 18855 | 6126 | 0.765232282 | -1.42469404 | 18883 | 6154 | 0.76359857 | 0 | 18911 | 6182 | 0.762008329 | -1.358837074 |
| 18828 | 6099 | 0.766689647 | 0 | 18856 | 6127 | 0.764920624 | 0 | 18884 | 6155 | 0.76359857 | 0 | 18912 | 6183 | 0.761943212 | 0 |
| 18829 | 6100 | 0.766689647 | 0 | 18857 | 6128 | 0.764920624 | 0 | 18885 | 6156 | 0.76359857 | 0 | 18913 | 6184 | 0.761943212 | 0 |
| 18830 | 6101 | 0.766689647 | 0 | 18858 | 6129 | 0.764920624 | 0 | 18886 | 6157 | 0.76359857 | -0.358606128 | 18914 | 6185 | 0.761754429 | 0 |
| 18831 | 6102 | 0.766689647 | 0 | 18859 | 6130 | 0.764920624 | 0 | 18887 | 6158 | 0.763318651 | 0 | 18915 | 6186 | 0.761754429 | 0 |
| 18832 | 6103 | 0.766354414 | -1.460294715 | 18860 | 6131 | 0.764920624 | -0.261503566 | 18888 | 6159 | 0.763318651 | 0 | 18916 | 6187 | 0.761754429 | 0 |
| 18833 | 6104 | 0.76628956 | 0 | 18861 | 6132 | 0.764920624 | -1.215746075 | 18889 | 6160 | 0.763229115 | 0 | 18917 | 6188 | 0.761754429 | 0 |
| 18834 | 6105 | 0.76628956 | 0 | 18862 | 6133 | 0.764920624 | -1.340684812 | 18890 | 6161 | 0.763229115 | 0 | 18918 | 6189 | 0.761754429 | 0 |
| 18835 | 6106 | 0.76628956 | 0 | 18863 | 6134 | 0.764555518 | 0 | 18891 | 6162 | 0.763229115 | 0 | 18919 | 6190 | 0.761754429 | 0 |
| 18836 | 6107 | 0.766193594 | 0 | 18864 | 6135 | 0.764555518 | 0 | 18892 | 6163 | 0.763055363 | 0 | 18920 | 6191 | 0.761754429 | -0.176533672 |
| 18837 | 6108 | 0.766193594 | 0 | 18865 | 6136 | 0.764555518 | 0 | 18893 | 6164 | 0.763055363 | 0 | 18921 | 6192 | 0.761754429 | -0.498752967 |
| 18838 | 6109 | 0.766193594 | 0 | 18866 | 6137 | 0.764439412 | 0 | 18894 | 6165 | 0.762888358 | 0 | 18922 | 6193 | 0.761754429 | -0.720601716 |
| 18839 | 6110 | 0.766193594 | -0.33595131 | 18867 | 6138 | 0.764439412 | 0 | 18895 | 6166 | 0.762573081 | 0 | 18923 | 6194 | 0.761517045 | 0 |
| 18840 | 6111 | 0.766037063 | 0 | 18868 | 6139 | 0.764348431 | 0 | 18896 | 6167 | 0.762573081 | 0 | 18924 | 6195 | 0.761517045 | 0 |
| 18841 | 6112 | 0.766037063 | 0 | 18869 | 6140 | 0.764348431 | 0 | 18897 | 6168 | 0.762573081 | 0 | 18925 | 6196 | 0.761404051 | 0 |
| 18842 | 6113 | 0.765914813 | 0 | 18870 | 6141 | 0.764348431 | 0 | 18898 | 6169 | 0.762573081 | 0 | 18926 | 6197 | 0.761404051 | 0 |
| 18843 | 6114 | 0.765914813 | 0 | 18871 | 6142 | 0.764348431 | 0 | 18899 | 6170 | 0.762573081 | 0 | 18927 | 6198 | 0.761294615 | 0 |
| 18844 | 6115 | 0.765736201 | 0 | 18872 | 6143 | 0.764348431 | 0 | 18900 | 6171 | 0.762573081 | 0 | 18928 | 6199 | 0.761294615 | 0 |
| 18845 | 6116 | 0.765736201 | 0 | 18873 | 6144 | 0.764215028 | 0 | 18901 | 6172 | 0.762573081 | -1.151146829 | 18929 | 6200 | 0.761294615 | 0 |
| 18846 | 6117 | 0.765736201 | 0 | 18874 | 6145 | 0.764215028 | 0 | 18902 | 6173 | 0.762573081 | -1.327238088 | 18930 | 6201 | 0.761294615 | 0 |
| 18847 | 6118 | 0.765736201 | -1.006654556 | 18875 | 6146 | 0.764215028 | -1.371353631 | 18903 | 6174 | 0.76242412 | 0 | 18931 | 6202 | 0.76108577 | 0 |
| 18848 | 6119 | 0.765611993 | 0 | 18876 | 6147 | 0.764085175 | 0 | 18904 | 6175 | 0.762351672 | 0 | 18932 | 6203 | 0.76108577 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 18933 | 6204 | 0.76108577 | 0 | 18961 | 6232 | 0.759307694 | 0 | 18989 | 6260 | 0.757684161 | 0 | 19017 | 6288 | 0.756654155 | -1.42030719 |
| 18934 | 6205 | 0.760937318 | 0 | 18962 | 6233 | 0.759307694 | 0 | 18990 | 6261 | 0.75761371 | 0 | 19018 | 6289 | 0.75658932 | 0 |
| 18935 | 6206 | 0.760937318 | 0 | 18963 | 6234 | 0.759150312 | 0 | 18991 | 6262 | 0.75761371 | 0 | 19019 | 6290 | 0.756528199 | 0 |
| 18936 | 6207 | 0.760795369 | 0 | 18964 | 6235 | 0.759002818 | 0 | 18992 | 6263 | 0.75761371 | 0 | 19020 | 6291 | 0.756470482 | 0 |
| 18937 | 6208 | 0.760795369 | 0 | 18965 | 6236 | 0.759002818 | -1.103564569 | 18993 | 6264 | 0.757360181 | 0 | 19021 | 6292 | 0.756470482 | -1.458279424 |
| 18938 | 6209 | 0.760795369 | 0 | 18966 | 6237 | 0.75886431 | 0 | 18994 | 6265 | 0.757360181 | 0 | 19022 | 6293 | 0.756415892 | 0 |
| 18939 | 6210 | 0.760795369 | 0 | 18967 | 6238 | 0.758733989 | 0 | 18995 | 6266 | 0.757360181 | 0 | 19023 | 6294 | 0.756415892 | 0 |
| 18940 | 6211 | 0.760795369 | 0 | 18968 | 6239 | 0.758733989 | 0 | 18996 | 6267 | 0.757360181 | 0 | 19024 | 6295 | 0.756364181 | 0 |
| 18941 | 6212 | 0.760529338 | 0 | 18969 | 6240 | 0.758733989 | 0 | 18997 | 6268 | 0.757360181 | 0 | 19025 | 6296 | 0.756141773 | 0 |
| 18942 | 6213 | 0.760529338 | 0 | 18970 | 6241 | 0.758733989 | 0 | 18998 | 6269 | 0.757360181 | 0 | 19026 | 6297 | 0.756141773 | 0 |
| 18943 | 6214 | 0.760529338 | 0 | 18971 | 6242 | 0.758733989 | 0 | 18999 | 6270 | 0.757360181 | -1.299027232 | 19027 | 6298 | 0.756031579 | 0 |
| 18944 | 6215 | 0.760529338 | 0 | 18972 | 6243 | 0.758733989 | 0 | 19000 | 6271 | 0.757248091 | 0 | 19028 | 6299 | 0.755965782 | 0 |
| 18945 | 6216 | 0.760284734 | 0 | 18973 | 6244 | 0.758495169 | 0 | 19001 | 6272 | 0.757144329 | 0 | 19029 | 6300 | 0.755965782 | 0 |
| 18946 | 6217 | 0.760284734 | 0 | 18974 | 6245 | 0.758495169 | 0 | 19002 | 6273 | 0.757144329 | 0 | 19030 | 6301 | 0.754455191 | 0 |
| 18947 | 6218 | 0.760284734 | 0 | 18975 | 6246 | 0.758281599 | 0 | 19003 | 6274 | 0.757144329 | 0 | 19031 | 6302 | 0.754455191 | 0 |
| 18948 | 6219 | 0.760059068 | 0 | 18976 | 6247 | 0.758281599 | 0 | 19004 | 6275 | 0.757144329 | 0 | 19032 | 6303 | 0.754455191 | 0 |
| 18949 | 6220 | 0.760059068 | -0.887392952 | 18977 | 6248 | 0.758281599 | 0 | 19005 | 6276 | 0.757048001 | 0 | 19033 | 6304 | 0.754455191 | 0 |
| 18950 | 6221 | 0.760059068 | -1.012331689 | 18978 | 6249 | 0.758281599 | -1.479949403 | 19006 | 6277 | 0.757048001 | 0 | 19034 | 6305 | 0.754455191 | 0 |
| 18951 | 6222 | 0.759918086 | 0 | 18979 | 6250 | 0.758089475 | 0 | 19007 | 6278 | 0.756958336 | 0 | 19035 | 6306 | 0.754455191 | 0 |
| 18952 | 6223 | 0.759918086 | 0 | 18980 | 6251 | 0.758089475 | 0 | 19008 | 6279 | 0.756958336 | 0 | 19036 | 6307 | 0.754455191 | 0 |
| 18953 | 6224 | 0.759918086 | 0 | 18981 | 6252 | 0.758089475 | 0 | 19009 | 6280 | 0.756874665 | 0 | 19037 | 6308 | 0.754455191 | 0 |
| 18954 | 6225 | 0.759850223 | 0 | 18982 | 6253 | 0.758000472 | 0 | 19010 | 6281 | 0.756874665 | -0.533595955 | 19038 | 6309 | 0.754455191 | 0 |
| 18955 | 6226 | 0.759784024 | 0 | 18983 | 6254 | 0.757915723 | 0 | 19011 | 6282 | 0.756796407 | 0 | 19039 | 6310 | 0.754455191 | 0 |
| 18956 | 6227 | 0.759656384 | 0 | 18984 | 6255 | 0.757915723 | 0 | 19012 | 6283 | 0.756796407 | 0 | 19040 | 6311 | 0.754455191 | 0 |
| 18957 | 6228 | 0.759656384 | 0 | 18985 | 6256 | 0.757915723 | 0 | 19013 | 6284 | 0.756796407 | 0 | 19041 | 6312 | 0.754455191 | 0 |
| 18958 | 6229 | 0.759475992 | 0 | 18986 | 6257 | 0.757915723 | 0 | 19014 | 6285 | 0.756723052 | 0 | 19042 | 6313 | 0.754455191 | 0 |
| 18959 | 6230 | 0.759475992 | 0 | 18987 | 6258 | 0.757834931 | 0 | 19015 | 6286 | 0.756723052 | -1.406874331 | 19043 | 6314 | 0.754455191 | 0 |
| 18960 | 6231 | 0.759307694 | 0 | 18988 | 6259 | 0.757757826 | 0 | 19016 | 6287 | 0.756654155 | 0 | 19044 | 6315 | 0.754455191 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19045 | 6316 | 0.754455191 | 0 | 19073 | 6344 | 0.754455191 | 0 | 19101 | 6372 | 0.752449208 | 0 | 19129 | 6400 | 0.751449681 | 0 |
| 19046 | 6317 | 0.754455191 | 0 | 19074 | 6345 | 0.754455191 | 0 | 19102 | 6373 | 0.75239203 | -1.450123419 | 19130 | 6401 | 0.751449681 | 0 |
| 19047 | 6318 | 0.754455191 | 0 | 19075 | 6346 | 0.754455191 | 0 | 19103 | 6374 | 0.752267305 | 0 | 19131 | 6402 | 0.751449681 | 0 |
| 19048 | 6319 | 0.754455191 | 0 | 19076 | 6347 | 0.754455191 | 0 | 19104 | 6375 | 0.752267305 | 0 | 19132 | 6403 | 0.751449681 | 0 |
| 19049 | 6320 | 0.754455191 | 0 | 19077 | 6348 | 0.754455191 | 0 | 19105 | 6376 | 0.75219911 | 0 | 19133 | 6404 | 0.751449681 | -1.287208966 |
| 19050 | 6321 | 0.754455191 | 0 | 19078 | 6349 | 0.754455191 | 0 | 19106 | 6377 | 0.75219911 | 0 | 19134 | 6405 | 0.751319477 | 0 |
| 19051 | 6322 | 0.754455191 | 0 | 19079 | 6350 | 0.754455191 | 0 | 19107 | 6378 | 0.75219911 | 0 | 19135 | 6406 | 0.751319477 | 0 |
| 19052 | 6323 | 0.754455191 | 0 | 19080 | 6351 | 0.754455191 | 0 | 19108 | 6379 | 0.75219911 | 0 | 19136 | 6407 | 0.751319477 | 0 |
| 19053 | 6324 | 0.754455191 | 0 | 19081 | 6352 | 0.754455191 | 0 | 19109 | 6380 | 0.752126528 | 0 | 19137 | 6408 | 0.751319477 | 0 |
| 19054 | 6325 | 0.754455191 | 0 | 19082 | 6353 | 0.754455191 | 0 | 19110 | 6381 | 0.752126528 | 0 | 19138 | 6409 | 0.751319477 | 0 |
| 19055 | 6326 | 0.754455191 | 0 | 19083 | 6354 | 0.754455191 | -1.381113469 | 19111 | 6382 | 0.752049121 | 0 | 19139 | 6410 | 0.751250051 | 0 |
| 19056 | 6327 | 0.754455191 | 0 | 19084 | 6355 | 0.754455191 | 0 | 19112 | 6383 | 0.752049121 | 0 | 19140 | 6411 | 0.751177481 | 0 |
| 19057 | 6328 | 0.754455191 | 0 | 19085 | 6356 | 0.754455191 | 0 | 19113 | 6384 | 0.752049121 | 0 | 19141 | 6412 | 0.751177481 | 0 |
| 19058 | 6329 | 0.754455191 | 0 | 19086 | 6357 | 0.754455191 | 0 | 19114 | 6385 | 0.75196639 | 0 | 19142 | 6413 | 0.751022015 | 0 |
| 19059 | 6330 | 0.754455191 | 0 | 19087 | 6358 | 0.754455191 | 0 | 19115 | 6386 | 0.75196639 | 0 | 19143 | 6414 | 0.751022015 | 0 |
| 19060 | 6331 | 0.754455191 | 0 | 19088 | 6359 | 0.754455191 | 0 | 19116 | 6387 | 0.751877768 | 0 | 19144 | 6415 | 0.750851066 | 0 |
| 19061 | 6332 | 0.754455191 | 0 | 19089 | 6360 | 0.754455191 | 0 | 19117 | 6388 | 0.751877768 | 0 | 19145 | 6416 | 0.750662202 | 0 |
| 19062 | 6333 | 0.754455191 | 0 | 19090 | 6361 | 0.754455191 | 0 | 19118 | 6389 | 0.751782601 | 0 | 19146 | 6417 | 0.750662202 | 0 |
| 19063 | 6334 | 0.754455191 | 0 | 19091 | 6362 | 0.754455191 | 0 | 19119 | 6390 | 0.751782601 | 0 | 19147 | 6418 | 0.750662202 | 0 |
| 19064 | 6335 | 0.754455191 | 0 | 19092 | 6363 | 0.754455191 | 0 | 19120 | 6391 | 0.751782601 | 0 | 19148 | 6419 | 0.750662202 | 0 |
| 19065 | 6336 | 0.754455191 | 0 | 19093 | 6364 | 0.754455191 | 0 | 19121 | 6392 | 0.751782601 | -0.860907313 | 19149 | 6420 | 0.750338625 | -0.02081306 |
| 19066 | 6337 | 0.754455191 | 0 | 19094 | 6365 | 0.754455191 | -1.159264719 | 19122 | 6393 | 0.751680137 | 0 | 19150 | 6421 | 0.750218138 | 0 |
| 19067 | 6338 | 0.754455191 | 0 | 19095 | 6366 | 0.75273521 | 0 | 19123 | 6394 | 0.751680137 | 0 | 19151 | 6422 | 0.750218138 | 0 |
| 19068 | 6339 | 0.754455191 | 0 | 19096 | 6367 | 0.752693345 | 0 | 19124 | 6395 | 0.751569503 | 0 | 19152 | 6423 | 0.750090385 | 0 |
| 19069 | 6340 | 0.754455191 | 0 | 19097 | 6368 | 0.75264939 | 0 | 19125 | 6396 | 0.751569503 | 0 | 19153 | 6424 | 0.750090385 | 0 |
| 19070 | 6341 | 0.754455191 | 0 | 19098 | 6369 | 0.752603186 | 0 | 19126 | 6397 | 0.751569503 | 0 | 19154 | 6425 | 0.74995469 | 0 |
| 19071 | 6342 | 0.754455191 | 0 | 19099 | 6370 | 0.752554555 | 0 | 19127 | 6398 | 0.751569503 | 0 | 19155 | 6426 | 0.74995469 | 0 |
| 19072 | 6343 | 0.754455191 | 0 | 19100 | 6371 | 0.752449208 | 0 | 19128 | 6399 | 0.751449681 | 0 | 19156 | 6427 | 0.74995469 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19157 | 6428 | 0.749656308 | 0 | 19185 | 6456 | 0.747924324 | 0 | 19213 | 6484 | 0.746486261 | 0 | 19241 | 6512 | 0.745115164 | 0 |
| 19158 | 6429 | 0.749656308 | 0 | 19186 | 6457 | 0.747924324 | 0 | 19214 | 6485 | 0.746486261 | 0 | 19242 | 6513 | 0.745115164 | 0 |
| 19159 | 6430 | 0.749656308 | 0 | 19187 | 6458 | 0.747924324 | 0 | 19215 | 6486 | 0.746486261 | 0 | 19243 | 6514 | 0.744909873 | 0 |
| 19160 | 6431 | 0.749491771 | 0 | 19188 | 6459 | 0.747924324 | 0 | 19216 | 6487 | 0.746486261 | 0 | 19244 | 6515 | 0.744909873 | 0 |
| 19161 | 6432 | 0.749491771 | 0 | 19189 | 6460 | 0.747924324 | 0 | 19217 | 6488 | 0.746486261 | 0 | 19245 | 6516 | 0.744909873 | 0 |
| 19162 | 6433 | 0.749315551 | 0 | 19190 | 6461 | 0.747721808 | 0 | 19218 | 6489 | 0.746486261 | 0 | 19246 | 6517 | 0.744909873 | 0 |
| 19163 | 6434 | 0.749315551 | 0 | 19191 | 6462 | 0.747615766 | 0 | 19219 | 6490 | 0.746486261 | 0 | 19247 | 6518 | 0.744909873 | 0 |
| 19164 | 6435 | 0.749315551 | 0 | 19192 | 6463 | 0.747615766 | 0 | 19220 | 6491 | 0.746486261 | 0 | 19248 | 6519 | 0.744782308 | 0 |
| 19165 | 6436 | 0.749315551 | 0 | 19193 | 6464 | 0.747615766 | 0 | 19221 | 6492 | 0.746486261 | 0 | 19249 | 6520 | 0.744695353 | 0 |
| 19166 | 6437 | 0.749126357 | 0 | 19194 | 6465 | 0.747615766 | 0 | 19222 | 6493 | 0.746486261 | 0 | 19250 | 6521 | 0.744695353 | 0 |
| 19167 | 6438 | 0.748922702 | 0 | 19195 | 6466 | 0.747615766 | 0 | 19223 | 6494 | 0.746486261 | 0 | 19251 | 6522 | 0.744695353 | 0 |
| 19168 | 6439 | 0.748922702 | 0 | 19196 | 6467 | 0.747615766 | 0 | 19224 | 6495 | 0.746260712 | 0 | 19252 | 6523 | 0.744695353 | 0 |
| 19169 | 6440 | 0.748922702 | 0 | 19197 | 6468 | 0.747450289 | 0 | 19225 | 6496 | 0.746260712 | 0 | 19253 | 6524 | 0.744584437 | 0 |
| 19170 | 6441 | 0.748814923 | 0 | 19198 | 6469 | 0.747450289 | 0 | 19226 | 6497 | 0.746182665 | 0 | 19254 | 6525 | 0.744516668 | 0 |
| 19171 | 6442 | 0.748778058 | 0 | 19199 | 6470 | 0.747276606 | 0 | 19227 | 6498 | 0.746182665 | 0 | 19255 | 6526 | 0.744516668 | 0 |
| 19172 | 6443 | 0.748702862 | -0.052412047 | 19200 | 6471 | 0.747276606 | 0 | 19228 | 6499 | 0.746022023 | 0 | 19256 | 6527 | 0.744516668 | 0 |
| 19173 | 6444 | 0.748464827 | 0 | 19201 | 6472 | 0.747276606 | 0 | 19229 | 6500 | 0.746022023 | 0 | 19257 | 6528 | 0.744516668 | 0 |
| 19174 | 6445 | 0.748464827 | 0 | 19202 | 6473 | 0.747276606 | 0 | 19230 | 6501 | 0.746022023 | 0 | 19258 | 6529 | 0.74447097 | 0 |
| 19175 | 6446 | 0.748464827 | 0 | 19203 | 6474 | 0.747276606 | 0 | 19231 | 6502 | 0.745855019 | 0 | 19259 | 6530 | 0.744236026 | 0 |
| 19176 | 6447 | 0.748464827 | 0 | 19204 | 6475 | 0.747094091 | 0 | 19232 | 6503 | 0.745855019 | 0 | 19260 | 6531 | 0.744236026 | 0 |
| 19177 | 6448 | 0.748464827 | -0.290193819 | 19205 | 6476 | 0.747031173 | 0 | 19233 | 6504 | 0.745855019 | -1.310532394 | 19261 | 6532 | 0.744236026 | 0 |
| 19178 | 6449 | 0.748294882 | 0 | 19206 | 6477 | 0.747031173 | 0 | 19234 | 6505 | 0.745716576 | 0 | 19262 | 6533 | 0.744236026 | 0 |
| 19179 | 6450 | 0.748294882 | 0 | 19207 | 6478 | 0.747031173 | 0 | 19235 | 6506 | 0.745716576 | 0 | 19263 | 6534 | 0.744236026 | 0 |
| 19180 | 6451 | 0.748206241 | 0 | 19208 | 6479 | 0.746902053 | -1.190298953 | 19236 | 6507 | 0.745681266 | 0 | 19264 | 6535 | 0.744236026 | 0 |
| 19181 | 6452 | 0.748206241 | 0 | 19209 | 6480 | 0.746822402 | 0 | 19237 | 6508 | 0.74565587 | 0 | 19265 | 6536 | 0.744236026 | 0 |
| 19182 | 6453 | 0.748206241 | 0 | 19210 | 6481 | 0.746768362 | 0 | 19238 | 6509 | 0.745500348 | 0 | 19266 | 6537 | 0.744236026 | 0 |
| 19183 | 6454 | 0.748206241 | 0 | 19211 | 6482 | 0.746768362 | -1.358837074 | 19239 | 6510 | 0.745500348 | 0 | 19267 | 6538 | 0.743939072 | 0 |
| 19184 | 6455 | 0.748115013 | 0 | 19212 | 6483 | 0.746486261 | 0 | 19240 | 6511 | 0.745500348 | -0.515007048 | 19268 | 6539 | 0.743624343 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19269 | 6540 | 0.743624343 | 0 | 19297 | 6568 | 0.742045933 | 0 | 19325 | 6596 | 0.740753913 | 0 | 19353 | 6624 | 0.739802903 | 0 |
| 19270 | 6541 | 0.743459806 | 0 | 19298 | 6569 | 0.742045933 | 0 | 19326 | 6597 | 0.740753913 | 0 | 19354 | 6625 | 0.739802903 | 0 |
| 19271 | 6542 | 0.743459806 | 0 | 19299 | 6570 | 0.742045933 | 0 | 19327 | 6598 | 0.740753913 | 0 | 19355 | 6626 | 0.739802903 | 0 |
| 19272 | 6543 | 0.743459806 | 0 | 19300 | 6571 | 0.742045933 | -1.278129308 | 19328 | 6599 | 0.740753913 | -1.031636844 | 19356 | 6627 | 0.739802903 | 0 |
| 19273 | 6544 | 0.743459806 | 0 | 19301 | 6572 | 0.741866063 | 0 | 19329 | 6600 | 0.740753913 | -1.33266684 | 19357 | 6628 | 0.739731934 | 0 |
| 19274 | 6545 | 0.743366219 | 0 | 19302 | 6573 | 0.741866063 | 0 | 19330 | 6601 | 0.740666906 | 0 | 19358 | 6629 | 0.739731934 | -1.381113469 |
| 19275 | 6546 | 0.743290193 | 0 | 19303 | 6574 | 0.741866063 | 0 | 19331 | 6602 | 0.740666906 | 0 | 19359 | 6630 | 0.739631414 | 0 |
| 19276 | 6547 | 0.743290193 | 0 | 19304 | 6575 | 0.741866063 | -0.669909008 | 19332 | 6603 | 0.740666906 | -0.086922898 | 19360 | 6631 | 0.739631414 | 0 |
| 19277 | 6548 | 0.74317418 | 0 | 19305 | 6576 | 0.741718369 | 0 | 19333 | 6604 | 0.740604079 | 0 | 19361 | 6632 | 0.739631414 | 0 |
| 19278 | 6549 | 0.74317418 | 0 | 19306 | 6577 | 0.741718369 | 0 | 19334 | 6605 | 0.740604079 | 0 | 19362 | 6633 | 0.739631414 | -0.18508388 |
| 19279 | 6550 | 0.74317418 | 0 | 19307 | 6578 | 0.741718369 | 0 | 19335 | 6606 | 0.740519413 | 0 | 19363 | 6634 | 0.739478035 | 0 |
| 19280 | 6551 | 0.743089827 | 0 | 19308 | 6579 | 0.741490214 | 0 | 19336 | 6607 | 0.740214752 | 0 | 19364 | 6635 | 0.739478035 | 0 |
| 19281 | 6552 | 0.743025729 | 0 | 19309 | 6580 | 0.741490214 | 0 | 19337 | 6608 | 0.740214752 | 0 | 19365 | 6636 | 0.739478035 | 0 |
| 19282 | 6553 | 0.743025729 | 0 | 19310 | 6581 | 0.741490214 | 0 | 19338 | 6609 | 0.740214752 | 0 | 19366 | 6637 | 0.73936652 | 0 |
| 19283 | 6554 | 0.743025729 | -1.012331689 | 19311 | 6582 | 0.741490214 | 0 | 19339 | 6610 | 0.740214752 | 0 | 19367 | 6638 | 0.739215224 | 0 |
| 19284 | 6555 | 0.742873318 | 0 | 19312 | 6583 | 0.741490214 | 0 | 19340 | 6611 | 0.740214752 | 0 | 19368 | 6639 | 0.739215224 | 0 |
| 19285 | 6556 | 0.742829023 | 0 | 19313 | 6584 | 0.741490214 | 0 | 19341 | 6612 | 0.740214752 | 0 | 19369 | 6640 | 0.739215224 | 0 |
| 19286 | 6557 | 0.742795578 | 0 | 19314 | 6585 | 0.741253734 | 0 | 19342 | 6613 | 0.740214752 | 0 | 19370 | 6641 | 0.739215224 | 0 |
| 19287 | 6558 | 0.742795578 | 0 | 19315 | 6586 | 0.741253734 | 0 | 19343 | 6614 | 0.740214752 | 0 | 19371 | 6642 | 0.739080329 | 0 |
| 19288 | 6559 | 0.742555967 | 0 | 19316 | 6587 | 0.741253734 | 0 | 19344 | 6615 | 0.740214752 | 0 | 19372 | 6643 | 0.739080329 | 0 |
| 19289 | 6560 | 0.742555967 | 0 | 19317 | 6588 | 0.741253734 | -0.09328493 | 19345 | 6616 | 0.740214752 | 0 | 19373 | 6644 | 0.73899824 | 0 |
| 19290 | 6561 | 0.742555967 | 0 | 19318 | 6589 | 0.741253734 | -0.64958743 | 19346 | 6617 | 0.740214752 | 0 | 19374 | 6645 | 0.738850117 | 0 |
| 19291 | 6562 | 0.742555967 | 0 | 19319 | 6590 | 0.741091229 | 0 | 19347 | 6618 | 0.740214752 | 0 | 19375 | 6646 | 0.738660924 | 0 |
| 19292 | 6563 | 0.742555967 | 0 | 19320 | 6591 | 0.741091229 | 0 | 19348 | 6619 | 0.740214752 | 0 | 19376 | 6647 | 0.738660924 | 0 |
| 19293 | 6564 | 0.742555967 | 0 | 19321 | 6592 | 0.740882384 | 0 | 19349 | 6620 | 0.740214752 | -0.08572374 | 19377 | 6648 | 0.738660924 | 0 |
| 19294 | 6565 | 0.742555967 | 0 | 19322 | 6593 | 0.740882384 | 0 | 19350 | 6621 | 0.740214752 | -1.219262649 | 19378 | 6649 | 0.738660924 | 0 |
| 19295 | 6566 | 0.742555967 | 0 | 19323 | 6594 | 0.740882384 | 0 | 19351 | 6622 | 0.739928938 | 0 | 19379 | 6650 | 0.738660924 | 0 |
| 19296 | 6567 | 0.742151408 | -0.533595955 | 19324 | 6595 | 0.740882384 | -1.239784316 | 19352 | 6623 | 0.739855682 | -1.208626334 | 19380 | 6651 | 0.738660924 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19381 | 6652 | 0.738410826 | 0 | 19409 | 6680 | 0.736726424 | 0 | 19437 | 6708 | 0.735392185 | -1.338028568 | 19465 | 6736 | 0.733671585 | 0 |
| 19382 | 6653 | 0.738308555 | 0 | 19410 | 6681 | 0.736726424 | 0 | 19438 | 6709 | 0.73532018 | 0 | 19466 | 6737 | 0.733671585 | 0 |
| 19383 | 6654 | 0.738308555 | 0 | 19411 | 6682 | 0.736726424 | 0 | 19439 | 6710 | 0.735150036 | 0 | 19467 | 6738 | 0.733671585 | 0 |
| 19384 | 6655 | 0.738308555 | 0 | 19412 | 6683 | 0.736726424 | 0 | 19440 | 6711 | 0.735150036 | 0 | 19468 | 6739 | 0.733521284 | 0 |
| 19385 | 6656 | 0.738308555 | 0 | 19413 | 6684 | 0.736726424 | 0 | 19441 | 6712 | 0.735150036 | 0 | 19469 | 6740 | 0.733521284 | 0 |
| 19386 | 6657 | 0.738308555 | 0 | 19414 | 6685 | 0.736726424 | 0 | 19442 | 6713 | 0.734992711 | 0 | 19470 | 6741 | 0.733265892 | 0 |
| 19387 | 6658 | 0.738217992 | 0 | 19415 | 6686 | 0.736726424 | 0 | 19443 | 6714 | 0.734933051 | 0 | 19471 | 6742 | 0.733265892 | 0 |
| 19388 | 6659 | 0.738064775 | 0 | 19416 | 6687 | 0.736726424 | 0 | 19444 | 6715 | 0.734933051 | 0 | 19472 | 6743 | 0.733265892 | 0 |
| 19389 | 6660 | 0.738064775 | 0 | 19417 | 6688 | 0.736726424 | 0 | 19445 | 6716 | 0.734933051 | -0.084882356 | 19473 | 6744 | 0.733265892 | 0 |
| 19390 | 6661 | 0.738064775 | 0 | 19418 | 6689 | 0.736726424 | 0 | 19446 | 6717 | 0.734800503 | 0 | 19474 | 6745 | 0.733265892 | 0 |
| 19391 | 6662 | 0.738064775 | 0 | 19419 | 6690 | 0.736726424 | -0.280742924 | 19447 | 6718 | 0.734800503 | 0 | 19475 | 6746 | 0.733265892 | 0 |
| 19392 | 6663 | 0.738064775 | 0 | 19420 | 6691 | 0.736726424 | -1.125840964 | 19448 | 6719 | 0.734800503 | 0 | 19476 | 6747 | 0.733265892 | 0 |
| 19393 | 6664 | 0.738064775 | 0 | 19421 | 6692 | 0.736726424 | -1.368879012 | 19449 | 6720 | 0.734800503 | 0 | 19477 | 6748 | 0.733265892 | 0 |
| 19394 | 6665 | 0.737940103 | 0 | 19422 | 6693 | 0.736281222 | 0 | 19450 | 6721 | 0.734251805 | 0 | 19478 | 6749 | 0.733265892 | 0 |
| 19395 | 6666 | 0.737749497 | 0 | 19423 | 6694 | 0.735971785 | 0 | 19451 | 6722 | 0.734251805 | 0 | 19479 | 6750 | 0.733265892 | 0 |
| 19396 | 6667 | 0.737749497 | 0 | 19424 | 6695 | 0.735971785 | 0 | 19452 | 6723 | 0.734251805 | 0 | 19480 | 6751 | 0.733265892 | 0 |
| 19397 | 6668 | 0.737641692 | 0 | 19425 | 6696 | 0.735813081 | 0 | 19453 | 6724 | 0.734251805 | 0 | 19481 | 6752 | 0.733265892 | 0 |
| 19398 | 6669 | 0.737641692 | 0 | 19426 | 6697 | 0.735813081 | 0 | 19454 | 6725 | 0.734251805 | 0 | 19482 | 6753 | 0.733265892 | 0 |
| 19399 | 6670 | 0.73755444 | 0 | 19427 | 6698 | 0.735705755 | 0 | 19455 | 6726 | 0.734251805 | -0.593202381 | 19483 | 6754 | 0.733057046 | 0 |
| 19400 | 6671 | 0.737421851 | 0 | 19428 | 6699 | 0.735569847 | 0 | 19456 | 6727 | 0.734251805 | -1.468263644 | 19484 | 6755 | 0.733057046 | 0 |
| 19401 | 6672 | 0.737421851 | 0 | 19429 | 6700 | 0.735569847 | 0 | 19457 | 6728 | 0.733992137 | -1.504238865 | 19485 | 6756 | 0.733057046 | 0 |
| 19402 | 6673 | 0.737421851 | -0.063693057 | 19430 | 6701 | 0.735569847 | 0 | 19458 | 6729 | 0.733933524 | 0 | 19486 | 6757 | 0.733057046 | 0 |
| 19403 | 6674 | 0.737325864 | 0 | 19431 | 6702 | 0.735569847 | 0 | 19459 | 6730 | 0.733840736 | 0 | 19487 | 6758 | 0.732966275 | 0 |
| 19404 | 6675 | 0.737325864 | -1.383519539 | 19432 | 6703 | 0.735569847 | 0 | 19460 | 6731 | 0.733840736 | 0 | 19488 | 6759 | 0.732966275 | 0 |
| 19405 | 6676 | 0.737253161 | 0 | 19433 | 6704 | 0.735392185 | 0 | 19461 | 6732 | 0.733840736 | 0 | 19489 | 6760 | 0.732966275 | 0 |
| 19406 | 6677 | 0.737112635 | -0.671457297 | 19434 | 6705 | 0.735392185 | 0 | 19462 | 6733 | 0.733840736 | -1.003787915 | 19490 | 6761 | 0.732966275 | 0 |
| 19407 | 6678 | 0.737081095 | -0.465434354 | 19435 | 6706 | 0.735392185 | 0 | 19463 | 6734 | 0.733671585 | 0 | 19491 | 6762 | 0.732966275 | 0 |
| 19408 | 6679 | 0.736726424 | 0 | 19436 | 6707 | 0.735392185 | 0 | 19464 | 6735 | 0.733671585 | 0 | 19492 | 6763 | 0.732966275 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19493 | 6764 | 0.732883085 | 0 | 19521 | 6792 | 0.731712064 | 0 | 19549 | 6820 | 0.730095845 | 0 | 19577 | 6848 | 0.728901086 | 0 |
| 19494 | 6765 | 0.732883085 | -1.481866821 | 19522 | 6793 | 0.731712064 | -0.139343434 | 19550 | 6821 | 0.730095845 | 0 | 19578 | 6849 | 0.728901086 | 0 |
| 19495 | 6766 | 0.732735941 | 0 | 19523 | 6794 | 0.731646898 | 0 | 19551 | 6822 | 0.730042132 | 0 | 19579 | 6850 | 0.728901086 | 0 |
| 19496 | 6767 | 0.732735941 | 0 | 19524 | 6795 | 0.731646898 | 0 | 19552 | 6823 | 0.729981421 | 0 | 19580 | 6851 | 0.728901086 | 0 |
| 19497 | 6768 | 0.732735941 | 0 | 19525 | 6796 | 0.731592308 | -1.495056821 | 19553 | 6824 | 0.72991225 | 0 | 19581 | 6852 | 0.728901086 | 0 |
| 19498 | 6769 | 0.732735941 | 0 | 19526 | 6797 | 0.730974095 | 0 | 19554 | 6825 | 0.729832716 | 0 | 19582 | 6853 | 0.728694329 | 0 |
| 19499 | 6770 | 0.732735941 | 0 | 19527 | 6798 | 0.730974095 | 0 | 19555 | 6826 | 0.729832716 | 0 | 19583 | 6854 | 0.728574672 | 0 |
| 19500 | 6771 | 0.732553349 | 0 | 19528 | 6799 | 0.730974095 | 0 | 19556 | 6827 | 0.729832716 | 0 | 19584 | 6855 | 0.728441758 | 0 |
| 19501 | 6772 | 0.73240505 | 0 | 19529 | 6800 | 0.730974095 | 0 | 19557 | 6828 | 0.729832716 | -0.150463439 | 19585 | 6856 | 0.728441758 | 0 |
| 19502 | 6773 | 0.73240505 | 0 | 19530 | 6801 | 0.730974095 | 0 | 19558 | 6829 | 0.729740303 | 0 | 19586 | 6857 | 0.728441758 | 0 |
| 19503 | 6774 | 0.73240505 | 0 | 19531 | 6802 | 0.730974095 | 0 | 19559 | 6830 | 0.729740303 | 0 | 19587 | 6858 | 0.728441758 | 0 |
| 19504 | 6775 | 0.73240505 | 0 | 19532 | 6803 | 0.730974095 | 0 | 19560 | 6831 | 0.729631607 | 0 | 19588 | 6859 | 0.728369622 | 0 |
| 19505 | 6776 | 0.73240505 | 0 | 19533 | 6804 | 0.730974095 | 0 | 19561 | 6832 | 0.729631607 | 0 | 19589 | 6860 | 0.728126252 | 0 |
| 19506 | 6777 | 0.732282212 | 0 | 19534 | 6805 | 0.730974095 | 0 | 19562 | 6833 | 0.729631607 | 0 | 19590 | 6861 | 0.728126252 | 0 |
| 19507 | 6778 | 0.732178796 | 0 | 19535 | 6806 | 0.730974095 | 0 | 19563 | 6834 | 0.729631607 | 0 | 19591 | 6862 | 0.728126252 | 0 |
| 19508 | 6779 | 0.732178796 | 0 | 19536 | 6807 | 0.730974095 | 0 | 19564 | 6835 | 0.729631607 | 0 | 19592 | 6863 | 0.728126252 | -1.435471131 |
| 19509 | 6780 | 0.732178796 | 0 | 19537 | 6808 | 0.730974095 | 0 | 19565 | 6836 | 0.729501909 | 0 | 19593 | 6864 | 0.727896162 | 0 |
| 19510 | 6781 | 0.732178796 | 0 | 19538 | 6809 | 0.730974095 | 0 | 19566 | 6837 | 0.729501909 | 0 | 19594 | 6865 | 0.727832711 | 0 |
| 19511 | 6782 | 0.732178796 | 0 | 19539 | 6810 | 0.730974095 | 0 | 19567 | 6838 | 0.72934447 | 0 | 19595 | 6866 | 0.727720937 | 0 |
| 19512 | 6783 | 0.732178796 | 0 | 19540 | 6811 | 0.730974095 | 0 | 19568 | 6839 | 0.72934447 | 0 | 19596 | 6867 | 0.727720937 | 0 |
| 19513 | 6784 | 0.732014322 | 0 | 19541 | 6812 | 0.730974095 | 0 | 19569 | 6840 | 0.72934447 | 0 | 19597 | 6868 | 0.727720937 | 0 |
| 19514 | 6785 | 0.732014322 | 0 | 19542 | 6813 | 0.730974095 | 0 | 19570 | 6841 | 0.72934447 | 0 | 19598 | 6869 | 0.727720937 | 0 |
| 19515 | 6786 | 0.731889363 | 0 | 19543 | 6814 | 0.730974095 | -1.44598725 | 19571 | 6842 | 0.729219367 | 0 | 19599 | 6870 | 0.727720937 | 0 |
| 19516 | 6787 | 0.731889363 | 0 | 19544 | 6815 | 0.730454914 | 0 | 19572 | 6843 | 0.729219367 | 0 | 19600 | 6871 | 0.727471701 | 0 |
| 19517 | 6788 | 0.731889363 | 0 | 19545 | 6816 | 0.730372995 | 0 | 19573 | 6844 | 0.729219367 | 0 | 19601 | 6872 | 0.727471701 | 0 |
| 19518 | 6789 | 0.731791206 | 0 | 19546 | 6817 | 0.730260382 | 0 | 19574 | 6845 | 0.729149325 | 0 | 19602 | 6873 | 0.727471701 | 0 |
| 19519 | 6790 | 0.731791206 | 0 | 19547 | 6818 | 0.730260382 | 0 | 19575 | 6846 | 0.729149325 | 0 | 19603 | 6874 | 0.727471701 | 0 |
| 19520 | 6791 | 0.731791206 | 0 | 19548 | 6819 | 0.730095845 | 0 | 19576 | 6847 | 0.729149325 | 0 | 19604 | 6875 | 0.727471701 | -1.044919056 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19605 | 6876 | 0.727302945 | 0 | 19633 | 6904 | 0.725731039 | 0 | 19661 | 6932 | 0.724170387 | 0 | 19689 | 6960 | 0.722740778 | 0 |
| 19606 | 6877 | 0.727302945 | 0 | 19634 | 6905 | 0.725628865 | 0 | 19662 | 6933 | 0.724072562 | 0 | 19690 | 6961 | 0.722740778 | 0 |
| 19607 | 6878 | 0.727181106 | 0 | 19635 | 6906 | 0.725628865 | 0 | 19663 | 6934 | 0.724072562 | 0 | 19691 | 6962 | 0.722566046 | 0 |
| 19608 | 6879 | 0.727181106 | 0 | 19636 | 6907 | 0.725628865 | 0 | 19664 | 6935 | 0.723997327 | 0 | 19692 | 6963 | 0.722270507 | 0 |
| 19609 | 6880 | 0.727181106 | 0 | 19637 | 6908 | 0.725491495 | 0 | 19665 | 6936 | 0.723889199 | 0 | 19693 | 6964 | 0.722270507 | 0 |
| 19610 | 6881 | 0.727181106 | 0 | 19638 | 6909 | 0.725296962 | 0 | 19666 | 6937 | 0.723889199 | 0 | 19694 | 6965 | 0.722270507 | 0 |
| 19611 | 6882 | 0.727181106 | 0 | 19639 | 6910 | 0.725296962 | 0 | 19667 | 6938 | 0.723889199 | 0 | 19695 | 6966 | 0.722270507 | 0 |
| 19612 | 6883 | 0.727181106 | -0.4875688 | 19640 | 6911 | 0.725296962 | 0 | 19668 | 6939 | 0.723889199 | 0 | 19696 | 6967 | 0.722085898 | 0 |
| 19613 | 6884 | 0.727016942 | 0 | 19641 | 6912 | 0.725296962 | 0 | 19669 | 6940 | 0.723889199 | 0 | 19697 | 6968 | 0.721925966 | 0 |
| 19614 | 6885 | 0.727016942 | 0 | 19642 | 6913 | 0.725296962 | 0 | 19670 | 6941 | 0.723720574 | 0 | 19698 | 6969 | 0.721925966 | 0 |
| 19615 | 6886 | 0.727016942 | -1.293158298 | 19643 | 6914 | 0.725115059 | 0 | 19671 | 6942 | 0.723720574 | 0 | 19699 | 6970 | 0.721925966 | 0 |
| 19616 | 6887 | 0.726911441 | 0 | 19644 | 6915 | 0.725115059 | 0 | 19672 | 6943 | 0.723641243 | 0 | 19700 | 6971 | 0.721786074 | 0 |
| 19617 | 6888 | 0.726911441 | 0 | 19645 | 6916 | 0.725115059 | 0 | 19673 | 6944 | 0.723420957 | 0 | 19701 | 6972 | 0.721662677 | 0 |
| 19618 | 6889 | 0.726911441 | -1.378693995 | 19646 | 6917 | 0.725000211 | 0 | 19674 | 6945 | 0.723420957 | 0 | 19702 | 6973 | 0.721662677 | 0 |
| 19619 | 6890 | 0.726837926 | 0 | 19647 | 6918 | 0.724863318 | 0 | 19675 | 6946 | 0.723420957 | 0 | 19703 | 6974 | 0.721662677 | -1.468263644 |
| 19620 | 6891 | 0.726837926 | 0 | 19648 | 6919 | 0.72478452 | 0 | 19676 | 6947 | 0.723420957 | 0 | 19704 | 6975 | 0.721454931 | 0 |
| 19621 | 6892 | 0.726426467 | 0 | 19649 | 6920 | 0.72478452 | 0 | 19677 | 6948 | 0.723420957 | 0 | 19705 | 6976 | 0.721454931 | 0 |
| 19622 | 6893 | 0.726426467 | 0 | 19650 | 6921 | 0.72478452 | 0 | 19678 | 6949 | 0.723420957 | 0 | 19706 | 6977 | 0.721366668 | 0 |
| 19623 | 6894 | 0.726426467 | 0 | 19651 | 6922 | 0.72478452 | 0 | 19679 | 6950 | 0.723420957 | -0.588238962 | 19707 | 6978 | 0.721286827 | 0 |
| 19624 | 6895 | 0.726426467 | 0 | 19652 | 6923 | 0.724491967 | 0 | 19680 | 6951 | 0.723162832 | 0 | 19708 | 6979 | 0.721148009 | 0 |
| 19625 | 6896 | 0.726426467 | 0 | 19653 | 6924 | 0.724491967 | 0 | 19681 | 6952 | 0.723046726 | 0 | 19709 | 6980 | 0.721031435 | 0 |
| 19626 | 6897 | 0.726426467 | -0.506052205 | 19654 | 6925 | 0.724491967 | 0 | 19682 | 6953 | 0.723046726 | -1.236430674 | 19710 | 6981 | 0.721031435 | 0 |
| 19627 | 6898 | 0.726426467 | -1.476088982 | 19655 | 6926 | 0.724491967 | 0 | 19683 | 6954 | 0.722938139 | 0 | 19711 | 6982 | 0.720932157 | 0 |
| 19628 | 6899 | 0.726103452 | 0 | 19656 | 6927 | 0.724491967 | 0 | 19684 | 6955 | 0.722886441 | -1.558810255 | 19712 | 6983 | 0.720932157 | 0 |
| 19629 | 6900 | 0.726059819 | 0 | 19657 | 6928 | 0.724491967 | 0 | 19685 | 6956 | 0.722740778 | 0 | 19713 | 6984 | 0.720932157 | 0 |
| 19630 | 6901 | 0.726002558 | -1.136564829 | 19658 | 6929 | 0.724231208 | 0 | 19686 | 6957 | 0.722740778 | 0 | 19714 | 6985 | 0.720932157 | 0 |
| 19631 | 6902 | 0.725810009 | 0 | 19659 | 6930 | 0.724170387 | 0 | 19687 | 6958 | 0.722740778 | 0 | 19715 | 6986 | 0.72084659 | 0 |
| 19632 | 6903 | 0.725810009 | -0.974030081 | 19660 | 6931 | 0.724170387 | 0 | 19688 | 6959 | 0.722740778 | 0 | 19716 | 6987 | 0.72084659 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19717 | 6988 | 0.72084659 | 0 | 19745 | 7016 | 0.719693084 | 0 | 19773 | 7044 | 0.717732384 | 0 | 19801 | 7072 | 0.716472097 | 0 |
| 19718 | 6989 | 0.720772078 | 0 | 19746 | 7017 | 0.719693084 | -0.93875432 | 19774 | 7045 | 0.717732384 | 0 | 19802 | 7073 | 0.716472097 | 0 |
| 19719 | 6990 | 0.720772078 | 0 | 19747 | 7018 | 0.719693084 | -1.169203242 | 19775 | 7046 | 0.717610133 | 0 | 19803 | 7074 | 0.716472097 | 0 |
| 19720 | 6991 | 0.720706608 | 0 | 19748 | 7019 | 0.718879036 | 0 | 19776 | 7047 | 0.717471624 | 0 | 19804 | 7075 | 0.716365141 | 0 |
| 19721 | 6992 | 0.719693084 | 0 | 19749 | 7020 | 0.718879036 | 0 | 19777 | 7048 | 0.717471624 | 0 | 19805 | 7076 | 0.716365141 | 0 |
| 19722 | 6993 | 0.719693084 | 0 | 19750 | 7021 | 0.718879036 | 0 | 19778 | 7049 | 0.717313383 | 0 | 19806 | 7077 | 0.716250838 | 0 |
| 19723 | 6994 | 0.719693084 | 0 | 19751 | 7022 | 0.718837332 | 0 | 19779 | 7050 | 0.717313383 | 0 | 19807 | 7078 | 0.716250838 | 0 |
| 19724 | 6995 | 0.719693084 | 0 | 19752 | 7023 | 0.718837332 | 0 | 19780 | 7051 | 0.717130868 | 0 | 19808 | 7079 | 0.716250838 | -1.404594565 |
| 19725 | 6996 | 0.719693084 | 0 | 19753 | 7024 | 0.718837332 | 0 | 19781 | 7052 | 0.717130868 | 0 | 19809 | 7080 | 0.716250838 | -1.404594565 |
| 19726 | 6997 | 0.719693084 | 0 | 19754 | 7025 | 0.718791123 | 0 | 19782 | 7053 | 0.717130868 | 0 | 19810 | 7081 | 0.716153583 | 0 |
| 19727 | 6998 | 0.719693084 | 0 | 19755 | 7026 | 0.718739638 | 0 | 19783 | 7054 | 0.717130868 | 0 | 19811 | 7082 | 0.715996939 | 0 |
| 19728 | 6999 | 0.719693084 | 0 | 19756 | 7027 | 0.718542635 | 0 | 19784 | 7055 | 0.717130868 | 0 | 19812 | 7083 | 0.715996939 | 0 |
| 19729 | 7000 | 0.719693084 | 0 | 19757 | 7028 | 0.718457537 | 0 | 19785 | 7056 | 0.717130868 | 0 | 19813 | 7084 | 0.715996939 | -0.674844226 |
| 19730 | 7001 | 0.719693084 | 0 | 19758 | 7029 | 0.718457537 | 0 | 19786 | 7057 | 0.716992799 | 0 | 19814 | 7085 | 0.715996939 | -1.37381423 |
| 19731 | 7002 | 0.719693084 | 0 | 19759 | 7030 | 0.718457537 | 0 | 19787 | 7058 | 0.716992799 | 0 | 19815 | 7086 | 0.715702602 | 0 |
| 19732 | 7003 | 0.719693084 | 0 | 19760 | 7031 | 0.718358845 | 0 | 19788 | 7059 | 0.71691803 | 0 | 19816 | 7087 | 0.715537125 | 0 |
| 19733 | 7004 | 0.719693084 | 0 | 19761 | 7032 | 0.718358845 | 0 | 19789 | 7060 | 0.71691803 | 0 | 19817 | 7088 | 0.715537125 | 0 |
| 19734 | 7005 | 0.719693084 | 0 | 19762 | 7033 | 0.718358845 | 0 | 19790 | 7061 | 0.71691803 | 0 | 19818 | 7089 | 0.715537125 | 0 |
| 19735 | 7006 | 0.719693084 | 0 | 19763 | 7034 | 0.718243018 | 0 | 19791 | 7062 | 0.71691803 | 0 | 19819 | 7090 | 0.715537125 | 0 |
| 19736 | 7007 | 0.719693084 | 0 | 19764 | 7035 | 0.718243018 | 0 | 19792 | 7063 | 0.71666663 | 0 | 19820 | 7091 | 0.715537125 | -1.147030263 |
| 19737 | 7008 | 0.719693084 | 0 | 19765 | 7036 | 0.718105169 | 0 | 19793 | 7064 | 0.71666663 | 0 | 19821 | 7092 | 0.715537125 | -1.147030263 |
| 19738 | 7009 | 0.719693084 | 0 | 19766 | 7037 | 0.718105169 | 0 | 19794 | 7065 | 0.71666663 | 0 | 19822 | 7093 | 0.71535733 | 0 |
| 19739 | 7010 | 0.719693084 | 0 | 19767 | 7038 | 0.718105169 | 0 | 19795 | 7066 | 0.71666663 | 0 | 19823 | 7094 | 0.71535733 | 0 |
| 19740 | 7011 | 0.719693084 | 0 | 19768 | 7039 | 0.718025925 | 0 | 19796 | 7067 | 0.71666663 | 0 | 19824 | 7095 | 0.71526147 | 0 |
| 19741 | 7012 | 0.719693084 | 0 | 19769 | 7040 | 0.71784108 | 0 | 19797 | 7068 | 0.71666663 | 0 | 19825 | 7096 | 0.71526147 | 0 |
| 19742 | 7013 | 0.719693084 | 0 | 19770 | 7041 | 0.71784108 | 0 | 19798 | 7069 | 0.716523038 | 0 | 19826 | 7097 | 0.71526147 | 0 |
| 19743 | 7014 | 0.719693084 | 0 | 19771 | 7042 | 0.717732384 | 0 | 19799 | 7070 | 0.716523038 | 0 | 19827 | 7098 | 0.71526147 | -1.42030719 |
| 19744 | 7015 | 0.719693084 | 0 | 19772 | 7043 | 0.717732384 | 0 | 19800 | 7071 | 0.716472097 | 0 | 19828 | 7099 | 0.715161275 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19829 | 7100 | 0.714946649 | 0 | 19857 | 7128 | 0.71366112 | 0 | 19885 | 7156 | 0.712051342 | 0 | 19913 | 7184 | 0.710676266 | 0 |
| 19830 | 7101 | 0.714946649 | 0 | 19858 | 7129 | 0.713550203 | 0 | 19886 | 7157 | 0.712051342 | -0.423517317 | 19914 | 7185 | 0.710676266 | 0 |
| 19831 | 7102 | 0.714946649 | 0 | 19859 | 7130 | 0.713550203 | 0 | 19887 | 7158 | 0.712051342 | -1.361369411 | 19915 | 7186 | 0.710676266 | 0 |
| 19832 | 7103 | 0.714946649 | 0 | 19860 | 7131 | 0.713473964 | 0 | 19888 | 7159 | 0.71190284 | 0 | 19916 | 7187 | 0.710438362 | 0 |
| 19833 | 7104 | 0.714946649 | 0 | 19861 | 7132 | 0.713418339 | 0 | 19889 | 7160 | 0.71190284 | 0 | 19917 | 7188 | 0.710438362 | 0 |
| 19834 | 7105 | 0.714946649 | 0 | 19862 | 7133 | 0.713418339 | 0 | 19890 | 7161 | 0.711810936 | 0 | 19918 | 7189 | 0.710438362 | 0 |
| 19835 | 7106 | 0.714946649 | 0 | 19863 | 7134 | 0.713062506 | 0 | 19891 | 7162 | 0.711810936 | 0 | 19919 | 7190 | 0.710251528 | 0 |
| 19836 | 7107 | 0.714946649 | -0.964690054 | 19864 | 7135 | 0.713062506 | 0 | 19892 | 7163 | 0.711810936 | 0 | 19920 | 7191 | 0.710251528 | 0 |
| 19837 | 7108 | 0.71474582 | -1.615799443 | 19865 | 7136 | 0.713062506 | 0 | 19893 | 7164 | 0.711810936 | 0 | 19921 | 7192 | 0.710251528 | 0 |
| 19838 | 7109 | 0.714660647 | 0 | 19866 | 7137 | 0.713062506 | 0 | 19894 | 7165 | 0.711420559 | 0 | 19922 | 7193 | 0.710251528 | 0 |
| 19839 | 7110 | 0.714660647 | 0 | 19867 | 7138 | 0.713062506 | 0 | 19895 | 7166 | 0.711420559 | 0 | 19923 | 7194 | 0.710100915 | 0 |
| 19840 | 7111 | 0.714583679 | 0 | 19868 | 7139 | 0.713062506 | 0 | 19896 | 7167 | 0.711420559 | 0 | 19924 | 7195 | 0.710100915 | 0 |
| 19841 | 7112 | 0.714450029 | 0 | 19869 | 7140 | 0.713062506 | 0 | 19897 | 7168 | 0.711420559 | -1.248056842 | 19925 | 7196 | 0.709976919 | 0 |
| 19842 | 7113 | 0.714288461 | 0 | 19870 | 7141 | 0.712663887 | 0 | 19898 | 7169 | 0.711186501 | 0 | 19926 | 7197 | 0.709976919 | 0 |
| 19843 | 7114 | 0.714160596 | 0 | 19871 | 7142 | 0.712663887 | 0 | 19899 | 7170 | 0.711186501 | 0 | 19927 | 7198 | 0.709976919 | 0 |
| 19844 | 7115 | 0.714160596 | 0 | 19872 | 7143 | 0.712592744 | 0 | 19900 | 7171 | 0.711186501 | 0 | 19928 | 7199 | 0.709976919 | 0 |
| 19845 | 7116 | 0.714160596 | 0 | 19873 | 7144 | 0.712592744 | 0 | 19901 | 7172 | 0.711186501 | 0 | 19929 | 7200 | 0.709976919 | 0 |
| 19846 | 7117 | 0.714026534 | 0 | 19874 | 7145 | 0.712592744 | 0 | 19902 | 7173 | 0.711117174 | 0 | 19930 | 7201 | 0.709976919 | 0 |
| 19847 | 7118 | 0.713921644 | -0.908313588 | 19875 | 7146 | 0.712592744 | 0 | 19903 | 7174 | 0.711117174 | 0 | 19931 | 7202 | 0.709976919 | 0 |
| 19848 | 7119 | 0.71383734 | 0 | 19876 | 7147 | 0.712592744 | 0 | 19904 | 7175 | 0.710989497 | 0 | 19932 | 7203 | 0.709976919 | 0 |
| 19849 | 7120 | 0.71383734 | 0 | 19877 | 7148 | 0.712592744 | -1.393012692 | 19905 | 7176 | 0.710989497 | 0 | 19933 | 7204 | 0.709873058 | 0 |
| 19850 | 7121 | 0.71383734 | 0 | 19878 | 7149 | 0.712592744 | -1.694042688 | 19906 | 7177 | 0.710989497 | 0 | 19934 | 7205 | 0.709784796 | 0 |
| 19851 | 7122 | 0.71383734 | 0 | 19879 | 7150 | 0.712490689 | 0 | 19907 | 7178 | 0.710874619 | 0 | 19935 | 7206 | 0.709784796 | 0 |
| 19852 | 7123 | 0.71383734 | 0 | 19880 | 7151 | 0.712331985 | 0 | 19908 | 7179 | 0.710874619 | 0 | 19936 | 7207 | 0.709784796 | 0 |
| 19853 | 7124 | 0.71383734 | 0 | 19881 | 7152 | 0.712331985 | 0 | 19909 | 7180 | 0.710821394 | 0 | 19937 | 7208 | 0.709784796 | 0 |
| 19854 | 7125 | 0.71383734 | -0.697937732 | 19882 | 7153 | 0.712051342 | 0 | 19910 | 7181 | 0.710676266 | 0 | 19938 | 7209 | 0.709642846 | 0 |
| 19855 | 7126 | 0.71366112 | 0 | 19883 | 7154 | 0.712051342 | 0 | 19911 | 7182 | 0.710676266 | 0 | 19939 | 7210 | 0.709642846 | 0 |
| 19856 | 7127 | 0.71366112 | 0 | 19884 | 7155 | 0.712051342 | 0 | 19912 | 7183 | 0.710676266 | 0 | 19940 | 7211 | 0.709533686 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 19941 | 7212 | 0.709533686 | 0 | 19969 | 7240 | 0.7086977 | 0 | 19997 | 7268 | 0.707030541 | 0 | 20025 | 7296 | 0.705606623 | 0 |
| 19942 | 7213 | 0.709533686 | -1.363887067 | 19970 | 7241 | 0.7086977 | 0 | 19998 | 7269 | 0.707030541 | 0 | 20026 | 7297 | 0.705606623 | 0 |
| 19943 | 7214 | 0.70944713 | 0 | 19971 | 7242 | 0.7086977 | 0 | 19999 | 7270 | 0.706891899 | 0 | 20027 | 7298 | 0.705606623 | 0 |
| 19944 | 7215 | 0.70944713 | 0 | 19972 | 7243 | 0.7086977 | 0 | 20000 | 7271 | 0.706891899 | 0 | 20028 | 7299 | 0.705606623 | 0 |
| 19945 | 7216 | 0.709376816 | 0 | 19973 | 7244 | 0.7086977 | 0 | 20001 | 7272 | 0.706891899 | 0 | 20029 | 7300 | 0.705606623 | 0 |
| 19946 | 7217 | 0.709376816 | 0 | 19974 | 7245 | 0.7086977 | 0 | 20002 | 7273 | 0.706813556 | 0 | 20030 | 7301 | 0.70531796 | -0.981158169 |
| 19947 | 7218 | 0.709376816 | 0 | 19975 | 7246 | 0.7086977 | -0.852839692 | 20003 | 7274 | 0.706813556 | 0 | 20031 | 7302 | 0.70531796 | -1.157249428 |
| 19948 | 7219 | 0.709376816 | -0.454220567 | 19976 | 7247 | 0.708111212 | 0 | 20004 | 7275 | 0.706813556 | 0 | 20032 | 7303 | 0.705093576 | 0 |
| 19949 | 7220 | 0.709318564 | 0 | 19977 | 7248 | 0.707922866 | 0 | 20005 | 7276 | 0.706813556 | 0 | 20033 | 7304 | 0.704969828 | 0 |
| 19950 | 7221 | 0.709269517 | 0 | 19978 | 7249 | 0.707829979 | 0 | 20006 | 7277 | 0.706728107 | 0 | 20034 | 7305 | 0.704767407 | 0 |
| 19951 | 7222 | 0.7086977 | 0 | 19979 | 7250 | 0.707829979 | 0 | 20007 | 7278 | 0.706531638 | 0 | 20035 | 7306 | 0.704767407 | 0 |
| 19952 | 7223 | 0.7086977 | 0 | 19980 | 7251 | 0.707711787 | 0 | 20008 | 7279 | 0.706531638 | 0 | 20036 | 7307 | 0.704767407 | 0 |
| 19953 | 7224 | 0.7086977 | 0 | 19981 | 7252 | 0.707711787 | 0 | 20009 | 7280 | 0.706531638 | 0 | 20037 | 7308 | 0.704767407 | 0 |
| 19954 | 7225 | 0.7086977 | 0 | 19982 | 7253 | 0.707711787 | 0 | 20010 | 7281 | 0.706531638 | 0 | 20038 | 7309 | 0.704767407 | 0 |
| 19955 | 7226 | 0.7086977 | 0 | 19983 | 7254 | 0.707711787 | 0 | 20011 | 7282 | 0.70629163 | 0 | 20039 | 7310 | 0.704767407 | 0 |
| 19956 | 7227 | 0.7086977 | 0 | 19984 | 7255 | 0.707711787 | 0 | 20012 | 7283 | 0.70629163 | 0 | 20040 | 7311 | 0.704767407 | 0 |
| 19957 | 7228 | 0.7086977 | 0 | 19985 | 7256 | 0.707711787 | -1.293158298 | 20013 | 7284 | 0.706237102 | 0 | 20041 | 7312 | 0.704608818 | 0 |
| 19958 | 7229 | 0.7086977 | 0 | 19986 | 7257 | 0.707556321 | 0 | 20014 | 7285 | 0.706150511 | 0 | 20042 | 7313 | 0.70454174 | 0 |
| 19959 | 7230 | 0.7086977 | 0 | 19987 | 7258 | 0.707342646 | 0 | 20015 | 7286 | 0.706150511 | 0 | 20043 | 7314 | 0.70454174 | 0 |
| 19960 | 7231 | 0.7086977 | 0 | 19988 | 7259 | 0.707342646 | 0 | 20016 | 7287 | 0.706150511 | 0 | 20044 | 7315 | 0.704376326 | 0 |
| 19961 | 7232 | 0.7086977 | 0 | 19989 | 7260 | 0.707342646 | 0 | 20017 | 7288 | 0.706150511 | -0.253326889 | 20045 | 7316 | 0.704376326 | 0 |
| 19962 | 7233 | 0.7086977 | 0 | 19990 | 7261 | 0.707342646 | 0 | 20018 | 7289 | 0.706150511 | -0.70562456 | 20046 | 7317 | 0.704376326 | 0 |
| 19963 | 7234 | 0.7086977 | 0 | 19991 | 7262 | 0.707342646 | -0.678103487 | 20019 | 7290 | 0.705991807 | 0 | 20047 | 7318 | 0.704376326 | 0 |
| 19964 | 7235 | 0.7086977 | 0 | 19992 | 7263 | 0.707202709 | 0 | 20020 | 7291 | 0.705991807 | 0 | 20048 | 7319 | 0.704376326 | 0 |
| 19965 | 7236 | 0.7086977 | 0 | 19993 | 7264 | 0.707030541 | 0 | 20021 | 7292 | 0.7059048 | 0 | 20049 | 7320 | 0.704249876 | 0 |
| 19966 | 7237 | 0.7086977 | 0 | 19994 | 7265 | 0.707030541 | 0 | 20022 | 7293 | 0.7059048 | 0 | 20050 | 7321 | 0.704249876 | -0.054312682 |
| 19967 | 7238 | 0.7086977 | 0 | 19995 | 7266 | 0.707030541 | 0 | 20023 | 7294 | 0.7059048 | -0.966783044 | 20051 | 7322 | 0.704150072 | 0 |
| 19968 | 7239 | 0.7086977 | 0 | 19996 | 7267 | 0.707030541 | 0 | 20024 | 7295 | 0.705606623 | 0 | 20052 | 7323 | 0.704150072 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20053 | 7324 | 0.704150072 | 0 | 20081 | 7352 | 0.702910529 | 0 | 20109 | 7380 | 0.701926139 | -0.801619305 | 20137 | 7408 | 0.700097528 | 0 |
| 20054 | 7325 | 0.704002579 | 0 | 20082 | 7353 | 0.702815518 | 0 | 20110 | 7381 | 0.701842854 | 0 | 20138 | 7409 | 0.700097528 | 0 |
| 20055 | 7326 | 0.704002579 | 0 | 20083 | 7354 | 0.702748368 | 0 | 20111 | 7382 | 0.701842854 | 0 | 20139 | 7410 | 0.699742858 | 0 |
| 20056 | 7327 | 0.704002579 | 0 | 20084 | 7355 | 0.702748368 | 0 | 20112 | 7383 | 0.701842854 | 0 | 20140 | 7411 | 0.69968568 | 0 |
| 20057 | 7328 | 0.704002579 | -1.316172662 | 20085 | 7356 | 0.702748368 | 0 | 20113 | 7384 | 0.701842854 | 0 | 20141 | 7412 | 0.69968568 | 0 |
| 20058 | 7329 | 0.703898817 | 0 | 20086 | 7357 | 0.702748368 | -0.304153683 | 20114 | 7385 | 0.701697142 | 0 | 20142 | 7413 | 0.699606523 | 0 |
| 20059 | 7330 | 0.703898817 | 0 | 20087 | 7358 | 0.702659745 | 0 | 20115 | 7386 | 0.701519116 | 0 | 20143 | 7414 | 0.699606523 | 0 |
| 20060 | 7331 | 0.703898817 | 0 | 20088 | 7359 | 0.702659745 | 0 | 20116 | 7387 | 0.701519116 | -0.066072759 | 20144 | 7415 | 0.699606523 | 0 |
| 20061 | 7332 | 0.703898817 | 0 | 20089 | 7360 | 0.702659745 | 0 | 20117 | 7388 | 0.701134444 | 0 | 20145 | 7416 | 0.699606523 | -1.37381423 |
| 20062 | 7333 | 0.703898817 | 0 | 20090 | 7361 | 0.702537391 | 0 | 20118 | 7389 | 0.701010872 | 0 | 20146 | 7417 | 0.699152382 | 0 |
| 20063 | 7334 | 0.703898817 | 0 | 20091 | 7362 | 0.702537391 | 0 | 20119 | 7390 | 0.701010872 | 0 | 20147 | 7418 | 0.699152382 | 0 |
| 20064 | 7335 | 0.703898817 | 0 | 20092 | 7363 | 0.702537391 | -1.278129308 | 20120 | 7391 | 0.701010872 | 0 | 20148 | 7419 | 0.699152382 | 0 |
| 20065 | 7336 | 0.703821849 | 0 | 20093 | 7364 | 0.702456914 | 0 | 20121 | 7392 | 0.701010872 | 0 | 20149 | 7420 | 0.699152382 | 0 |
| 20066 | 7337 | 0.703821849 | 0 | 20094 | 7365 | 0.702357522 | 0 | 20122 | 7393 | 0.701010872 | 0 | 20150 | 7421 | 0.699090274 | 0 |
| 20067 | 7338 | 0.703821849 | -1.144957254 | 20095 | 7366 | 0.702357522 | 0 | 20123 | 7394 | 0.700872363 | 0 | 20151 | 7422 | 0.698937863 | 0 |
| 20068 | 7339 | 0.7037153 | -1.545796712 | 20096 | 7367 | 0.702357522 | 0 | 20124 | 7395 | 0.700770332 | 0 | 20152 | 7423 | 0.698937863 | 0 |
| 20069 | 7340 | 0.703302668 | 0 | 20097 | 7368 | 0.702357522 | 0 | 20125 | 7396 | 0.700770332 | 0 | 20153 | 7424 | 0.698937863 | 0 |
| 20070 | 7341 | 0.703302668 | 0 | 20098 | 7369 | 0.702231658 | 0 | 20126 | 7397 | 0.700770332 | 0 | 20154 | 7425 | 0.698937863 | 0 |
| 20071 | 7342 | 0.703302668 | 0 | 20099 | 7370 | 0.702231658 | 0 | 20127 | 7398 | 0.700770332 | 0 | 20155 | 7426 | 0.698789412 | 0 |
| 20072 | 7343 | 0.703302668 | 0 | 20100 | 7371 | 0.702231658 | 0 | 20128 | 7399 | 0.700770332 | 0 | 20156 | 7427 | 0.698731105 | 0 |
| 20073 | 7344 | 0.703302668 | 0 | 20101 | 7372 | 0.702067121 | 0 | 20129 | 7400 | 0.700770332 | 0 | 20157 | 7428 | 0.698731105 | 0 |
| 20074 | 7345 | 0.703302668 | 0 | 20102 | 7373 | 0.702067121 | 0 | 20130 | 7401 | 0.700538213 | 0 | 20158 | 7429 | 0.698731105 | 0 |
| 20075 | 7346 | 0.703302668 | 0 | 20103 | 7374 | 0.702067121 | 0 | 20131 | 7402 | 0.700097528 | 0 | 20159 | 7430 | 0.698597373 | 0 |
| 20076 | 7347 | 0.703302668 | 0 | 20104 | 7375 | 0.702067121 | 0 | 20132 | 7403 | 0.700097528 | 0 | 20160 | 7431 | 0.698597373 | 0 |
| 20077 | 7348 | 0.703302668 | 0 | 20105 | 7376 | 0.702067121 | 0 | 20133 | 7404 | 0.700097528 | 0 | 20161 | 7432 | 0.698597373 | 0 |
| 20078 | 7349 | 0.703302668 | 0 | 20106 | 7377 | 0.702067121 | 0 | 20134 | 7405 | 0.700097528 | 0 | 20162 | 7433 | 0.698597373 | 0 |
| 20079 | 7350 | 0.703302668 | 0 | 20107 | 7378 | 0.702067121 | 0 | 20135 | 7406 | 0.700097528 | 0 | 20163 | 7434 | 0.698597373 | 0 |
| 20080 | 7351 | 0.703302668 | -0.381113469 | 20108 | 7379 | 0.702067121 | 0 | 20136 | 7407 | 0.700097528 | 0 | 20164 | 7435 | 0.698503785 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20165 | 7436 | 0.698434625 | 0 | 20193 | 7464 | 0.697312305 | 0 | 20221 | 7492 | 0.696052175 | 0 | 20249 | 7520 | 0.694457261 | 0 |
| 20166 | 7437 | 0.698339249 | 0 | 20194 | 7465 | 0.697159787 | 0 | 20222 | 7493 | 0.695974449 | 0 | 20250 | 7521 | 0.694457261 | -1.395353908 |
| 20167 | 7438 | 0.698339249 | 0 | 20195 | 7466 | 0.697159787 | 0 | 20223 | 7494 | 0.695860475 | 0 | 20251 | 7522 | 0.694207163 | 0 |
| 20168 | 7439 | 0.698339249 | 0 | 20196 | 7467 | 0.697159787 | 0 | 20224 | 7495 | 0.695860475 | 0 | 20252 | 7523 | 0.694088746 | 0 |
| 20169 | 7440 | 0.698339249 | -0.121476158 | 20197 | 7468 | 0.697159787 | 0 | 20225 | 7496 | 0.695860475 | 0 | 20253 | 7524 | 0.694088746 | 0 |
| 20170 | 7441 | 0.698276585 | 0 | 20198 | 7469 | 0.697159787 | 0 | 20226 | 7497 | 0.695860475 | 0 | 20254 | 7525 | 0.694088746 | 0 |
| 20171 | 7442 | 0.697973835 | 0 | 20199 | 7470 | 0.697011942 | 0 | 20227 | 7498 | 0.695860475 | 0 | 20255 | 7526 | 0.694088746 | 0 |
| 20172 | 7443 | 0.697973835 | 0 | 20200 | 7471 | 0.697011942 | 0 | 20228 | 7499 | 0.69567719 | 0 | 20256 | 7527 | 0.693974443 | 0 |
| 20173 | 7444 | 0.697973835 | 0 | 20201 | 7472 | 0.69691587 | 0 | 20229 | 7500 | 0.69567719 | 0 | 20257 | 7528 | 0.693918768 | 0 |
| 20174 | 7445 | 0.697973835 | 0 | 20202 | 7473 | 0.69691587 | 0 | 20230 | 7501 | 0.69567719 | 0 | 20258 | 7529 | 0.69375735 | 0 |
| 20175 | 7446 | 0.697973835 | 0 | 20203 | 7474 | 0.696848427 | 0 | 20231 | 7502 | 0.69567719 | 0 | 20259 | 7530 | 0.69375735 | 0 |
| 20176 | 7447 | 0.697973835 | 0 | 20204 | 7475 | 0.696798477 | 0 | 20232 | 7503 | 0.69567719 | 0 | 20260 | 7531 | 0.69375735 | 0 |
| 20177 | 7448 | 0.697973835 | 0 | 20205 | 7476 | 0.696798477 | 0 | 20233 | 7504 | 0.695588532 | -0.55113058 | 20261 | 7532 | 0.69375735 | 0 |
| 20178 | 7449 | 0.697973835 | 0 | 20206 | 7477 | 0.696798477 | -0.915891437 | 20234 | 7505 | 0.695333739 | 0 | 20262 | 7533 | 0.69375735 | 0 |
| 20179 | 7450 | 0.697973835 | 0 | 20207 | 7478 | 0.696729437 | 0 | 20235 | 7506 | 0.695333739 | 0 | 20263 | 7534 | 0.69375735 | 0 |
| 20180 | 7451 | 0.697973835 | 0 | 20208 | 7479 | 0.696683978 | 0 | 20236 | 7507 | 0.695333739 | 0 | 20264 | 7535 | 0.69375735 | -1.26572005 |
| 20181 | 7452 | 0.697973835 | -0.437594825 | 20209 | 7480 | 0.696463244 | 0 | 20237 | 7508 | 0.695333739 | 0 | 20265 | 7536 | 0.693554362 | -0.757284733 |
| 20182 | 7453 | 0.697757714 | -0.474794512 | 20210 | 7481 | 0.696463244 | 0 | 20238 | 7509 | 0.695333739 | 0 | 20266 | 7537 | 0.693457734 | 0 |
| 20183 | 7454 | 0.697687644 | 0 | 20211 | 7482 | 0.696463244 | 0 | 20239 | 7510 | 0.695333739 | 0 | 20267 | 7538 | 0.693457734 | 0 |
| 20184 | 7455 | 0.697632274 | 0 | 20212 | 7483 | 0.696463244 | 0 | 20240 | 7511 | 0.695333739 | -1.167233649 | 20268 | 7539 | 0.693185534 | 0 |
| 20185 | 7456 | 0.697632274 | 0 | 20213 | 7484 | 0.696463244 | 0 | 20241 | 7512 | 0.69514119 | 0 | 20269 | 7540 | 0.693185534 | 0 |
| 20186 | 7457 | 0.697550339 | -0.513739034 | 20214 | 7485 | 0.696211989 | 0 | 20242 | 7513 | 0.695018003 | 0 | 20270 | 7541 | 0.693185534 | 0 |
| 20187 | 7458 | 0.697550339 | -1.358837074 | 20215 | 7486 | 0.696151363 | 0 | 20243 | 7514 | 0.695018003 | 0 | 20271 | 7542 | 0.693185534 | 0 |
| 20188 | 7459 | 0.69741669 | 0 | 20216 | 7487 | 0.696151363 | -0.248602781 | 20244 | 7515 | 0.694869501 | 0 | 20272 | 7543 | 0.693185534 | 0 |
| 20189 | 7460 | 0.69741669 | 0 | 20217 | 7488 | 0.696151363 | -1.42469404 | 20245 | 7516 | 0.694869501 | 0 | 20273 | 7544 | 0.693185534 | 0 |
| 20190 | 7461 | 0.69741669 | 0 | 20218 | 7489 | 0.696052175 | 0 | 20246 | 7517 | 0.694726758 | -1.378693995 | 20274 | 7545 | 0.693185534 | 0 |
| 20191 | 7462 | 0.697312305 | 0 | 20219 | 7490 | 0.696052175 | 0 | 20247 | 7518 | 0.694457261 | 0 | 20275 | 7546 | 0.693185534 | 0 |
| 20192 | 7463 | 0.697312305 | 0 | 20220 | 7491 | 0.696052175 | 0 | 20248 | 7519 | 0.694457261 | 0 | 20276 | 7547 | 0.693017496 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20277 | 7548 | 0.692937153 | 0 | 20305 | 7576 | 0.691664361 | 0 | 20333 | 7604 | 0.690214294 | 0 | 20361 | 7632 | 0.689284659 | 0 |
| 20278 | 7549 | 0.692709595 | 0 | 20306 | 7577 | 0.691664361 | 0 | 20334 | 7605 | 0.690101212 | 0 | 20362 | 7633 | 0.68923522 | -0.747363435 |
| 20279 | 7550 | 0.692709595 | 0 | 20307 | 7578 | 0.691664361 | 0 | 20335 | 7606 | 0.690101212 | 0 | 20363 | 7634 | 0.689144164 | 0 |
| 20280 | 7551 | 0.692709595 | 0 | 20308 | 7579 | 0.691529675 | 0 | 20336 | 7607 | 0.690101212 | -0.87143618 | 20364 | 7635 | 0.689102144 | 0 |
| 20281 | 7552 | 0.692709595 | 0 | 20309 | 7580 | 0.691529675 | 0 | 20337 | 7608 | 0.689997202 | 0 | 20365 | 7636 | 0.689062229 | 0 |
| 20282 | 7553 | 0.692709595 | 0 | 20310 | 7581 | 0.691403445 | 0 | 20338 | 7609 | 0.689997202 | 0 | 20366 | 7637 | 0.689024265 | 0 |
| 20283 | 7554 | 0.692709595 | 0 | 20311 | 7582 | 0.691403445 | -0.694042688 | 20339 | 7610 | 0.689997202 | 0 | 20367 | 7638 | 0.689024265 | 0 |
| 20284 | 7555 | 0.692500347 | 0 | 20312 | 7583 | 0.691403445 | -1.472193938 | 20340 | 7611 | 0.689997202 | 0 | 20368 | 7639 | 0.688920742 | 0 |
| 20285 | 7556 | 0.692500347 | -1.363887067 | 20313 | 7584 | 0.691284899 | -1.485676446 | 20341 | 7612 | 0.689901214 | 0 | 20369 | 7640 | 0.688776415 | -1.65986707 |
| 20286 | 7557 | 0.692434289 | 0 | 20314 | 7585 | 0.691173355 | 0 | 20342 | 7613 | 0.689901214 | 0 | 20370 | 7641 | 0.687508401 | 0 |
| 20287 | 7558 | 0.692307284 | 0 | 20315 | 7586 | 0.691173355 | 0 | 20343 | 7614 | 0.689901214 | 0 | 20371 | 7642 | 0.687508401 | 0 |
| 20288 | 7559 | 0.692307284 | 0 | 20316 | 7587 | 0.691173355 | 0 | 20344 | 7615 | 0.689901214 | 0 | 20372 | 7643 | 0.687508401 | 0 |
| 20289 | 7560 | 0.692307284 | 0 | 20317 | 7588 | 0.690968933 | 0 | 20345 | 7616 | 0.689812356 | 0 | 20373 | 7644 | 0.687508401 | 0 |
| 20290 | 7561 | 0.692307284 | 0 | 20318 | 7589 | 0.690968933 | 0 | 20346 | 7617 | 0.689812356 | 0 | 20374 | 7645 | 0.687508401 | 0 |
| 20291 | 7562 | 0.692307284 | 0 | 20319 | 7590 | 0.690968933 | 0 | 20347 | 7618 | 0.689812356 | -1.098968817 | 20375 | 7646 | 0.687508401 | 0 |
| 20292 | 7563 | 0.692128599 | 0 | 20320 | 7591 | 0.690968933 | 0 | 20348 | 7619 | 0.689729861 | 0 | 20376 | 7647 | 0.687508401 | 0 |
| 20293 | 7564 | 0.692128599 | 0 | 20321 | 7592 | 0.690968933 | 0 | 20349 | 7620 | 0.689729861 | 0 | 20377 | 7648 | 0.687508401 | 0 |
| 20294 | 7565 | 0.692128599 | 0 | 20322 | 7593 | 0.690875042 | -0.933714096 | 20350 | 7621 | 0.689729861 | 0 | 20378 | 7649 | 0.687508401 | 0 |
| 20295 | 7566 | 0.691962743 | 0 | 20323 | 7594 | 0.690786111 | 0 | 20351 | 7622 | 0.68965307 | -0.653041083 | 20379 | 7650 | 0.687508401 | 0 |
| 20296 | 7567 | 0.691962743 | 0 | 20324 | 7595 | 0.690621637 | 0 | 20352 | 7623 | 0.68965307 | -1.431192333 | 20380 | 7651 | 0.687508401 | 0 |
| 20297 | 7568 | 0.691962743 | 0 | 20325 | 7596 | 0.690621637 | 0 | 20353 | 7624 | 0.68958141 | 0 | 20381 | 7652 | 0.687508401 | 0 |
| 20298 | 7569 | 0.691858633 | -0.043754727 | 20326 | 7597 | 0.69047288 | 0 | 20354 | 7625 | 0.68958141 | 0 | 20382 | 7653 | 0.687508401 | 0 |
| 20299 | 7570 | 0.691808382 | 0 | 20327 | 7598 | 0.690337691 | 0 | 20355 | 7626 | 0.68958141 | 0 | 20383 | 7654 | 0.687508401 | 0 |
| 20300 | 7571 | 0.691808382 | 0 | 20328 | 7599 | 0.690337691 | 0 | 20356 | 7627 | 0.68958141 | 0 | 20384 | 7655 | 0.687508401 | 0 |
| 20301 | 7572 | 0.691808382 | 0 | 20329 | 7600 | 0.690337691 | 0 | 20357 | 7628 | 0.689451556 | 0 | 20385 | 7656 | 0.687508401 | 0 |
| 20302 | 7573 | 0.691808382 | 0 | 20330 | 7601 | 0.690214294 | 0 | 20358 | 7629 | 0.689451556 | 0 | 20386 | 7657 | 0.687508401 | 0 |
| 20303 | 7574 | 0.691664361 | 0 | 20331 | 7602 | 0.690214294 | 0 | 20359 | 7630 | 0.689337012 | 0 | 20387 | 7658 | 0.687508401 | 0 |
| 20304 | 7575 | 0.691664361 | 0 | 20332 | 7603 | 0.690214294 | 0 | 20360 | 7631 | 0.689337012 | 0 | 20388 | 7659 | 0.687508401 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20389 | 7660 | 0.687508401 | 0 | 20417 | 7688 | 0.687508401 | 0 | 20445 | 7716 | 0.685573901 | 0 | 20473 | 7744 | 0.684255244 | 0 |
| 20390 | 7661 | 0.687508401 | 0 | 20418 | 7689 | 0.687508401 | 0 | 20446 | 7717 | 0.685511641 | 0 | 20474 | 7745 | 0.684255244 | 0 |
| 20391 | 7662 | 0.687508401 | 0 | 20419 | 7690 | 0.687508401 | 0 | 20447 | 7718 | 0.685445241 | 0 | 20475 | 7746 | 0.684167658 | 0 |
| 20392 | 7663 | 0.687508401 | 0 | 20420 | 7691 | 0.687508401 | 0 | 20448 | 7719 | 0.685445241 | 0 | 20476 | 7747 | 0.684075225 | 0 |
| 20393 | 7664 | 0.687508401 | 0 | 20421 | 7692 | 0.687508401 | 0 | 20449 | 7720 | 0.685374272 | 0 | 20477 | 7748 | 0.684075225 | 0 |
| 20394 | 7665 | 0.687508401 | 0 | 20422 | 7693 | 0.687508401 | 0 | 20450 | 7721 | 0.685374272 | 0 | 20478 | 7749 | 0.684075225 | 0 |
| 20395 | 7666 | 0.687508401 | 0 | 20423 | 7694 | 0.687508401 | 0 | 20451 | 7722 | 0.685298246 | 0 | 20479 | 7750 | 0.683977532 | 0 |
| 20396 | 7667 | 0.687508401 | 0 | 20424 | 7695 | 0.687508401 | 0 | 20452 | 7723 | 0.685298246 | 0 | 20480 | 7751 | 0.683977532 | 0 |
| 20397 | 7668 | 0.687508401 | 0 | 20425 | 7696 | 0.687508401 | 0 | 20453 | 7724 | 0.685216604 | 0 | 20481 | 7752 | 0.683874116 | 0 |
| 20398 | 7669 | 0.687508401 | 0 | 20426 | 7697 | 0.687508401 | 0 | 20454 | 7725 | 0.685128699 | 0 | 20482 | 7753 | 0.683874116 | 0 |
| 20399 | 7670 | 0.687508401 | 0 | 20427 | 7698 | 0.687508401 | 0 | 20455 | 7726 | 0.685128699 | 0 | 20483 | 7754 | 0.683874116 | 0 |
| 20400 | 7671 | 0.687508401 | 0 | 20428 | 7699 | 0.687508401 | 0 | 20456 | 7727 | 0.685033782 | 0 | 20484 | 7755 | 0.68376446 | 0 |
| 20401 | 7672 | 0.687508401 | 0 | 20429 | 7700 | 0.687508401 | 0 | 20457 | 7728 | 0.685033782 | 0 | 20485 | 7756 | 0.68376446 | 0 |
| 20402 | 7673 | 0.687508401 | 0 | 20430 | 7701 | 0.687508401 | 0 | 20458 | 7729 | 0.685033782 | 0 | 20486 | 7757 | 0.68364798 | 0 |
| 20403 | 7674 | 0.687508401 | 0 | 20431 | 7702 | 0.687508401 | 0 | 20459 | 7730 | 0.685033782 | 0 | 20487 | 7758 | 0.68364798 | 0 |
| 20404 | 7675 | 0.687508401 | 0 | 20432 | 7703 | 0.687508401 | 0 | 20460 | 7731 | 0.685033782 | 0 | 20488 | 7759 | 0.68364798 | 0 |
| 20405 | 7676 | 0.687508401 | 0 | 20433 | 7704 | 0.687508401 | 0 | 20461 | 7732 | 0.684930978 | 0 | 20489 | 7760 | 0.68364798 | 0 |
| 20406 | 7677 | 0.687508401 | 0 | 20434 | 7705 | 0.687508401 | 0 | 20462 | 7733 | 0.684930978 | 0 | 20490 | 7761 | 0.68364798 | 0 |
| 20407 | 7678 | 0.687508401 | 0 | 20435 | 7706 | 0.687508401 | -0.515007048 | 20463 | 7734 | 0.684697424 | 0 | 20491 | 7762 | 0.68352402 | 0 |
| 20408 | 7679 | 0.687508401 | 0 | 20436 | 7707 | 0.687508401 | -1.147030263 | 20464 | 7735 | 0.68456402 | 0 | 20492 | 7763 | 0.68352402 | 0 |
| 20409 | 7680 | 0.687508401 | 0 | 20437 | 7708 | 0.687508401 | -1.271968999 | 20465 | 7736 | 0.68456402 | 0 | 20493 | 7764 | 0.68352402 | 0 |
| 20410 | 7681 | 0.687508401 | 0 | 20438 | 7709 | 0.687508401 | -1.5507226 | 20466 | 7737 | 0.68456402 | 0 | 20494 | 7765 | 0.683391835 | 0 |
| 20411 | 7682 | 0.687508401 | 0 | 20439 | 7710 | 0.687508401 | -0.985179443 | 20467 | 7738 | 0.684417324 | 0 | 20495 | 7766 | 0.683391835 | 0 |
| 20412 | 7683 | 0.687508401 | 0 | 20440 | 7711 | 0.685960113 | 0 | 20468 | 7739 | 0.684417324 | 0 | 20496 | 7767 | 0.683391835 | -1.452176825 |
| 20413 | 7684 | 0.687508401 | 0 | 20441 | 7712 | 0.685960113 | -1.574547284 | 20469 | 7740 | 0.684417324 | 0 | 20497 | 7768 | 0.683250578 | 0 |
| 20414 | 7685 | 0.687508401 | 0 | 20442 | 7713 | 0.685687457 | 0 | 20470 | 7741 | 0.684417324 | 0 | 20498 | 7769 | 0.683099282 | 0 |
| 20415 | 7686 | 0.687508401 | 0 | 20443 | 7714 | 0.685573901 | 0 | 20471 | 7742 | 0.684417324 | 0 | 20499 | 7770 | 0.683099282 | 0 |
| 20416 | 7687 | 0.687508401 | 0 | 20444 | 7715 | 0.685573901 | 0 | 20472 | 7743 | 0.684255244 | 0 | 20500 | 7771 | 0.682936838 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20501 | 7772 | 0.682936838 | 0 | 20529 | 7800 | 0.681904524 | 0 | 20557 | 7828 | 0.679821572 | 0 | 20585 | 7856 | 0.678522677 | 0 |
| 20502 | 7773 | 0.682936838 | 0 | 20530 | 7801 | 0.681904524 | 0 | 20558 | 7829 | 0.679821572 | 0 | 20586 | 7857 | 0.678412896 | 0 |
| 20503 | 7774 | 0.682936838 | 0 | 20531 | 7802 | 0.681775057 | 0 | 20559 | 7830 | 0.679821572 | 0 | 20587 | 7858 | 0.678412896 | 0 |
| 20504 | 7775 | 0.682936838 | 0 | 20532 | 7803 | 0.681730562 | -1.180836825 | 20560 | 7831 | 0.679821572 | 0 | 20588 | 7859 | 0.678412896 | 0 |
| 20505 | 7776 | 0.682936838 | -1.105844335 | 20533 | 7804 | 0.681639467 | 0 | 20561 | 7832 | 0.679821572 | -0.802534573 | 20589 | 7860 | 0.678412896 | 0 |
| 20506 | 7777 | 0.682761966 | 0 | 20534 | 7805 | 0.681545454 | -0.354320292 | 20562 | 7833 | 0.679821572 | -1.006654556 | 20590 | 7861 | 0.678300399 | 0 |
| 20507 | 7778 | 0.682761966 | 0 | 20535 | 7806 | 0.681348092 | 0 | 20563 | 7834 | 0.679575861 | 0 | 20591 | 7862 | 0.678300399 | 0 |
| 20508 | 7779 | 0.682761966 | 0 | 20536 | 7807 | 0.681348092 | 0 | 20564 | 7835 | 0.679575861 | 0 | 20592 | 7863 | 0.678300399 | 0 |
| 20509 | 7780 | 0.682761966 | 0 | 20537 | 7808 | 0.681348092 | 0 | 20565 | 7836 | 0.679575861 | 0 | 20593 | 7864 | 0.678300399 | 0 |
| 20510 | 7781 | 0.682761966 | 0 | 20538 | 7809 | 0.681348092 | 0 | 20566 | 7837 | 0.679490429 | 0 | 20594 | 7865 | 0.678300399 | 0 |
| 20511 | 7782 | 0.682761966 | 0 | 20539 | 7810 | 0.681348092 | 0 | 20567 | 7838 | 0.679490429 | 0 | 20595 | 7866 | 0.678300399 | 0 |
| 20512 | 7783 | 0.682761966 | -0.390658787 | 20540 | 7811 | 0.681348092 | -1.278129308 | 20568 | 7839 | 0.679490429 | -0.061931211 | 20596 | 7867 | 0.678300399 | 0 |
| 20513 | 7784 | 0.682573183 | 0 | 20541 | 7812 | 0.681026274 | 0 | 20569 | 7840 | 0.679490429 | -1.340684812 | 20597 | 7868 | 0.678066845 | 0 |
| 20514 | 7785 | 0.682368761 | 0 | 20542 | 7813 | 0.681026274 | 0 | 20570 | 7841 | 0.679313922 | 0 | 20598 | 7869 | 0.678066845 | 0 |
| 20515 | 7786 | 0.682146673 | 0 | 20543 | 7814 | 0.681026274 | 0 | 20571 | 7842 | 0.67912947 | 0 | 20599 | 7870 | 0.678066845 | 0 |
| 20516 | 7787 | 0.682146673 | 0 | 20544 | 7815 | 0.680668977 | 0 | 20572 | 7843 | 0.67912947 | 0 | 20600 | 7871 | 0.678066845 | 0 |
| 20517 | 7788 | 0.682146673 | 0 | 20545 | 7816 | 0.680668977 | 0 | 20573 | 7844 | 0.67912947 | 0 | 20601 | 7872 | 0.678066845 | 0 |
| 20518 | 7789 | 0.682146673 | 0 | 20546 | 7817 | 0.680668977 | 0 | 20574 | 7845 | 0.678734477 | 0 | 20602 | 7873 | 0.678066845 | 0 |
| 20519 | 7790 | 0.682146673 | 0 | 20547 | 7818 | 0.680269992 | 0 | 20575 | 7846 | 0.678734477 | 0 | 20603 | 7874 | 0.678066845 | -1.094323912 |
| 20520 | 7791 | 0.682146673 | 0 | 20548 | 7819 | 0.680269992 | 0 | 20576 | 7847 | 0.678734477 | 0 | 20604 | 7875 | 0.677821134 | 0 |
| 20521 | 7792 | 0.682146673 | 0 | 20549 | 7820 | 0.680126447 | 0 | 20577 | 7848 | 0.678734477 | 0 | 20605 | 7876 | 0.677821134 | 0 |
| 20522 | 7793 | 0.682068316 | 0 | 20550 | 7821 | 0.680126447 | -1.07523097 | 20578 | 7849 | 0.678734477 | 0 | 20606 | 7877 | 0.677821134 | 0 |
| 20523 | 7794 | 0.682068316 | 0 | 20551 | 7822 | 0.680052519 | 0 | 20579 | 7850 | 0.678734477 | 0 | 20607 | 7878 | 0.677821134 | 0 |
| 20524 | 7795 | 0.681904524 | 0 | 20552 | 7823 | 0.679821572 | 0 | 20580 | 7851 | 0.678734477 | 0 | 20608 | 7879 | 0.677821134 | 0 |
| 20525 | 7796 | 0.681904524 | 0 | 20553 | 7824 | 0.679821572 | 0 | 20581 | 7852 | 0.678734477 | 0 | 20609 | 7880 | 0.677821134 | 0 |
| 20526 | 7797 | 0.681904524 | 0 | 20554 | 7825 | 0.679821572 | 0 | 20582 | 7853 | 0.678734477 | 0 | 20610 | 7881 | 0.677821134 | 0 |
| 20527 | 7798 | 0.681904524 | 0 | 20555 | 7826 | 0.679821572 | 0 | 20583 | 7854 | 0.678734477 | 0 | 20611 | 7882 | 0.677821134 | -1.560409868 |
| 20528 | 7799 | 0.681904524 | 0 | 20556 | 7827 | 0.679821572 | 0 | 20584 | 7855 | 0.678734477 | -1.000902227 | 20612 | 7883 | 0.677693419 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20613 | 7884 | 0.677693419 | -1.077663999 | 20641 | 7912 | 0.676568415 | 0 | 20669 | 7940 | 0.675273945 | 0 | 20697 | 7968 | 0.673935594 | 0 |
| 20614 | 7885 | 0.677615161 | 0 | 20642 | 7913 | 0.676568415 | -0.82697703 | 20670 | 7941 | 0.675273945 | 0 | 20698 | 7969 | 0.673935594 | 0 |
| 20615 | 7886 | 0.677289236 | 0 | 20643 | 7914 | 0.676372035 | 0 | 20671 | 7942 | 0.675273945 | 0 | 20699 | 7970 | 0.673935594 | 0 |
| 20616 | 7887 | 0.677289236 | 0 | 20644 | 7915 | 0.676372035 | 0 | 20672 | 7943 | 0.675273945 | 0 | 20700 | 7971 | 0.673631998 | 0 |
| 20617 | 7888 | 0.677289236 | 0 | 20645 | 7916 | 0.676372035 | 0 | 20673 | 7944 | 0.675273945 | 0 | 20701 | 7972 | 0.673631998 | 0 |
| 20618 | 7889 | 0.677289236 | 0 | 20646 | 7917 | 0.676372035 | 0 | 20674 | 7945 | 0.675273945 | 0 | 20702 | 7973 | 0.673631998 | 0 |
| 20619 | 7890 | 0.677289236 | 0 | 20647 | 7918 | 0.676372035 | 0 | 20675 | 7946 | 0.674964728 | 0 | 20703 | 7974 | 0.673631998 | 0 |
| 20620 | 7891 | 0.677289236 | 0 | 20648 | 7919 | 0.676227391 | 0 | 20676 | 7947 | 0.674919274 | -1.515007048 | 20704 | 7975 | 0.673631998 | 0 |
| 20621 | 7892 | 0.677289236 | 0 | 20649 | 7920 | 0.676168475 | 0 | 20677 | 7948 | 0.674858153 | 0 | 20705 | 7976 | 0.67342194 | 0 |
| 20622 | 7893 | 0.677289236 | 0 | 20650 | 7921 | 0.676168475 | -1.112612698 | 20678 | 7949 | 0.674858153 | 0 | 20706 | 7977 | 0.67342194 | 0 |
| 20623 | 7894 | 0.677289236 | 0 | 20651 | 7922 | 0.676116417 | 0 | 20679 | 7950 | 0.674858153 | -1.44598725 | 20707 | 7978 | 0.67342194 | 0 |
| 20624 | 7895 | 0.677289236 | 0 | 20652 | 7923 | 0.676028583 | 0 | 20680 | 7951 | 0.67477158 | 0 | 20708 | 7979 | 0.67342194 | 0 |
| 20625 | 7896 | 0.677289236 | 0 | 20653 | 7924 | 0.676028583 | 0 | 20681 | 7952 | 0.67477158 | 0 | 20709 | 7980 | 0.67342194 | 0 |
| 20626 | 7897 | 0.677042967 | 0 | 20654 | 7925 | 0.676028583 | 0 | 20682 | 7953 | 0.67477158 | 0 | 20710 | 7981 | 0.67342194 | 0 |
| 20627 | 7898 | 0.677000764 | 0 | 20655 | 7926 | 0.676028583 | 0 | 20683 | 7954 | 0.674639475 | 0 | 20711 | 7982 | 0.673150251 | 0 |
| 20628 | 7899 | 0.676941104 | -1.142874303 | 20656 | 7927 | 0.675926529 | 0 | 20684 | 7955 | 0.674639475 | 0 | 20712 | 7983 | 0.673150251 | 0 |
| 20629 | 7900 | 0.676850333 | 0 | 20657 | 7928 | 0.675926529 | -1.5507226 | 20685 | 7956 | 0.674639475 | 0 | 20713 | 7984 | 0.672982148 | 0 |
| 20630 | 7901 | 0.676850333 | 0 | 20658 | 7929 | 0.675848789 | 0 | 20686 | 7957 | 0.674639475 | 0 | 20714 | 7985 | 0.672982148 | 0 |
| 20631 | 7902 | 0.676850333 | 0 | 20659 | 7930 | 0.675848789 | 0 | 20687 | 7958 | 0.674639475 | 0 | 20715 | 7986 | 0.672982148 | 0 |
| 20632 | 7903 | 0.676850333 | 0 | 20660 | 7931 | 0.675848789 | 0 | 20688 | 7959 | 0.674639475 | 0 | 20716 | 7987 | 0.672982148 | 0 |
| 20633 | 7904 | 0.676850333 | 0 | 20661 | 7932 | 0.675848789 | 0 | 20689 | 7960 | 0.674543424 | 0 | 20717 | 7988 | 0.672867875 | 0 |
| 20634 | 7905 | 0.676850333 | 0 | 20662 | 7933 | 0.675738183 | 0 | 20690 | 7961 | 0.674413103 | 0 | 20718 | 7989 | 0.672867875 | 0 |
| 20635 | 7906 | 0.676850333 | 0 | 20663 | 7934 | 0.675738183 | 0 | 20691 | 7962 | 0.674413103 | 0 | 20719 | 7990 | 0.672867875 | 0 |
| 20636 | 7907 | 0.676695532 | 0 | 20664 | 7935 | 0.675738183 | 0 | 20692 | 7963 | 0.674226189 | 0 | 20720 | 7991 | 0.672785144 | 0 |
| 20637 | 7908 | 0.676695532 | 0 | 20665 | 7936 | 0.675609178 | 0 | 20693 | 7964 | 0.674226189 | -1.345949052 | 20721 | 7992 | 0.672785144 | 0 |
| 20638 | 7909 | 0.676695532 | 0 | 20666 | 7937 | 0.675273945 | 0 | 20694 | 7965 | 0.67414444 | 0 | 20722 | 7993 | 0.672785144 | 0 |
| 20639 | 7910 | 0.676568415 | 0 | 20667 | 7938 | 0.675273945 | 0 | 20695 | 7966 | 0.67414444 | 0 | 20723 | 7994 | 0.672785144 | 0 |
| 20640 | 7911 | 0.676568415 | 0 | 20668 | 7939 | 0.675273945 | 0 | 20696 | 7967 | 0.673935594 | 0 | 20724 | 7995 | 0.672268435 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20725 | 7996 | 0.672268435 | 0 | 20753 | 8024 | 0.671388405 | 0 | 20781 | 8052 | 0.670400498 | 0 | 20809 | 8080 | 0.668826188 | 0 |
| 20726 | 7997 | 0.672268435 | 0 | 20754 | 8025 | 0.671388405 | 0 | 20782 | 8053 | 0.670400498 | -0.590106898 | 20810 | 8081 | 0.668826188 | 0 |
| 20727 | 7998 | 0.672268435 | 0 | 20755 | 8026 | 0.671271202 | 0 | 20783 | 8054 | 0.670134305 | 0 | 20811 | 8082 | 0.668826188 | 0 |
| 20728 | 7999 | 0.672268435 | 0 | 20756 | 8027 | 0.671271202 | 0 | 20784 | 8055 | 0.670134305 | 0 | 20812 | 8083 | 0.668826188 | 0 |
| 20729 | 8000 | 0.672268435 | 0 | 20757 | 8028 | 0.671271202 | 0 | 20785 | 8056 | 0.670134305 | 0 | 20813 | 8084 | 0.668826188 | 0 |
| 20730 | 8001 | 0.672268435 | 0 | 20758 | 8029 | 0.671271202 | 0 | 20786 | 8057 | 0.670134305 | 0 | 20814 | 8085 | 0.668826188 | -0.92747331 |
| 20731 | 8002 | 0.672268435 | 0 | 20759 | 8030 | 0.671271202 | 0 | 20787 | 8058 | 0.670134305 | -0.106412412 | 20815 | 8086 | 0.668668578 | 0 |
| 20732 | 8003 | 0.672268435 | 0 | 20760 | 8031 | 0.671271202 | 0 | 20788 | 8059 | 0.669910269 | 0 | 20816 | 8087 | 0.668540562 | 0 |
| 20733 | 8004 | 0.672268435 | 0 | 20761 | 8032 | 0.671117985 | 0 | 20789 | 8060 | 0.669779634 | 0 | 20817 | 8088 | 0.668540562 | 0 |
| 20734 | 8005 | 0.672268435 | 0 | 20762 | 8033 | 0.671117985 | 0 | 20790 | 8061 | 0.669779634 | 0 | 20818 | 8089 | 0.668540562 | -0.591966834 |
| 20735 | 8006 | 0.672268435 | 0 | 20763 | 8034 | 0.670909139 | 0 | 20791 | 8062 | 0.669633677 | 0 | 20819 | 8090 | 0.66843452 | 0 |
| 20736 | 8007 | 0.672268435 | 0 | 20764 | 8035 | 0.670909139 | 0 | 20792 | 8063 | 0.669633677 | 0 | 20820 | 8091 | 0.668345242 | 0 |
| 20737 | 8008 | 0.672268435 | 0 | 20765 | 8036 | 0.670909139 | 0 | 20793 | 8064 | 0.669633677 | 0 | 20821 | 8092 | 0.668345242 | 0 |
| 20738 | 8009 | 0.672268435 | 0 | 20766 | 8037 | 0.670909139 | 0 | 20794 | 8065 | 0.669633677 | 0 | 20822 | 8093 | 0.668345242 | 0 |
| 20739 | 8010 | 0.672268435 | 0 | 20767 | 8038 | 0.670909139 | 0 | 20795 | 8066 | 0.669633677 | 0 | 20823 | 8094 | 0.668345242 | 0 |
| 20740 | 8011 | 0.672268435 | -1.190298953 | 20768 | 8039 | 0.670909139 | -0.216017594 | 20796 | 8067 | 0.669633677 | 0 | 20824 | 8095 | 0.668345242 | 0 |
| 20741 | 8012 | 0.671920303 | 0 | 20769 | 8040 | 0.670721984 | 0 | 20797 | 8068 | 0.669503979 | 0 | 20825 | 8096 | 0.668345242 | -0.038406843 |
| 20742 | 8013 | 0.671785617 | -0.331895446 | 20770 | 8041 | 0.670721984 | 0 | 20798 | 8069 | 0.669503979 | 0 | 20826 | 8097 | 0.668203246 | 0 |
| 20743 | 8014 | 0.671714134 | 0 | 20771 | 8042 | 0.670721984 | 0 | 20799 | 8070 | 0.669503979 | 0 | 20827 | 8098 | 0.668203246 | 0 |
| 20744 | 8015 | 0.671714134 | 0 | 20772 | 8043 | 0.670721984 | 0 | 20800 | 8071 | 0.669283581 | 0 | 20828 | 8099 | 0.668203246 | 0 |
| 20745 | 8016 | 0.671617806 | 0 | 20773 | 8044 | 0.670721984 | 0 | 20801 | 8072 | 0.669283581 | 0 | 20829 | 8100 | 0.668203246 | 0 |
| 20746 | 8017 | 0.671617806 | 0 | 20774 | 8045 | 0.670721984 | 0 | 20802 | 8073 | 0.669283581 | 0 | 20830 | 8101 | 0.668203246 | -0.554515589 |
| 20747 | 8018 | 0.671480956 | 0 | 20775 | 8046 | 0.670607651 | 0 | 20803 | 8074 | 0.669283581 | 0 | 20831 | 8102 | 0.66809536 | 0 |
| 20748 | 8019 | 0.671480956 | 0 | 20776 | 8047 | 0.670607651 | 0 | 20804 | 8075 | 0.669283581 | -1.466285079 | 20832 | 8103 | 0.66809536 | 0 |
| 20749 | 8020 | 0.671480956 | 0 | 20777 | 8048 | 0.670607651 | 0 | 20805 | 8076 | 0.669024995 | 0 | 20833 | 8104 | 0.66809536 | 0 |
| 20750 | 8021 | 0.671480956 | 0 | 20778 | 8049 | 0.670475062 | 0 | 20806 | 8077 | 0.669024995 | 0 | 20834 | 8105 | 0.66809536 | -0.485202066 |
| 20751 | 8022 | 0.671480956 | 0 | 20779 | 8050 | 0.670475062 | 0 | 20807 | 8078 | 0.669024995 | 0 | 20835 | 8106 | 0.66809536 | -1.388292053 |
| 20752 | 8023 | 0.671480956 | 0 | 20780 | 8051 | 0.670475062 | 0 | 20808 | 8079 | 0.669024995 | 0 | 20836 | 8107 | 0.668010611 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20837 | 8108 | 0.668010611 | 0 | 20865 | 8136 | 0.666688557 | 0 | 20893 | 8164 | 0.665514107 | -0.490257938 | 20921 | 8192 | 0.664027305 | 0 |
| 20838 | 8109 | 0.668010611 | 0 | 20866 | 8137 | 0.666624836 | 0 | 20894 | 8165 | 0.665232006 | 0 | 20922 | 8193 | 0.664027305 | 0 |
| 20839 | 8110 | 0.668010611 | 0 | 20867 | 8138 | 0.666624836 | -0.755250563 | 20895 | 8166 | 0.665232006 | 0 | 20923 | 8194 | 0.664027305 | 0 |
| 20840 | 8111 | 0.667942278 | 0 | 20868 | 8139 | 0.666546422 | 0 | 20896 | 8167 | 0.665232006 | 0 | 20924 | 8195 | 0.664027305 | 0 |
| 20841 | 8112 | 0.667305015 | 0 | 20869 | 8140 | 0.666447573 | 0 | 20897 | 8168 | 0.665232006 | 0 | 20925 | 8196 | 0.663885356 | 0 |
| 20842 | 8113 | 0.667305015 | 0 | 20870 | 8141 | 0.666447573 | 0 | 20898 | 8169 | 0.665232006 | 0 | 20926 | 8197 | 0.663885356 | 0 |
| 20843 | 8114 | 0.667305015 | 0 | 20871 | 8142 | 0.666447573 | 0 | 20899 | 8170 | 0.665117129 | 0 | 20927 | 8198 | 0.663885356 | 0 |
| 20844 | 8115 | 0.667305015 | 0 | 20872 | 8143 | 0.666447573 | 0 | 20900 | 8171 | 0.664844416 | 0 | 20928 | 8199 | 0.663730555 | 0 |
| 20845 | 8116 | 0.667305015 | 0 | 20873 | 8144 | 0.666447573 | 0 | 20901 | 8172 | 0.664844416 | 0 | 20929 | 8200 | 0.663730555 | 0 |
| 20846 | 8117 | 0.667305015 | 0 | 20874 | 8145 | 0.666447573 | 0 | 20902 | 8173 | 0.664844416 | 0 | 20930 | 8201 | 0.663730555 | 0 |
| 20847 | 8118 | 0.667305015 | 0 | 20875 | 8146 | 0.666145349 | 0 | 20903 | 8174 | 0.664844416 | 0 | 20931 | 8202 | 0.663374721 | 0 |
| 20848 | 8119 | 0.667305015 | 0 | 20876 | 8147 | 0.666145349 | 0 | 20904 | 8175 | 0.664844416 | 0 | 20932 | 8203 | 0.663374721 | 0 |
| 20849 | 8120 | 0.667305015 | 0 | 20877 | 8148 | 0.666145349 | 0 | 20905 | 8176 | 0.664844416 | 0 | 20933 | 8204 | 0.663374721 | 0 |
| 20850 | 8121 | 0.667305015 | 0 | 20878 | 8149 | 0.666145349 | -0.444599726 | 20906 | 8177 | 0.664844416 | 0 | 20934 | 8205 | 0.663374721 | 0 |
| 20851 | 8122 | 0.667305015 | 0 | 20879 | 8150 | 0.666033288 | 0 | 20907 | 8178 | 0.664590666 | 0 | 20935 | 8206 | 0.663374721 | 0 |
| 20852 | 8123 | 0.667305015 | 0 | 20880 | 8151 | 0.665897252 | 0 | 20908 | 8179 | 0.664590666 | 0 | 20936 | 8207 | 0.663374721 | 0 |
| 20853 | 8124 | 0.667305015 | 0 | 20881 | 8152 | 0.665897252 | 0 | 20909 | 8180 | 0.664590666 | -0.678103487 | 20937 | 8208 | 0.663374721 | 0 |
| 20854 | 8125 | 0.667305015 | 0 | 20882 | 8153 | 0.665897252 | 0 | 20910 | 8181 | 0.664494038 | 0 | 20938 | 8209 | 0.663374721 | 0 |
| 20855 | 8126 | 0.667305015 | 0 | 20883 | 8154 | 0.665789151 | -1.282692865 | 20911 | 8182 | 0.664494038 | 0 | 20939 | 8210 | 0.663374721 | 0 |
| 20856 | 8127 | 0.667305015 | 0 | 20884 | 8155 | 0.665728627 | 0 | 20912 | 8183 | 0.664374824 | -0.967200434 | 20940 | 8211 | 0.663374721 | 0 |
| 20857 | 8128 | 0.667305015 | -0.417111122 | 20885 | 8156 | 0.665728627 | 0 | 20913 | 8184 | 0.66427856 | 0 | 20941 | 8212 | 0.663374721 | -1.171163942 |
| 20858 | 8129 | 0.667305015 | -1.121476158 | 20886 | 8157 | 0.665728627 | 0 | 20914 | 8185 | 0.66427856 | 0 | 20942 | 8213 | 0.663374721 | -1.472193938 |
| 20859 | 8130 | 0.667305015 | -1.246414895 | 20887 | 8158 | 0.665728627 | -0.691688782 | 20915 | 8186 | 0.66427856 | 0 | 20943 | 8214 | 0.663008073 | 0 |
| 20860 | 8131 | 0.667305015 | -1.371353631 | 20888 | 8159 | 0.665663068 | -1.248056842 | 20916 | 8187 | 0.66427856 | 0 | 20944 | 8215 | 0.66294021 | 0 |
| 20861 | 8132 | 0.666823802 | 0 | 20889 | 8160 | 0.665514107 | 0 | 20917 | 8188 | 0.664132653 | 0 | 20945 | 8216 | 0.66294021 | -1.125840964 |
| 20862 | 8133 | 0.666785834 | 0 | 20890 | 8161 | 0.665514107 | 0 | 20918 | 8189 | 0.664132653 | -0.023278448 | 20946 | 8217 | 0.662841518 | 0 |
| 20863 | 8134 | 0.666688557 | 0 | 20891 | 8162 | 0.665514107 | 0 | 20919 | 8190 | 0.664132653 | -0.206922845 | 20947 | 8218 | 0.662684817 | 0 |
| 20864 | 8135 | 0.666688557 | 0 | 20892 | 8163 | 0.665514107 | -0.131235996 | 20920 | 8191 | 0.664132653 | -1.008555191 | 20948 | 8219 | 0.662684817 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 20949 | 8220 | 0.662565979 | 0 | 20977 | 8248 | 0.661701138 | 0 | 21005 | 8276 | 0.660356155 | 0 | 21033 | 8304 | 0.659251642 | 0 |
| 20950 | 8221 | 0.662397681 | 0 | 20978 | 8249 | 0.661701138 | 0 | 21006 | 8277 | 0.660356155 | 0 | 21034 | 8305 | 0.659251642 | 0 |
| 20951 | 8222 | 0.662397681 | 0 | 20979 | 8250 | 0.661338167 | 0 | 21007 | 8278 | 0.660185274 | 0 | 21035 | 8306 | 0.659251642 | 0 |
| 20952 | 8223 | 0.662397681 | 0 | 20980 | 8251 | 0.661338167 | 0 | 21008 | 8279 | 0.660185274 | 0 | 21036 | 8307 | 0.659071698 | 0 |
| 20953 | 8224 | 0.662397681 | 0 | 20981 | 8252 | 0.661338167 | 0 | 21009 | 8280 | 0.660185274 | 0 | 21037 | 8308 | 0.659071698 | 0 |
| 20954 | 8225 | 0.662397681 | 0 | 20982 | 8253 | 0.661179462 | 0 | 21010 | 8281 | 0.660185274 | 0 | 21038 | 8309 | 0.658926083 | -1.321740616 |
| 20955 | 8226 | 0.662397681 | 0 | 20983 | 8254 | 0.661179462 | 0 | 21011 | 8282 | 0.660185274 | 0 | 21039 | 8310 | 0.65880583 | 0 |
| 20956 | 8227 | 0.662397681 | 0 | 20984 | 8255 | 0.661033506 | 0 | 21012 | 8283 | 0.660185274 | 0 | 21040 | 8311 | 0.65880583 | 0 |
| 20957 | 8228 | 0.662397681 | -0.598109716 | 20985 | 8256 | 0.661033506 | 0 | 21013 | 8284 | 0.660185274 | 0 | 21041 | 8312 | 0.65880583 | -1.361369411 |
| 20958 | 8229 | 0.662240299 | 0 | 20986 | 8257 | 0.661033506 | 0 | 21014 | 8285 | 0.660185274 | 0 | 21042 | 8313 | 0.658704843 | 0 |
| 20959 | 8230 | 0.662140929 | 0 | 20987 | 8258 | 0.660964837 | 0 | 21015 | 8286 | 0.659964652 | 0 | 21043 | 8314 | 0.658544705 | 0 |
| 20960 | 8231 | 0.662140929 | 0 | 20988 | 8259 | 0.660964837 | -0.227931489 | 21016 | 8287 | 0.659964652 | 0 | 21044 | 8315 | 0.658219025 | 0 |
| 20961 | 8232 | 0.662140929 | 0 | 20989 | 8260 | 0.660774148 | 0 | 21017 | 8288 | 0.659964652 | 0 | 21045 | 8316 | 0.657545178 | 0 |
| 20962 | 8233 | 0.662140929 | 0 | 20990 | 8261 | 0.660774148 | 0 | 21018 | 8289 | 0.659964652 | 0 | 21046 | 8317 | 0.657545178 | 0 |
| 20963 | 8234 | 0.662140929 | 0 | 20991 | 8262 | 0.660774148 | 0 | 21019 | 8290 | 0.659778059 | 0 | 21047 | 8318 | 0.657545178 | 0 |
| 20964 | 8235 | 0.662140929 | -0.320817567 | 20992 | 8263 | 0.660774148 | 0 | 21020 | 8291 | 0.659778059 | 0 | 21048 | 8319 | 0.657545178 | 0 |
| 20965 | 8236 | 0.66202248 | 0 | 20993 | 8264 | 0.660774148 | 0 | 21021 | 8292 | 0.659778059 | 0 | 21049 | 8320 | 0.657545178 | 0 |
| 20966 | 8237 | 0.66202248 | -0.068975592 | 20994 | 8265 | 0.660774148 | 0 | 21022 | 8293 | 0.659778059 | 0 | 21050 | 8321 | 0.657545178 | 0 |
| 20967 | 8238 | 0.661701138 | 0 | 20995 | 8266 | 0.660774148 | 0 | 21023 | 8294 | 0.659778059 | 0 | 21051 | 8322 | 0.657545178 | 0 |
| 20968 | 8239 | 0.661701138 | 0 | 20996 | 8267 | 0.660550688 | 0 | 21024 | 8295 | 0.659778059 | -0.635491443 | 21052 | 8323 | 0.657545178 | 0 |
| 20969 | 8240 | 0.661701138 | 0 | 20997 | 8268 | 0.660550688 | 0 | 21025 | 8296 | 0.659618186 | 0 | 21053 | 8324 | 0.657545178 | 0 |
| 20970 | 8241 | 0.661701138 | 0 | 20998 | 8269 | 0.660450168 | 0 | 21026 | 8297 | 0.659618186 | 0 | 21054 | 8325 | 0.657545178 | 0 |
| 20971 | 8242 | 0.661701138 | 0 | 20999 | 8270 | 0.660450168 | 0 | 21027 | 8298 | 0.659618186 | 0 | 21055 | 8326 | 0.657545178 | 0 |
| 20972 | 8243 | 0.661701138 | 0 | 21000 | 8271 | 0.660450168 | 0 | 21028 | 8299 | 0.659479678 | 0 | 21056 | 8327 | 0.657545178 | 0 |
| 20973 | 8244 | 0.661701138 | 0 | 21001 | 8272 | 0.660450168 | 0 | 21029 | 8300 | 0.659479678 | 0 | 21057 | 8328 | 0.657545178 | 0 |
| 20974 | 8245 | 0.661701138 | 0 | 21002 | 8273 | 0.660450168 | 0 | 21030 | 8301 | 0.659479678 | 0 | 21058 | 8329 | 0.657545178 | 0 |
| 20975 | 8246 | 0.661701138 | 0 | 21003 | 8274 | 0.660450168 | 0 | 21031 | 8302 | 0.659358518 | 0 | 21059 | 8330 | 0.657545178 | 0 |
| 20976 | 8247 | 0.661701138 | 0 | 21004 | 8275 | 0.660450168 | 0 | 21032 | 8303 | 0.659358518 | 0 | 21060 | 8331 | 0.657545178 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21061 | 8332 | 0.657545178 | 0 | 21089 | 8360 | 0.656168649 | 0 | 21117 | 8388 | 0.654921034 | 0 | 21145 | 8416 | 0.653941053 | 0 |
| 21062 | 8333 | 0.657545178 | 0 | 21090 | 8361 | 0.656099937 | 0 | 21118 | 8389 | 0.654921034 | 0 | 21146 | 8417 | 0.653785029 | 0 |
| 21063 | 8334 | 0.657545178 | 0 | 21091 | 8362 | 0.656024005 | 0 | 21119 | 8390 | 0.654659489 | 0 | 21147 | 8418 | 0.653785029 | 0 |
| 21064 | 8335 | 0.657545178 | 0 | 21092 | 8363 | 0.656024005 | 0 | 21120 | 8391 | 0.654659489 | 0 | 21148 | 8419 | 0.653785029 | 0 |
| 21065 | 8336 | 0.657545178 | 0 | 21093 | 8364 | 0.655845393 | 0 | 21121 | 8392 | 0.654659489 | 0 | 21149 | 8420 | 0.653785029 | 0 |
| 21066 | 8337 | 0.657545178 | 0 | 21094 | 8365 | 0.655845393 | 0 | 21122 | 8393 | 0.654659489 | 0 | 21150 | 8421 | 0.653701839 | 0 |
| 21067 | 8338 | 0.657545178 | 0 | 21095 | 8366 | 0.655845393 | 0 | 21123 | 8394 | 0.654659489 | 0 | 21151 | 8422 | 0.653650134 | 0 |
| 21068 | 8339 | 0.657545178 | 0 | 21096 | 8367 | 0.655739377 | 0 | 21124 | 8395 | 0.654659489 | 0 | 21152 | 8423 | 0.653428612 | 0 |
| 21069 | 8340 | 0.657545178 | 0 | 21097 | 8368 | 0.655739377 | 0 | 21125 | 8396 | 0.654560324 | 0 | 21153 | 8424 | 0.653428612 | 0 |
| 21070 | 8341 | 0.657545178 | 0 | 21098 | 8369 | 0.655619257 | 0 | 21126 | 8397 | 0.654560324 | 0 | 21154 | 8425 | 0.653428612 | 0 |
| 21071 | 8342 | 0.657545178 | 0 | 21099 | 8370 | 0.655619257 | 0 | 21127 | 8398 | 0.654340038 | 0 | 21155 | 8426 | 0.653428612 | 0 |
| 21072 | 8343 | 0.657545178 | 0 | 21100 | 8371 | 0.655619257 | 0 | 21128 | 8399 | 0.654340038 | 0 | 21156 | 8427 | 0.653428612 | 0 |
| 21073 | 8344 | 0.657545178 | 0 | 21101 | 8372 | 0.655619257 | 0 | 21129 | 8400 | 0.654340038 | 0 | 21157 | 8428 | 0.653428612 | 0 |
| 21074 | 8345 | 0.657545178 | 0 | 21102 | 8373 | 0.655619257 | 0 | 21130 | 8401 | 0.654340038 | 0 | 21158 | 8429 | 0.653428612 | 0 |
| 21075 | 8346 | 0.657545178 | 0 | 21103 | 8374 | 0.655482017 | 0 | 21131 | 8402 | 0.654340038 | 0 | 21159 | 8430 | 0.653428612 | 0 |
| 21076 | 8347 | 0.657545178 | -1.256174732 | 21104 | 8375 | 0.655482017 | 0 | 21132 | 8403 | 0.654340038 | 0 | 21160 | 8431 | 0.653428612 | 0 |
| 21077 | 8348 | 0.657545178 | -1.343324908 | 21105 | 8376 | 0.655323718 | 0 | 21133 | 8404 | 0.654340038 | 0 | 21161 | 8432 | 0.653428612 | 0 |
| 21078 | 8349 | 0.657545178 | -1.176993486 | 21106 | 8377 | 0.655323718 | 0 | 21134 | 8405 | 0.654340038 | 0 | 21162 | 8433 | 0.653180372 | 0 |
| 21079 | 8350 | 0.6566687 | 0 | 21107 | 8378 | 0.655323718 | 0 | 21135 | 8406 | 0.654340038 | 0 | 21163 | 8434 | 0.653113563 | 0 |
| 21080 | 8351 | 0.656612214 | 0 | 21108 | 8379 | 0.655323718 | 0 | 21136 | 8407 | 0.654152235 | 0 | 21164 | 8435 | 0.653113563 | 0 |
| 21081 | 8352 | 0.656547945 | 0 | 21109 | 8380 | 0.655139108 | 0 | 21137 | 8408 | 0.654084646 | 0 | 21165 | 8436 | 0.653113563 | 0 |
| 21082 | 8353 | 0.656547945 | -1.464297457 | 21110 | 8381 | 0.655139108 | 0 | 21138 | 8409 | 0.654084646 | 0 | 21166 | 8437 | 0.653113563 | 0 |
| 21083 | 8354 | 0.656474167 | 0 | 21111 | 8382 | 0.655070559 | 0 | 21139 | 8410 | 0.654084646 | 0 | 21167 | 8438 | 0.65299755 | 0 |
| 21084 | 8355 | 0.656474167 | 0 | 21112 | 8383 | 0.654921034 | 0 | 21140 | 8411 | 0.654084646 | 0 | 21168 | 8439 | 0.65299755 | 0 |
| 21085 | 8356 | 0.656388601 | 0 | 21113 | 8384 | 0.654921034 | 0 | 21141 | 8412 | 0.654084646 | -0.360910083 | 21169 | 8440 | 0.65299755 | 0 |
| 21086 | 8357 | 0.656288174 | 0 | 21114 | 8385 | 0.654921034 | 0 | 21142 | 8413 | 0.653941053 | 0 | 21170 | 8441 | 0.65299755 | 0 |
| 21087 | 8358 | 0.656168649 | 0 | 21115 | 8386 | 0.654921034 | 0 | 21143 | 8414 | 0.653941053 | 0 | 21171 | 8442 | 0.652900273 | 0 |
| 21088 | 8359 | 0.656168649 | 0 | 21116 | 8387 | 0.654921034 | 0 | 21144 | 8415 | 0.653941053 | 0 | 21172 | 8443 | 0.652746295 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21173 | 8444 | 0.652746295 | 0 | 21201 | 8472 | 0.651792849 | 0 | 21229 | 8500 | 0.650914599 | 0 | 21257 | 8528 | 0.649513083 | 0 |
| 21174 | 8445 | 0.652746295 | 0 | 21202 | 8473 | 0.651792849 | 0 | 21230 | 8501 | 0.650914599 | 0 | 21258 | 8529 | 0.649350699 | 0 |
| 21175 | 8446 | 0.652746295 | 0 | 21203 | 8474 | 0.651792849 | 0 | 21231 | 8502 | 0.650785594 | 0 | 21259 | 8530 | 0.649350699 | 0 |
| 21176 | 8447 | 0.652746295 | 0 | 21204 | 8475 | 0.651792849 | 0 | 21232 | 8503 | 0.650705753 | 0 | 21260 | 8531 | 0.649350699 | 0 |
| 21177 | 8448 | 0.652746295 | 0 | 21205 | 8476 | 0.651792849 | -0.70562456 | 21233 | 8504 | 0.650705753 | 0 | 21261 | 8532 | 0.649350699 | 0 |
| 21178 | 8449 | 0.652581758 | 0 | 21206 | 8477 | 0.651792849 | -1.404594565 | 21234 | 8505 | 0.650705753 | 0 | 21262 | 8533 | 0.649219789 | 0 |
| 21179 | 8450 | 0.652465652 | 0 | 21207 | 8478 | 0.651384869 | 0 | 21235 | 8506 | 0.650705753 | 0 | 21263 | 8534 | 0.64911201 | 0 |
| 21180 | 8451 | 0.652465652 | 0 | 21208 | 8479 | 0.651384869 | -1.153190571 | 21236 | 8507 | 0.650705753 | 0 | 21264 | 8535 | 0.64911201 | 0 |
| 21181 | 8452 | 0.652465652 | 0 | 21209 | 8480 | 0.651296228 | 0 | 21237 | 8508 | 0.650366593 | 0 | 21265 | 8536 | 0.64911201 | 0 |
| 21182 | 8453 | 0.652465652 | 0 | 21210 | 8481 | 0.651296228 | 0 | 21238 | 8509 | 0.650366593 | 0 | 21266 | 8537 | 0.64911201 | 0 |
| 21183 | 8454 | 0.652465652 | 0 | 21211 | 8482 | 0.651296228 | 0 | 21239 | 8510 | 0.650366593 | 0 | 21267 | 8538 | 0.64911201 | 0 |
| 21184 | 8455 | 0.652312651 | 0 | 21212 | 8483 | 0.651158379 | 0 | 21240 | 8511 | 0.650366593 | 0 | 21268 | 8539 | 0.64911201 | 0 |
| 21185 | 8456 | 0.652312651 | 0 | 21213 | 8484 | 0.651158379 | 0 | 21241 | 8512 | 0.650366593 | 0 | 21269 | 8540 | 0.648945006 | 0 |
| 21186 | 8457 | 0.652312651 | 0 | 21214 | 8485 | 0.651158379 | 0 | 21242 | 8513 | 0.650163224 | 0 | 21270 | 8541 | 0.648945006 | 0 |
| 21187 | 8458 | 0.652216344 | 0 | 21215 | 8486 | 0.651158379 | 0 | 21243 | 8514 | 0.650102985 | 0 | 21271 | 8542 | 0.648945006 | 0 |
| 21188 | 8459 | 0.652216344 | 0 | 21216 | 8487 | 0.651158379 | 0 | 21244 | 8515 | 0.650102985 | 0 | 21272 | 8543 | 0.648945006 | 0 |
| 21189 | 8460 | 0.652216344 | 0 | 21217 | 8488 | 0.651158379 | 0 | 21245 | 8516 | 0.650102985 | 0 | 21273 | 8544 | 0.648945006 | 0 |
| 21190 | 8461 | 0.651792849 | 0 | 21218 | 8489 | 0.651158379 | 0 | 21246 | 8517 | 0.650102985 | 0 | 21274 | 8545 | 0.648821609 | 0 |
| 21191 | 8462 | 0.651792849 | 0 | 21219 | 8490 | 0.651158379 | 0 | 21247 | 8518 | 0.64999204 | 0 | 21275 | 8546 | 0.648821609 | 0 |
| 21192 | 8463 | 0.651792849 | 0 | 21220 | 8491 | 0.651056132 | 0 | 21248 | 8519 | 0.649892214 | 0 | 21276 | 8547 | 0.648821609 | 0 |
| 21193 | 8464 | 0.651792849 | 0 | 21221 | 8492 | 0.651056132 | 0 | 21249 | 8520 | 0.649892214 | 0 | 21277 | 8548 | 0.648821609 | -1.371353631 |
| 21194 | 8465 | 0.651792849 | 0 | 21222 | 8493 | 0.651056132 | 0 | 21250 | 8521 | 0.64971984 | 0 | 21278 | 8549 | 0.648726713 | 0 |
| 21195 | 8466 | 0.651792849 | 0 | 21223 | 8494 | 0.651056132 | 0 | 21251 | 8522 | 0.64971984 | 0 | 21279 | 8550 | 0.648726713 | -0.009720692 |
| 21196 | 8467 | 0.651792849 | 0 | 21224 | 8495 | 0.651056132 | 0 | 21252 | 8523 | 0.64971984 | 0 | 21280 | 8551 | 0.648651465 | 0 |
| 21197 | 8468 | 0.651792849 | 0 | 21225 | 8496 | 0.650914599 | 0 | 21253 | 8524 | 0.64971984 | 0 | 21281 | 8552 | 0.648590335 | 0 |
| 21198 | 8469 | 0.651792849 | 0 | 21226 | 8497 | 0.650914599 | 0 | 21254 | 8525 | 0.64971984 | 0 | 21282 | 8553 | 0.648539691 | 0 |
| 21199 | 8470 | 0.651792849 | 0 | 21227 | 8498 | 0.650914599 | 0 | 21255 | 8526 | 0.649513083 | 0 | 21283 | 8554 | 0.64799986 | 0 |
| 21200 | 8471 | 0.651792849 | 0 | 21228 | 8499 | 0.650914599 | 0 | 21256 | 8527 | 0.649513083 | 0 | 21284 | 8555 | 0.64799986 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21285 | 8556 | 0.64799986 | 0 | 21313 | 8584 | 0.646821312 | 0 | 21341 | 8612 | 0.645645954 | 0 | 21369 | 8640 | 0.644580201 | 0 |
| 21286 | 8557 | 0.64799986 | 0 | 21314 | 8585 | 0.646821312 | 0 | 21342 | 8613 | 0.645645954 | -1.393012692 | 21370 | 8641 | 0.644383732 | 0 |
| 21287 | 8558 | 0.64799986 | 0 | 21315 | 8586 | 0.646699576 | 0 | 21343 | 8614 | 0.645310721 | 0 | 21371 | 8642 | 0.644383732 | 0 |
| 21288 | 8559 | 0.64799986 | 0 | 21316 | 8587 | 0.646549793 | 0 | 21344 | 8615 | 0.645310721 | 0 | 21372 | 8643 | 0.644383732 | 0 |
| 21289 | 8560 | 0.64799986 | 0 | 21317 | 8588 | 0.646549793 | 0 | 21345 | 8616 | 0.645310721 | 0 | 21373 | 8644 | 0.644383732 | 0 |
| 21290 | 8561 | 0.64799986 | 0 | 21318 | 8589 | 0.646549793 | 0 | 21346 | 8617 | 0.645310721 | 0 | 21374 | 8645 | 0.644239711 | 0 |
| 21291 | 8562 | 0.64799986 | 0 | 21319 | 8590 | 0.646549793 | 0 | 21347 | 8618 | 0.645310721 | 0 | 21375 | 8646 | 0.644239711 | 0 |
| 21292 | 8563 | 0.64799986 | 0 | 21320 | 8591 | 0.646361011 | 0 | 21348 | 8619 | 0.645310721 | 0 | 21376 | 8647 | 0.644239711 | 0 |
| 21293 | 8564 | 0.64799986 | 0 | 21321 | 8592 | 0.646361011 | 0 | 21349 | 8620 | 0.645310721 | -1.335355978 | 21377 | 8648 | 0.644239711 | 0 |
| 21294 | 8565 | 0.64799986 | -0.186538804 | 21322 | 8593 | 0.646115716 | 0 | 21350 | 8621 | 0.644989141 | 0 | 21378 | 8649 | 0.644239711 | 0 |
| 21295 | 8566 | 0.64799986 | -0.446176115 | 21323 | 8594 | 0.646115716 | 0 | 21351 | 8622 | 0.644989141 | 0 | 21379 | 8650 | 0.644239711 | 0 |
| 21296 | 8567 | 0.64799986 | -1.4875688 | 21324 | 8595 | 0.646115716 | 0 | 21352 | 8623 | 0.644989141 | 0 | 21380 | 8651 | 0.64412961 | 0 |
| 21297 | 8568 | 0.647444851 | 0 | 21325 | 8596 | 0.646115716 | 0 | 21353 | 8624 | 0.644989141 | 0 | 21381 | 8652 | 0.64412961 | 0 |
| 21298 | 8569 | 0.647326013 | 0 | 21326 | 8597 | 0.646115716 | 0 | 21354 | 8625 | 0.644989141 | 0 | 21382 | 8653 | 0.644042707 | 0 |
| 21299 | 8570 | 0.647245221 | 0 | 21327 | 8598 | 0.646115716 | -1.313361685 | 21355 | 8626 | 0.644989141 | 0 | 21383 | 8654 | 0.644042707 | 0 |
| 21300 | 8571 | 0.647245221 | 0 | 21328 | 8599 | 0.64590687 | 0 | 21356 | 8627 | 0.644989141 | -0.235307014 | 21384 | 8655 | 0.644042707 | 0 |
| 21301 | 8572 | 0.647245221 | 0 | 21329 | 8600 | 0.64590687 | 0 | 21357 | 8628 | 0.644864146 | 0 | 21385 | 8656 | 0.644042707 | 0 |
| 21302 | 8573 | 0.647142417 | 0 | 21330 | 8601 | 0.64590687 | 0 | 21358 | 8629 | 0.644864146 | 0 | 21386 | 8657 | 0.643914275 | 0 |
| 21303 | 8574 | 0.647142417 | 0 | 21331 | 8602 | 0.64590687 | -1.443904299 | 21359 | 8630 | 0.644864146 | 0 | 21387 | 8658 | 0.643914275 | 0 |
| 21304 | 8575 | 0.647142417 | 0 | 21332 | 8603 | 0.645784067 | 0 | 21360 | 8631 | 0.644864146 | 0 | 21388 | 8659 | 0.643914275 | 0 |
| 21305 | 8576 | 0.647142417 | 0 | 21333 | 8604 | 0.645784067 | 0 | 21361 | 8632 | 0.644864146 | 0 | 21389 | 8660 | 0.643823919 | 0 |
| 21306 | 8577 | 0.647142417 | -0.876606414 | 21334 | 8605 | 0.645784067 | 0 | 21362 | 8633 | 0.644864146 | 0 | 21390 | 8661 | 0.643823919 | 0 |
| 21307 | 8578 | 0.647007186 | 0 | 21335 | 8606 | 0.645784067 | 0 | 21363 | 8634 | 0.644864146 | 0 | 21391 | 8662 | 0.643756893 | 0 |
| 21308 | 8579 | 0.647007186 | 0 | 21336 | 8607 | 0.645784067 | 0 | 21364 | 8635 | 0.644756421 | 0 | 21392 | 8663 | 0.643756893 | 0 |
| 21309 | 8580 | 0.646922205 | 0 | 21337 | 8608 | 0.645784067 | 0 | 21365 | 8636 | 0.644580201 | 0 | 21393 | 8664 | 0.643304739 | 0 |
| 21310 | 8581 | 0.646821312 | 0 | 21338 | 8609 | 0.645784067 | 0 | 21366 | 8637 | 0.644580201 | 0 | 21394 | 8665 | 0.643304739 | 0 |
| 21311 | 8582 | 0.646821312 | 0 | 21339 | 8610 | 0.645645954 | 0 | 21367 | 8638 | 0.644580201 | 0 | 21395 | 8666 | 0.643304739 | 0 |
| 21312 | 8583 | 0.646821312 | 0 | 21340 | 8611 | 0.645645954 | 0 | 21368 | 8639 | 0.644580201 | 0 | 21396 | 8667 | 0.643304739 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21397 | 8668 | 0.643304739 | 0 | 21425 | 8696 | 0.64222842 | 0 | 21453 | 8724 | 0.640511838 | 0 | 21481 | 8752 | 0.639816411 | 0 |
| 21398 | 8669 | 0.643304739 | 0 | 21426 | 8697 | 0.642105581 | 0 | 21454 | 8725 | 0.640511838 | 0 | 21482 | 8753 | 0.63968775 | 0 |
| 21399 | 8670 | 0.643304739 | 0 | 21427 | 8698 | 0.642033012 | 0 | 21455 | 8726 | 0.640511838 | 0 | 21483 | 8754 | 0.639500675 | 0 |
| 21400 | 8671 | 0.643304739 | 0 | 21428 | 8699 | 0.642033012 | 0 | 21456 | 8727 | 0.640511838 | 0 | 21484 | 8755 | 0.639500675 | 0 |
| 21401 | 8672 | 0.643304739 | 0 | 21429 | 8700 | 0.641750911 | 0 | 21457 | 8728 | 0.640511838 | 0 | 21485 | 8756 | 0.639500675 | 0 |
| 21402 | 8673 | 0.643304739 | 0 | 21430 | 8701 | 0.641750911 | 0 | 21458 | 8729 | 0.640511838 | 0 | 21486 | 8757 | 0.639500675 | 0 |
| 21403 | 8674 | 0.643304739 | 0 | 21431 | 8702 | 0.641750911 | 0 | 21459 | 8730 | 0.640511838 | 0 | 21487 | 8758 | 0.639500675 | 0 |
| 21404 | 8675 | 0.643304739 | 0 | 21432 | 8703 | 0.641750911 | 0 | 21460 | 8731 | 0.640511838 | 0 | 21488 | 8759 | 0.639500675 | 0 |
| 21405 | 8676 | 0.643304739 | 0 | 21433 | 8704 | 0.641750911 | 0 | 21461 | 8732 | 0.640511838 | 0 | 21489 | 8760 | 0.639500675 | 0 |
| 21406 | 8677 | 0.643304739 | 0 | 21434 | 8705 | 0.641557072 | 0 | 21462 | 8733 | 0.640511838 | 0 | 21490 | 8761 | 0.639500675 | 0 |
| 21407 | 8678 | 0.643304739 | 0 | 21435 | 8706 | 0.641481246 | 0 | 21463 | 8734 | 0.640511838 | 0 | 21491 | 8762 | 0.639500675 | -1.060339415 |
| 21408 | 8679 | 0.643304739 | 0 | 21436 | 8707 | 0.641481246 | 0 | 21464 | 8735 | 0.640511838 | 0 | 21492 | 8763 | 0.639320358 | 0 |
| 21409 | 8680 | 0.643304739 | 0 | 21437 | 8708 | 0.641481246 | -1.378693995 | 21465 | 8736 | 0.640511838 | -1.318965562 | 21493 | 8764 | 0.639203722 | 0 |
| 21410 | 8681 | 0.643304739 | 0 | 21438 | 8709 | 0.641307979 | 0 | 21466 | 8737 | 0.640511838 | -1.415875575 | 21494 | 8765 | 0.639203722 | 0 |
| 21411 | 8682 | 0.643304739 | -1.395353908 | 21439 | 8710 | 0.641187258 | 0 | 21467 | 8738 | 0.640152769 | 0 | 21495 | 8766 | 0.639203722 | 0 |
| 21412 | 8683 | 0.642821921 | 0 | 21440 | 8711 | 0.641187258 | 0 | 21468 | 8739 | 0.640152769 | 0 | 21496 | 8767 | 0.639203722 | 0 |
| 21413 | 8684 | 0.64274472 | 0 | 21441 | 8712 | 0.641098327 | 0 | 21469 | 8740 | 0.640083751 | 0 | 21497 | 8768 | 0.639203722 | 0 |
| 21414 | 8685 | 0.64274472 | 0 | 21442 | 8713 | 0.641098327 | 0 | 21470 | 8741 | 0.640083751 | 0 | 21498 | 8769 | 0.639203722 | 0 |
| 21415 | 8686 | 0.642638131 | 0 | 21443 | 8714 | 0.641098327 | 0 | 21471 | 8742 | 0.640083751 | 0 | 21499 | 8770 | 0.639061772 | 0 |
| 21416 | 8687 | 0.642638131 | 0 | 21444 | 8715 | 0.641098327 | 0 | 21472 | 8743 | 0.640083751 | 0 | 21500 | 8771 | 0.639061772 | 0 |
| 21417 | 8688 | 0.642638131 | 0 | 21445 | 8716 | 0.641098327 | 0 | 21473 | 8744 | 0.640083751 | 0 | 21501 | 8772 | 0.639061772 | 0 |
| 21418 | 8689 | 0.642638131 | 0 | 21446 | 8717 | 0.641098327 | 0 | 21474 | 8745 | 0.639981888 | 0 | 21502 | 8773 | 0.639061772 | 0 |
| 21419 | 8690 | 0.642481431 | 0 | 21447 | 8718 | 0.641098327 | -0.995072683 | 21475 | 8746 | 0.639981888 | 0 | 21503 | 8774 | 0.639061772 | 0 |
| 21420 | 8691 | 0.642481431 | 0 | 21448 | 8719 | 0.640976076 | 0 | 21476 | 8747 | 0.639981888 | 0 | 21504 | 8775 | 0.639061772 | 0 |
| 21421 | 8692 | 0.642481431 | -1.246414895 | 21449 | 8720 | 0.640976076 | 0 | 21477 | 8748 | 0.639981888 | -0.437594825 | 21505 | 8776 | 0.639061772 | -0.779053477 |
| 21422 | 8693 | 0.642371775 | 0 | 21450 | 8721 | 0.640839484 | 0 | 21478 | 8749 | 0.639816411 | 0 | 21506 | 8777 | 0.639061772 | -0.536015429 |
| 21423 | 8694 | 0.64222842 | 0 | 21451 | 8722 | 0.640797465 | 0 | 21479 | 8750 | 0.639816411 | 0 | 21507 | 8778 | 0.638978582 | 0 |
| 21424 | 8695 | 0.64222842 | 0 | 21452 | 8723 | 0.640511838 | 0 | 21480 | 8751 | 0.639816411 | 0 | 21508 | 8779 | 0.638978582 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21509 | 8780 | 0.638659834 | 0 | 21537 | 8808 | 0.638173774 | -0.821905977 | 21565 | 8836 | 0.637069592 | -1.182745815 | 21593 | 8864 | 0.635950564 | 0 |
| 21510 | 8781 | 0.638659834 | 0 | 21538 | 8809 | 0.637949622 | 0 | 21566 | 8837 | 0.636983019 | 0 | 21594 | 8865 | 0.635950564 | 0 |
| 21511 | 8782 | 0.638659834 | 0 | 21539 | 8810 | 0.637949622 | 0 | 21567 | 8838 | 0.636983019 | 0 | 21595 | 8866 | 0.635950564 | 0 |
| 21512 | 8783 | 0.638659834 | 0 | 21540 | 8811 | 0.637949622 | 0 | 21568 | 8839 | 0.636815693 | 0 | 21596 | 8867 | 0.635950564 | 0 |
| 21513 | 8784 | 0.638659834 | 0 | 21541 | 8812 | 0.637949622 | 0 | 21569 | 8840 | 0.636815693 | 0 | 21597 | 8868 | 0.635825928 | 0 |
| 21514 | 8785 | 0.638659834 | 0 | 21542 | 8813 | 0.637949622 | 0 | 21570 | 8841 | 0.636815693 | 0 | 21598 | 8869 | 0.635825928 | 0 |
| 21515 | 8786 | 0.638659834 | 0 | 21543 | 8814 | 0.637820617 | 0 | 21571 | 8842 | 0.636815693 | 0 | 21599 | 8870 | 0.635825928 | 0 |
| 21516 | 8787 | 0.638659834 | 0 | 21544 | 8815 | 0.637736784 | 0 | 21572 | 8843 | 0.636655702 | 0 | 21600 | 8871 | 0.635825928 | 0 |
| 21517 | 8788 | 0.638659834 | 0 | 21545 | 8816 | 0.637736784 | 0 | 21573 | 8844 | 0.636655702 | 0 | 21601 | 8872 | 0.635825928 | 0 |
| 21518 | 8789 | 0.638659834 | 0 | 21546 | 8817 | 0.637736784 | 0 | 21574 | 8845 | 0.636655702 | 0 | 21602 | 8873 | 0.635825928 | 0 |
| 21519 | 8790 | 0.638659834 | 0 | 21547 | 8818 | 0.637736784 | 0 | 21575 | 8846 | 0.636655702 | 0 | 21603 | 8874 | 0.635590602 | 0 |
| 21520 | 8791 | 0.638659834 | 0 | 21548 | 8819 | 0.637736784 | 0 | 21576 | 8847 | 0.636655702 | 0 | 21604 | 8875 | 0.635590602 | 0 |
| 21521 | 8792 | 0.638659834 | 0 | 21549 | 8820 | 0.637634344 | 0 | 21577 | 8848 | 0.636655702 | -1.383519539 | 21605 | 8876 | 0.635590602 | 0 |
| 21522 | 8793 | 0.638659834 | 0 | 21550 | 8821 | 0.637634344 | 0 | 21578 | 8849 | 0.636578309 | 0 | 21606 | 8877 | 0.635590602 | 0 |
| 21523 | 8794 | 0.638659834 | -0.496908826 | 21551 | 8822 | 0.637574097 | 0 | 21579 | 8850 | 0.636355879 | 0 | 21607 | 8878 | 0.635590602 | 0 |
| 21524 | 8795 | 0.638361861 | 0 | 21552 | 8823 | 0.637341792 | 0 | 21580 | 8851 | 0.636355879 | 0 | 21608 | 8879 | 0.635590602 | 0 |
| 21525 | 8796 | 0.638361861 | 0 | 21553 | 8824 | 0.637341792 | 0 | 21581 | 8852 | 0.636355879 | 0 | 21609 | 8880 | 0.635590602 | 0 |
| 21526 | 8797 | 0.638290378 | 0 | 21554 | 8825 | 0.637341792 | 0 | 21582 | 8853 | 0.636355879 | 0 | 21610 | 8881 | 0.635372199 | 0 |
| 21527 | 8798 | 0.638290378 | 0 | 21555 | 8826 | 0.637341792 | 0 | 21583 | 8854 | 0.636355879 | 0 | 21611 | 8882 | 0.635372199 | 0 |
| 21528 | 8799 | 0.638290378 | 0 | 21556 | 8827 | 0.637341792 | 0 | 21584 | 8855 | 0.636355879 | 0 | 21612 | 8883 | 0.635268783 | 0 |
| 21529 | 8800 | 0.638290378 | -0.572998995 | 21557 | 8828 | 0.637341792 | 0 | 21585 | 8856 | 0.636355879 | 0 | 21613 | 8884 | 0.635268783 | 0 |
| 21530 | 8801 | 0.638173774 | 0 | 21558 | 8829 | 0.637341792 | 0 | 21586 | 8857 | 0.636355879 | -0.288359416 | 21614 | 8885 | 0.635268783 | 0 |
| 21531 | 8802 | 0.638173774 | 0 | 21559 | 8830 | 0.637341792 | 0 | 21587 | 8858 | 0.636147033 | 0 | 21615 | 8886 | 0.635168957 | 0 |
| 21532 | 8803 | 0.638173774 | 0 | 21560 | 8831 | 0.637341792 | 0 | 21588 | 8859 | 0.636080224 | 0 | 21616 | 8887 | 0.63497935 | 0 |
| 21533 | 8804 | 0.638173774 | 0 | 21561 | 8832 | 0.637341792 | 0 | 21589 | 8860 | 0.636080224 | 0 | 21617 | 8888 | 0.63497935 | 0 |
| 21534 | 8805 | 0.638173774 | 0 | 21562 | 8833 | 0.637341792 | 0 | 21590 | 8861 | 0.636080224 | 0 | 21618 | 8889 | 0.63497935 | 0 |
| 21535 | 8806 | 0.638173774 | 0 | 21563 | 8834 | 0.637341792 | 0 | 21591 | 8862 | 0.636080224 | 0 | 21619 | 8890 | 0.63497935 | 0 |
| 21536 | 8807 | 0.638173774 | 0 | 21564 | 8835 | 0.637122506 | 0 | 21592 | 8863 | 0.635950564 | 0 | 21620 | 8891 | 0.63497935 | -0.210554698 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21621 | 8892 | 0.63497935 | -1.023468055 | 21649 | 8920 | 0.633150739 | 0 | 21677 | 8948 | 0.632109265 | 0 | 21705 | 8976 | 0.631329795 | 0 |
| 21622 | 8893 | 0.634717648 | 0 | 21650 | 8921 | 0.633150739 | 0 | 21678 | 8949 | 0.632109265 | 0 | 21706 | 8977 | 0.631329795 | 0 |
| 21623 | 8894 | 0.634717648 | 0 | 21651 | 8922 | 0.633150739 | 0 | 21679 | 8950 | 0.632109265 | 0 | 21707 | 8978 | 0.631216239 | 0 |
| 21624 | 8895 | 0.634717648 | -0.141829069 | 21652 | 8923 | 0.633150739 | 0 | 21680 | 8951 | 0.631991073 | 0 | 21708 | 8979 | 0.631116067 | 0 |
| 21625 | 8896 | 0.634479874 | 0 | 21653 | 8924 | 0.633150739 | -1.201387925 | 21681 | 8952 | 0.631991073 | 0 | 21709 | 8980 | 0.630875749 | 0 |
| 21626 | 8897 | 0.634479874 | 0 | 21654 | 8925 | 0.633150739 | -1.502417921 | 21682 | 8953 | 0.631991073 | 0 | 21710 | 8981 | 0.629516454 | 0 |
| 21627 | 8898 | 0.634479874 | 0 | 21655 | 8926 | 0.633033028 | 0 | 21683 | 8954 | 0.631991073 | 0 | 21711 | 8982 | 0.629516454 | 0 |
| 21628 | 8899 | 0.634479874 | 0 | 21656 | 8927 | 0.632922703 | 0 | 21684 | 8955 | 0.631991073 | 0 | 21712 | 8983 | 0.629516454 | 0 |
| 21629 | 8900 | 0.634262889 | 0 | 21657 | 8928 | 0.632922703 | 0 | 21685 | 8956 | 0.631991073 | 0 | 21713 | 8984 | 0.629516454 | 0 |
| 21630 | 8901 | 0.634262889 | 0 | 21658 | 8929 | 0.632922703 | 0 | 21686 | 8957 | 0.631991073 | 0 | 21714 | 8985 | 0.629516454 | 0 |
| 21631 | 8902 | 0.634262889 | -0.043489671 | 21659 | 8930 | 0.632922703 | 0 | 21687 | 8958 | 0.631991073 | 0 | 21715 | 8986 | 0.629516454 | 0 |
| 21632 | 8903 | 0.634064082 | 0 | 21660 | 8931 | 0.632922703 | 0 | 21688 | 8959 | 0.631991073 | 0 | 21716 | 8987 | 0.629516454 | 0 |
| 21633 | 8904 | 0.634064082 | 0 | 21661 | 8932 | 0.632922703 | 0 | 21689 | 8960 | 0.631883187 | 0 | 21717 | 8988 | 0.629516454 | 0 |
| 21634 | 8905 | 0.634064082 | 0 | 21662 | 8933 | 0.632922703 | 0 | 21690 | 8961 | 0.631883187 | 0 | 21718 | 8989 | 0.629516454 | 0 |
| 21635 | 8906 | 0.63388126 | 0 | 21663 | 8934 | 0.63281909 | 0 | 21691 | 8962 | 0.631784316 | 0 | 21719 | 8990 | 0.629516454 | 0 |
| 21636 | 8907 | 0.633712569 | 0 | 21664 | 8935 | 0.632721594 | -1.256174732 | 21692 | 8963 | 0.631693373 | 0 | 21720 | 8991 | 0.629516454 | 0 |
| 21637 | 8908 | 0.633712569 | 0 | 21665 | 8936 | 0.632542909 | 0 | 21693 | 8964 | 0.631693373 | 0 | 21721 | 8992 | 0.629516454 | 0 |
| 21638 | 8909 | 0.633712569 | -0.184435679 | 21666 | 8937 | 0.632542909 | 0 | 21694 | 8965 | 0.631693373 | 0 | 21722 | 8993 | 0.629516454 | 0 |
| 21639 | 8910 | 0.633712569 | -1.138678188 | 21667 | 8938 | 0.632383095 | 0 | 21695 | 8966 | 0.631693373 | 0 | 21723 | 8994 | 0.629516454 | 0 |
| 21640 | 8911 | 0.633556432 | 0 | 21668 | 8939 | 0.632383095 | 0 | 21696 | 8967 | 0.631693373 | -1.123664044 | 21724 | 8995 | 0.629516454 | 0 |
| 21641 | 8912 | 0.633556432 | 0 | 21669 | 8940 | 0.632383095 | 0 | 21697 | 8968 | 0.631609444 | 0 | 21725 | 8996 | 0.629516454 | 0 |
| 21642 | 8913 | 0.633411498 | 0 | 21670 | 8941 | 0.632383095 | 0 | 21698 | 8969 | 0.631609444 | 0 | 21726 | 8997 | 0.629516454 | 0 |
| 21643 | 8914 | 0.633411498 | 0 | 21671 | 8942 | 0.632383095 | 0 | 21699 | 8970 | 0.631609444 | 0 | 21727 | 8998 | 0.629516454 | 0 |
| 21644 | 8915 | 0.633411498 | 0 | 21672 | 8943 | 0.632383095 | 0 | 21700 | 8971 | 0.631609444 | -0.839751318 | 21728 | 8999 | 0.629516454 | 0 |
| 21645 | 8916 | 0.633276603 | 0 | 21673 | 8944 | 0.632239312 | 0 | 21701 | 8972 | 0.631531745 | 0 | 21729 | 9000 | 0.629516454 | 0 |
| 21646 | 8917 | 0.633276603 | -0.64247076 | 21674 | 8945 | 0.632239312 | 0 | 21702 | 8973 | 0.631531745 | 0 | 21730 | 9001 | 0.629516454 | 0 |
| 21647 | 8918 | 0.633150739 | 0 | 21675 | 8946 | 0.632239312 | 0 | 21703 | 8974 | 0.631392459 | 0 | 21731 | 9002 | 0.629516454 | 0 |
| 21648 | 8919 | 0.633150739 | 0 | 21676 | 8947 | 0.632239312 | 0 | 21704 | 8975 | 0.631392459 | -1.489452944 | 21732 | 9003 | 0.629516454 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21733 | 9004 | 0.629516454 | 0 | 21761 | 9032 | 0.629516454 | 0 | 21789 | 9060 | 0.627581954 | 0 | 21817 | 9088 | 0.626668611 | 0 |
| 21734 | 9005 | 0.629516454 | 0 | 21762 | 9033 | 0.629516454 | 0 | 21790 | 9061 | 0.627510471 | 0 | 21818 | 9089 | 0.626668611 | 0 |
| 21735 | 9006 | 0.629516454 | 0 | 21763 | 9034 | 0.629516454 | 0 | 21791 | 9062 | 0.627433503 | 0 | 21819 | 9090 | 0.626668611 | 0 |
| 21736 | 9007 | 0.629516454 | 0 | 21764 | 9035 | 0.629516454 | 0 | 21792 | 9063 | 0.627433503 | -1.44598725 | 21820 | 9091 | 0.626668611 | -0.009502399 |
| 21737 | 9008 | 0.629516454 | 0 | 21765 | 9036 | 0.629516454 | 0 | 21793 | 9064 | 0.627350392 | 0 | 21821 | 9092 | 0.626510944 | 0 |
| 21738 | 9009 | 0.629516454 | 0 | 21766 | 9037 | 0.629516454 | 0 | 21794 | 9065 | 0.627350392 | 0 | 21822 | 9093 | 0.626510944 | 0 |
| 21739 | 9010 | 0.629516454 | 0 | 21767 | 9038 | 0.629516454 | 0 | 21795 | 9066 | 0.627350392 | 0 | 21823 | 9094 | 0.626510944 | 0 |
| 21740 | 9011 | 0.629516454 | 0 | 21768 | 9039 | 0.629516454 | 0 | 21796 | 9067 | 0.627350392 | 0 | 21824 | 9095 | 0.626510944 | 0 |
| 21741 | 9012 | 0.629516454 | 0 | 21769 | 9040 | 0.629516454 | 0 | 21797 | 9068 | 0.627350392 | -1.128007025 | 21825 | 9096 | 0.626510944 | 0 |
| 21742 | 9013 | 0.629516454 | 0 | 21770 | 9041 | 0.629516454 | 0 | 21798 | 9069 | 0.627260374 | 0 | 21826 | 9097 | 0.626510944 | 0 |
| 21743 | 9014 | 0.629516454 | 0 | 21771 | 9042 | 0.629516454 | 0 | 21799 | 9070 | 0.627260374 | 0 | 21827 | 9098 | 0.626510944 | -0.98617897 |
| 21744 | 9015 | 0.629516454 | 0 | 21772 | 9043 | 0.629516454 | 0 | 21800 | 9071 | 0.627260374 | 0 | 21828 | 9099 | 0.626334795 | 0 |
| 21745 | 9016 | 0.629516454 | 0 | 21773 | 9044 | 0.629516454 | 0 | 21801 | 9072 | 0.627260374 | 0 | 21829 | 9100 | 0.626334795 | -0.032112609 |
| 21746 | 9017 | 0.629516454 | 0 | 21774 | 9045 | 0.629516454 | 0 | 21802 | 9073 | 0.627260374 | 0 | 21830 | 9101 | 0.626334795 | -0.961531535 |
| 21747 | 9018 | 0.629516454 | 0 | 21775 | 9046 | 0.629516454 | 0 | 21803 | 9074 | 0.627162549 | 0 | 21831 | 9102 | 0.626238744 | 0 |
| 21748 | 9019 | 0.629516454 | 0 | 21776 | 9047 | 0.629516454 | 0 | 21804 | 9075 | 0.627055856 | 0 | 21832 | 9103 | 0.626136713 | 0 |
| 21749 | 9020 | 0.629516454 | 0 | 21777 | 9048 | 0.629516454 | -0.028930951 | 21805 | 9076 | 0.627055856 | 0 | 21833 | 9104 | 0.626136713 | 0 |
| 21750 | 9021 | 0.629516454 | 0 | 21778 | 9049 | 0.629516454 | -0.545560747 | 21806 | 9077 | 0.627055856 | 0 | 21834 | 9105 | 0.626136713 | 0 |
| 21751 | 9022 | 0.629516454 | 0 | 21779 | 9050 | 0.629516454 | -1.20502221 | 21807 | 9078 | 0.627055856 | 0 | 21835 | 9106 | 0.626136713 | 0 |
| 21752 | 9023 | 0.629516454 | 0 | 21780 | 9051 | 0.629516454 | -1.460294715 | 21808 | 9079 | 0.626939031 | 0 | 21836 | 9107 | 0.626136713 | 0 |
| 21753 | 9024 | 0.629516454 | 0 | 21781 | 9052 | 0.629516454 | -1.476088982 | 21809 | 9080 | 0.626939031 | 0 | 21837 | 9108 | 0.62591233 | 0 |
| 21754 | 9025 | 0.629516454 | 0 | 21782 | 9053 | 0.629516454 | -1.560409868 | 21810 | 9081 | 0.626939031 | 0 | 21838 | 9109 | 0.62591233 | 0 |
| 21755 | 9026 | 0.629516454 | 0 | 21783 | 9054 | 0.627968166 | 0 | 21811 | 9082 | 0.626939031 | 0 | 21839 | 9110 | 0.62591233 | 0 |
| 21756 | 9027 | 0.629516454 | 0 | 21784 | 9055 | 0.627823296 | -0.836804083 | 21812 | 9083 | 0.626939031 | 0 | 21840 | 9111 | 0.62591233 | 0 |
| 21757 | 9028 | 0.629516454 | 0 | 21785 | 9056 | 0.627710653 | 0 | 21813 | 9084 | 0.626939031 | -0.052697673 | 21841 | 9112 | 0.625656033 | 0 |
| 21758 | 9029 | 0.629516454 | 0 | 21786 | 9057 | 0.627648518 | 0 | 21814 | 9085 | 0.626939031 | -0.353727668 | 21842 | 9113 | 0.625656033 | 0 |
| 21759 | 9030 | 0.629516454 | 0 | 21787 | 9058 | 0.627648518 | 0 | 21815 | 9086 | 0.626810561 | 0 | 21843 | 9114 | 0.625656033 | 0 |
| 21760 | 9031 | 0.629516454 | 0 | 21788 | 9059 | 0.627648518 | 0 | 21816 | 9087 | 0.626810561 | 0 | 21844 | 9115 | 0.625656033 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21845 | 9116 | 0.625656033 | 0 | 21873 | 9144 | 0.62460912 | 0 | 21901 | 9172 | 0.62352609 | 0 | 21929 | 9200 | 0.62233787 | 0 |
| 21846 | 9117 | 0.625656033 | 0 | 21874 | 9145 | 0.624456655 | 0 | 21902 | 9173 | 0.62352609 | 0 | 21930 | 9201 | 0.62233787 | 0 |
| 21847 | 9118 | 0.625656033 | 0 | 21875 | 9146 | 0.624376814 | 0 | 21903 | 9174 | 0.62352609 | 0 | 21931 | 9202 | 0.62233787 | 0 |
| 21848 | 9119 | 0.625656033 | 0 | 21876 | 9147 | 0.624376814 | 0 | 21904 | 9175 | 0.62352609 | 0 | 21932 | 9203 | 0.62233787 | 0 |
| 21849 | 9120 | 0.625513712 | 0 | 21877 | 9148 | 0.624376814 | 0 | 21905 | 9176 | 0.623297334 | 0 | 21933 | 9204 | 0.62233787 | 0 |
| 21850 | 9121 | 0.625513712 | 0 | 21878 | 9149 | 0.624376814 | 0 | 21906 | 9177 | 0.623297334 | 0 | 21934 | 9205 | 0.622176091 | 0 |
| 21851 | 9122 | 0.625360494 | 0 | 21879 | 9150 | 0.624376814 | 0 | 21907 | 9178 | 0.623297334 | 0 | 21935 | 9206 | 0.622176091 | 0 |
| 21852 | 9123 | 0.625360494 | 0 | 21880 | 9151 | 0.624294413 | 0 | 21908 | 9179 | 0.623176276 | 0 | 21936 | 9207 | 0.622176091 | 0 |
| 21853 | 9124 | 0.625360494 | 0 | 21881 | 9152 | 0.624121422 | 0 | 21909 | 9180 | 0.623176276 | 0 | 21937 | 9208 | 0.622176091 | -1.378693995 |
| 21854 | 9125 | 0.625360494 | 0 | 21882 | 9153 | 0.624121422 | 0 | 21910 | 9181 | 0.623050412 | 0 | 21938 | 9209 | 0.622092436 | 0 |
| 21855 | 9126 | 0.62519508 | 0 | 21883 | 9154 | 0.624121422 | 0 | 21911 | 9182 | 0.623050412 | 0 | 21939 | 9210 | 0.622092436 | 0 |
| 21856 | 9127 | 0.62519508 | -1.431192333 | 21884 | 9155 | 0.624121422 | 0 | 21912 | 9183 | 0.623050412 | 0 | 21940 | 9211 | 0.621829625 | 0 |
| 21857 | 9128 | 0.62519508 | -1.431192333 | 21885 | 9156 | 0.624121422 | 0 | 21913 | 9184 | 0.622783071 | 0 | 21941 | 9212 | 0.621829625 | 0 |
| 21858 | 9129 | 0.625015953 | 0 | 21886 | 9157 | 0.624121422 | 0 | 21914 | 9185 | 0.622783071 | 0 | 21942 | 9213 | 0.621829625 | 0 |
| 21859 | 9130 | 0.625015953 | 0 | 21887 | 9158 | 0.624121422 | 0 | 21915 | 9186 | 0.622783071 | 0 | 21943 | 9214 | 0.621829625 | 0 |
| 21860 | 9131 | 0.625015953 | 0 | 21888 | 9159 | 0.624121422 | 0 | 21916 | 9187 | 0.622783071 | 0 | 21944 | 9215 | 0.621829625 | 0 |
| 21861 | 9132 | 0.625015953 | 0 | 21889 | 9160 | 0.624121422 | 0 | 21917 | 9188 | 0.622783071 | 0 | 21945 | 9216 | 0.621829625 | 0 |
| 21862 | 9133 | 0.625015953 | 0 | 21890 | 9161 | 0.623936577 | 0 | 21918 | 9189 | 0.622783071 | -1.540814312 | 21946 | 9217 | 0.621829625 | 0 |
| 21863 | 9134 | 0.625015953 | 0 | 21891 | 9162 | 0.623936577 | 0 | 21919 | 9190 | 0.622611786 | 0 | 21947 | 9218 | 0.621829625 | 0 |
| 21864 | 9135 | 0.62488805 | 0 | 21892 | 9163 | 0.623839321 | 0 | 21920 | 9191 | 0.622492671 | 0 | 21948 | 9219 | 0.621829625 | 0 |
| 21865 | 9136 | 0.624821333 | 0 | 21893 | 9164 | 0.623839321 | 0 | 21921 | 9192 | 0.622492671 | 0 | 21949 | 9220 | 0.621829625 | 0 |
| 21866 | 9137 | 0.624821333 | 0 | 21894 | 9165 | 0.623839321 | 0 | 21922 | 9193 | 0.622492671 | 0 | 21950 | 9221 | 0.621829625 | 0 |
| 21867 | 9138 | 0.624821333 | 0 | 21895 | 9166 | 0.623839321 | 0 | 21923 | 9194 | 0.622492671 | 0 | 21951 | 9222 | 0.621829625 | -1.483775811 |
| 21868 | 9139 | 0.624821333 | 0 | 21896 | 9167 | 0.623839321 | 0 | 21924 | 9195 | 0.622492671 | 0 | 21952 | 9223 | 0.621547524 | 0 |
| 21869 | 9140 | 0.624752664 | 0 | 21897 | 9168 | 0.623839321 | 0 | 21925 | 9196 | 0.622492671 | 0 | 21953 | 9224 | 0.621547524 | 0 |
| 21870 | 9141 | 0.62460912 | 0 | 21898 | 9169 | 0.623738615 | 0 | 21926 | 9197 | 0.622492671 | 0 | 21954 | 9225 | 0.621547524 | 0 |
| 21871 | 9142 | 0.62460912 | 0 | 21899 | 9170 | 0.62352609 | 0 | 21927 | 9198 | 0.622492671 | 0 | 21955 | 9226 | 0.621448832 | 0 |
| 21872 | 9143 | 0.62460912 | 0 | 21900 | 9171 | 0.62352609 | 0 | 21928 | 9199 | 0.62233787 | 0 | 21956 | 9227 | 0.621448832 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 21957 | 9228 | 0.621448832 | 0 | 21985 | 9256 | 0.620561611 | 0 | 22013 | 9284 | 0.619297289 | 0 | 22041 | 9312 | 0.618351457 | 0 |
| 21958 | 9229 | 0.621243928 | 0 | 21986 | 9257 | 0.620561611 | 0 | 22014 | 9285 | 0.619297289 | 0 | 22042 | 9313 | 0.618351457 | 0 |
| 21959 | 9230 | 0.621243928 | 0 | 21987 | 9258 | 0.620561611 | -1.418097035 | 22015 | 9286 | 0.619297289 | 0 | 22043 | 9314 | 0.618351457 | 0 |
| 21960 | 9231 | 0.621243928 | 0 | 21988 | 9259 | 0.620256093 | 0 | 22016 | 9287 | 0.619297289 | 0 | 22044 | 9315 | 0.618351457 | 0 |
| 21961 | 9232 | 0.621243928 | 0 | 21989 | 9260 | 0.620176428 | 0 | 22017 | 9288 | 0.619200186 | 0 | 22045 | 9316 | 0.618351457 | 0 |
| 21962 | 9233 | 0.621243928 | 0 | 21990 | 9261 | 0.620040562 | 0 | 22018 | 9289 | 0.619200186 | 0 | 22046 | 9317 | 0.618351457 | 0 |
| 21963 | 9234 | 0.621243928 | 0 | 21991 | 9262 | 0.620040562 | 0 | 22019 | 9290 | 0.619134418 | 0 | 22047 | 9318 | 0.618351457 | 0 |
| 21964 | 9235 | 0.621243928 | 0 | 21992 | 9263 | 0.620040562 | 0 | 22020 | 9291 | 0.618792589 | 0 | 22048 | 9319 | 0.618235444 | 0 |
| 21965 | 9236 | 0.621243928 | 0 | 21993 | 9264 | 0.620040562 | 0 | 22021 | 9292 | 0.618792589 | 0 | 22049 | 9320 | 0.618235444 | 0 |
| 21966 | 9237 | 0.621243928 | 0 | 21994 | 9265 | 0.620040562 | 0 | 22022 | 9293 | 0.618792589 | 0 | 22050 | 9321 | 0.618235444 | 0 |
| 21967 | 9238 | 0.621028344 | 0 | 21995 | 9266 | 0.620040562 | -1.268855764 | 22023 | 9294 | 0.618792589 | 0 | 22051 | 9322 | 0.618235444 | 0 |
| 21968 | 9239 | 0.621028344 | 0 | 21996 | 9267 | 0.61992899 | 0 | 22024 | 9295 | 0.618792589 | 0 | 22052 | 9323 | 0.618235444 | 0 |
| 21969 | 9240 | 0.621028344 | 0 | 21997 | 9268 | 0.61992899 | 0 | 22025 | 9296 | 0.618792589 | 0 | 22053 | 9324 | 0.618235444 | 0 |
| 21970 | 9241 | 0.621028344 | 0 | 21998 | 9269 | 0.61992899 | 0 | 22026 | 9297 | 0.618792589 | 0 | 22054 | 9325 | 0.618235444 | 0 |
| 21971 | 9242 | 0.621028344 | 0 | 21999 | 9270 | 0.619756617 | 0 | 22027 | 9298 | 0.618792589 | 0 | 22055 | 9326 | 0.618235444 | 0 |
| 21972 | 9243 | 0.621028344 | -1.316172662 | 22000 | 9271 | 0.619756617 | 0 | 22028 | 9299 | 0.618792589 | 0 | 22056 | 9327 | 0.618235444 | 0 |
| 21973 | 9244 | 0.620916282 | 0 | 22001 | 9272 | 0.619756617 | 0 | 22029 | 9300 | 0.618792589 | 0 | 22057 | 9328 | 0.618235444 | -1.318965562 |
| 21974 | 9245 | 0.620916282 | 0 | 22002 | 9273 | 0.619756617 | 0 | 22030 | 9301 | 0.618792589 | 0 | 22058 | 9329 | 0.61815109 | 0 |
| 21975 | 9246 | 0.620847614 | 0 | 22003 | 9274 | 0.619756617 | 0 | 22031 | 9302 | 0.618792589 | 0 | 22059 | 9330 | 0.618036636 | 0 |
| 21976 | 9247 | 0.620561611 | 0 | 22004 | 9275 | 0.619756617 | -0.955144736 | 22032 | 9303 | 0.618792589 | 0 | 22060 | 9331 | 0.618036636 | 0 |
| 21977 | 9248 | 0.620561611 | 0 | 22005 | 9276 | 0.619577932 | 0 | 22033 | 9304 | 0.618792589 | 0 | 22061 | 9332 | 0.618036636 | 0 |
| 21978 | 9249 | 0.620561611 | 0 | 22006 | 9277 | 0.619577932 | 0 | 22034 | 9305 | 0.618792589 | 0 | 22062 | 9333 | 0.618036636 | 0 |
| 21979 | 9250 | 0.620561611 | 0 | 22007 | 9278 | 0.619577932 | 0 | 22035 | 9306 | 0.618792589 | 0 | 22063 | 9334 | 0.617872473 | 0 |
| 21980 | 9251 | 0.620561611 | 0 | 22008 | 9279 | 0.619577932 | 0 | 22036 | 9307 | 0.618792589 | 0 | 22064 | 9335 | 0.617872473 | 0 |
| 21981 | 9252 | 0.620561611 | 0 | 22009 | 9280 | 0.619455128 | 0 | 22037 | 9308 | 0.618792589 | 0 | 22065 | 9336 | 0.617872473 | -1.402302768 |
| 21982 | 9253 | 0.620561611 | 0 | 22010 | 9281 | 0.619455128 | 0 | 22038 | 9309 | 0.618792589 | -1.039654816 | 22066 | 9337 | 0.617617231 | 0 |
| 21983 | 9254 | 0.620561611 | 0 | 22011 | 9282 | 0.619455128 | 0 | 22039 | 9310 | 0.618481155 | 0 | 22067 | 9338 | 0.617617231 | 0 |
| 21984 | 9255 | 0.620561611 | 0 | 22012 | 9283 | 0.619297289 | 0 | 22040 | 9311 | 0.618427482 | 0 | 22068 | 9339 | 0.617427955 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22069 | 9340 | 0.617350547 | 0 | 22097 | 9368 | 0.616152493 | 0 | 22125 | 9396 | 0.614957734 | 0 | 22153 | 9424 | 0.613528349 | 0 |
| 22070 | 9341 | 0.617350547 | 0 | 22098 | 9369 | 0.616152493 | 0 | 22126 | 9397 | 0.614957734 | 0 | 22154 | 9425 | 0.613528349 | 0 |
| 22071 | 9342 | 0.617350547 | 0 | 22099 | 9370 | 0.616152493 | 0 | 22127 | 9398 | 0.614957734 | 0 | 22155 | 9426 | 0.613528349 | 0 |
| 22072 | 9343 | 0.617350547 | 0 | 22100 | 9371 | 0.616152493 | 0 | 22128 | 9399 | 0.614793197 | 0 | 22156 | 9427 | 0.613528349 | 0 |
| 22073 | 9344 | 0.617166016 | 0 | 22101 | 9372 | 0.616152493 | 0 | 22129 | 9400 | 0.614793197 | -1.506052205 | 22157 | 9428 | 0.613528349 | 0 |
| 22074 | 9345 | 0.617166016 | 0 | 22102 | 9373 | 0.616152493 | 0 | 22130 | 9401 | 0.614692678 | 0 | 22158 | 9429 | 0.613528349 | 0 |
| 22075 | 9346 | 0.617166016 | 0 | 22103 | 9374 | 0.616152493 | 0 | 22131 | 9402 | 0.614692678 | 0 | 22159 | 9430 | 0.613528349 | 0 |
| 22076 | 9347 | 0.616927327 | 0 | 22104 | 9375 | 0.616152493 | 0 | 22132 | 9403 | 0.614692678 | 0 | 22160 | 9431 | 0.613528349 | 0 |
| 22077 | 9348 | 0.616927327 | 0 | 22105 | 9376 | 0.616152493 | 0 | 22133 | 9404 | 0.614692678 | 0 | 22161 | 9432 | 0.613528349 | 0 |
| 22078 | 9349 | 0.616927327 | 0 | 22106 | 9377 | 0.616152493 | 0 | 22134 | 9405 | 0.614692678 | 0 | 22162 | 9433 | 0.613528349 | 0 |
| 22079 | 9350 | 0.616927327 | 0 | 22107 | 9378 | 0.616152493 | 0 | 22135 | 9406 | 0.614576104 | 0 | 22163 | 9434 | 0.61330091 | 0 |
| 22080 | 9351 | 0.616779633 | 0 | 22108 | 9379 | 0.616152493 | 0 | 22136 | 9407 | 0.614576104 | 0 | 22164 | 9435 | 0.61330091 | 0 |
| 22081 | 9352 | 0.616779633 | 0 | 22109 | 9380 | 0.616152493 | 0 | 22137 | 9408 | 0.614576104 | 0 | 22165 | 9436 | 0.613237754 | 0 |
| 22082 | 9353 | 0.616779633 | -1.062857071 | 22110 | 9381 | 0.616152493 | 0 | 22138 | 9409 | 0.614576104 | -0.839751318 | 22166 | 9437 | 0.613126038 | 0 |
| 22083 | 9354 | 0.616679229 | 0 | 22111 | 9382 | 0.616152493 | -0.820446163 | 22139 | 9410 | 0.614510546 | 0 | 22167 | 9438 | 0.613126038 | 0 |
| 22084 | 9355 | 0.616679229 | 0 | 22112 | 9383 | 0.61572817 | 0 | 22140 | 9411 | 0.614468526 | 0 | 22168 | 9439 | 0.613126038 | 0 |
| 22085 | 9356 | 0.616606538 | 0 | 22113 | 9384 | 0.61572817 | 0 | 22141 | 9412 | 0.614276488 | 0 | 22169 | 9440 | 0.613126038 | 0 |
| 22086 | 9357 | 0.616606538 | 0 | 22114 | 9385 | 0.615665342 | 0 | 22142 | 9413 | 0.614276488 | 0 | 22170 | 9441 | 0.613126038 | 0 |
| 22087 | 9358 | 0.616606538 | 0 | 22115 | 9386 | 0.615580676 | 0 | 22143 | 9414 | 0.614276488 | 0 | 22171 | 9442 | 0.613126038 | 0 |
| 22088 | 9359 | 0.616551477 | 0 | 22116 | 9387 | 0.615580676 | 0 | 22144 | 9415 | 0.614276488 | 0 | 22172 | 9443 | 0.613126038 | 0 |
| 22089 | 9360 | 0.616152493 | 0 | 22117 | 9388 | 0.61546039 | 0 | 22145 | 9416 | 0.614276488 | 0 | 22173 | 9444 | 0.612874783 | 0 |
| 22090 | 9361 | 0.616152493 | 0 | 22118 | 9389 | 0.61546039 | 0 | 22146 | 9417 | 0.614276488 | 0 | 22174 | 9445 | 0.612874783 | 0 |
| 22091 | 9362 | 0.616152493 | 0 | 22119 | 9390 | 0.61546039 | 0 | 22147 | 9418 | 0.614276488 | 0 | 22175 | 9446 | 0.612874783 | 0 |
| 22092 | 9363 | 0.616152493 | 0 | 22120 | 9391 | 0.615276015 | 0 | 22148 | 9419 | 0.614276488 | -0.449936263 | 22176 | 9447 | 0.612874783 | 0 |
| 22093 | 9364 | 0.616152493 | 0 | 22121 | 9392 | 0.615276015 | 0 | 22149 | 9420 | 0.613964606 | 0 | 22177 | 9448 | 0.612874783 | 0 |
| 22094 | 9365 | 0.616152493 | 0 | 22122 | 9393 | 0.615276015 | 0 | 22150 | 9421 | 0.613964606 | 0 | 22178 | 9449 | 0.612874783 | 0 |
| 22095 | 9366 | 0.616152493 | 0 | 22123 | 9394 | 0.615141329 | 0 | 22151 | 9422 | 0.61383625 | 0 | 22179 | 9450 | 0.612874783 | -0.103564569 |
| 22096 | 9367 | 0.616152493 | 0 | 22124 | 9395 | 0.614957734 | 0 | 22152 | 9423 | 0.613722187 | 0 | 22180 | 9451 | 0.612702955 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22181 | 9452 | 0.612702955 | 0 | 22209 | 9480 | 0.611787687 | 0 | 22237 | 9508 | 0.610400164 | 0 | 22265 | 9536 | 0.609621625 | 0 |
| 22182 | 9453 | 0.612702955 | 0 | 22210 | 9481 | 0.611787687 | 0 | 22238 | 9509 | 0.610400164 | 0 | 22266 | 9537 | 0.609621625 | 0 |
| 22183 | 9454 | 0.612702955 | 0 | 22211 | 9482 | 0.611787687 | 0 | 22239 | 9510 | 0.610211299 | 0 | 22267 | 9538 | 0.609621625 | 0 |
| 22184 | 9455 | 0.612702955 | 0 | 22212 | 9483 | 0.611787687 | 0 | 22240 | 9511 | 0.610211299 | 0 | 22268 | 9539 | 0.609621625 | 0 |
| 22185 | 9456 | 0.612578032 | 0 | 22213 | 9484 | 0.611787687 | 0 | 22241 | 9512 | 0.610211299 | 0 | 22269 | 9540 | 0.609621625 | 0 |
| 22186 | 9457 | 0.612578032 | 0 | 22214 | 9485 | 0.611189073 | 0 | 22242 | 9513 | 0.610211299 | 0 | 22270 | 9541 | 0.609398165 | 0 |
| 22187 | 9458 | 0.612578032 | 0 | 22215 | 9486 | 0.611189073 | 0 | 22243 | 9514 | 0.610211299 | 0 | 22271 | 9542 | 0.609313068 | 0 |
| 22188 | 9459 | 0.612408551 | 0 | 22216 | 9487 | 0.611189073 | 0 | 22244 | 9515 | 0.610211299 | 0 | 22272 | 9543 | 0.609313068 | 0 |
| 22189 | 9460 | 0.612408551 | 0 | 22217 | 9488 | 0.611120055 | 0 | 22245 | 9516 | 0.610211299 | 0 | 22273 | 9544 | 0.609313068 | 0 |
| 22190 | 9461 | 0.612348429 | 0 | 22218 | 9489 | 0.611120055 | 0 | 22246 | 9517 | 0.610211299 | 0 | 22274 | 9545 | 0.609123295 | 0 |
| 22191 | 9462 | 0.611787687 | 0 | 22219 | 9490 | 0.611120055 | 0 | 22247 | 9518 | 0.610211299 | 0 | 22275 | 9546 | 0.609123295 | 0 |
| 22192 | 9463 | 0.611787687 | 0 | 22220 | 9491 | 0.611120055 | 0 | 22248 | 9519 | 0.610211299 | 0 | 22276 | 9547 | 0.609123295 | 0 |
| 22193 | 9464 | 0.611787687 | 0 | 22221 | 9492 | 0.611033048 | 0 | 22249 | 9520 | 0.610211299 | 0 | 22277 | 9548 | 0.609123295 | 0 |
| 22194 | 9465 | 0.611787687 | 0 | 22222 | 9493 | 0.611033048 | 0 | 22250 | 9521 | 0.610211299 | 0 | 22278 | 9549 | 0.609123295 | 0 |
| 22195 | 9466 | 0.611787687 | 0 | 22223 | 9494 | 0.611033048 | 0 | 22251 | 9522 | 0.610211299 | 0 | 22279 | 9550 | 0.609123295 | 0 |
| 22196 | 9467 | 0.611787687 | 0 | 22224 | 9495 | 0.610919966 | 0 | 22252 | 9523 | 0.610211299 | -1.089628791 | 22280 | 9551 | 0.609123295 | 0 |
| 22197 | 9468 | 0.611787687 | 0 | 22225 | 9496 | 0.610919966 | 0 | 22253 | 9524 | 0.610053974 | 0 | 22281 | 9552 | 0.609123295 | -0.464297457 |
| 22198 | 9469 | 0.611787687 | 0 | 22226 | 9497 | 0.610919966 | -1.348557435 | 22254 | 9525 | 0.610053974 | 0 | 22282 | 9553 | 0.608901999 | 0 |
| 22199 | 9470 | 0.611787687 | 0 | 22227 | 9498 | 0.610767018 | 0 | 22255 | 9526 | 0.610053974 | 0 | 22283 | 9554 | 0.608901999 | 0 |
| 22200 | 9471 | 0.611787687 | 0 | 22228 | 9499 | 0.610767018 | 0 | 22256 | 9527 | 0.609962918 | 0 | 22284 | 9555 | 0.608901999 | 0 |
| 22201 | 9472 | 0.611787687 | 0 | 22229 | 9500 | 0.610767018 | 0 | 22257 | 9528 | 0.609962918 | 0 | 22285 | 9556 | 0.608901999 | 0 |
| 22202 | 9473 | 0.611787687 | 0 | 22230 | 9501 | 0.610767018 | 0 | 22258 | 9529 | 0.609962918 | 0 | 22286 | 9557 | 0.608901999 | 0 |
| 22203 | 9474 | 0.611787687 | 0 | 22231 | 9502 | 0.610767018 | -0.164185956 | 22259 | 9530 | 0.609962918 | 0 | 22287 | 9558 | 0.608901999 | -1.304817911 |
| 22204 | 9475 | 0.611787687 | 0 | 22232 | 9503 | 0.610548615 | 0 | 22260 | 9531 | 0.609962918 | 0 | 22288 | 9559 | 0.608901999 | -0.70275792 |
| 22205 | 9476 | 0.611787687 | 0 | 22233 | 9504 | 0.610548615 | 0 | 22261 | 9532 | 0.609962918 | 0 | 22289 | 9560 | 0.608776968 | 0 |
| 22206 | 9477 | 0.611787687 | 0 | 22234 | 9505 | 0.610548615 | 0 | 22262 | 9533 | 0.609962918 | 0 | 22290 | 9561 | 0.608776968 | 0 |
| 22207 | 9478 | 0.611787687 | 0 | 22235 | 9506 | 0.610548615 | 0 | 22263 | 9534 | 0.609962918 | 0 | 22291 | 9562 | 0.608776968 | 0 |
| 22208 | 9479 | 0.611787687 | 0 | 22236 | 9507 | 0.610400164 | 0 | 22264 | 9535 | 0.609861766 | 0 | 22292 | 9563 | 0.608776968 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22293 | 9564 | 0.608776968 | 0 | 22321 | 9592 | 0.607719325 | 0 | 22349 | 9620 | 0.606532547 | 0 | 22377 | 9648 | 0.605516178 | 0 |
| 22294 | 9565 | 0.608776968 | 0 | 22322 | 9593 | 0.607466313 | 0 | 22350 | 9621 | 0.606392655 | 0 | 22378 | 9649 | 0.605516178 | 0 |
| 22295 | 9566 | 0.60869661 | 0 | 22323 | 9594 | 0.607466313 | 0 | 22351 | 9622 | 0.606392655 | 0 | 22379 | 9650 | 0.605321645 | 0 |
| 22296 | 9567 | 0.608327155 | 0 | 22324 | 9595 | 0.607466313 | 0 | 22352 | 9623 | 0.606392655 | 0 | 22380 | 9651 | 0.605157108 | 0 |
| 22297 | 9568 | 0.608327155 | 0 | 22325 | 9596 | 0.607466313 | 0 | 22353 | 9624 | 0.606392655 | 0 | 22381 | 9652 | 0.605157108 | 0 |
| 22298 | 9569 | 0.608327155 | 0 | 22326 | 9597 | 0.607466313 | 0 | 22354 | 9625 | 0.606263994 | 0 | 22382 | 9653 | 0.605157108 | 0 |
| 22299 | 9570 | 0.608327155 | 0 | 22327 | 9598 | 0.607466313 | 0 | 22355 | 9626 | 0.606263994 | 0 | 22383 | 9654 | 0.605157108 | 0 |
| 22300 | 9571 | 0.608327155 | 0 | 22328 | 9599 | 0.607466313 | 0 | 22356 | 9627 | 0.606263994 | 0 | 22384 | 9655 | 0.605016126 | 0 |
| 22301 | 9572 | 0.608327155 | 0 | 22329 | 9600 | 0.607466313 | 0 | 22357 | 9628 | 0.606263994 | -1.149093423 | 22385 | 9656 | 0.605016126 | 0 |
| 22302 | 9573 | 0.608327155 | 0 | 22330 | 9601 | 0.607466313 | 0 | 22358 | 9629 | 0.606203461 | 0 | 22386 | 9657 | 0.604893979 | 0 |
| 22303 | 9574 | 0.608327155 | 0 | 22331 | 9602 | 0.607240059 | 0 | 22359 | 9630 | 0.606203461 | 0 | 22387 | 9658 | 0.604893979 | 0 |
| 22304 | 9575 | 0.608327155 | 0 | 22332 | 9603 | 0.607240059 | 0 | 22360 | 9631 | 0.606035358 | 0 | 22388 | 9659 | 0.604893979 | 0 |
| 22305 | 9576 | 0.608327155 | 0 | 22333 | 9604 | 0.607135674 | -1.165255083 | 22361 | 9632 | 0.606035358 | 0 | 22389 | 9660 | 0.604893979 | 0 |
| 22306 | 9577 | 0.608327155 | 0 | 22334 | 9605 | 0.606852469 | 0 | 22362 | 9633 | 0.606035358 | 0 | 22390 | 9661 | 0.604893979 | 0 |
| 22307 | 9578 | 0.608327155 | 0 | 22335 | 9606 | 0.606852469 | 0 | 22363 | 9634 | 0.606035358 | 0 | 22391 | 9662 | 0.604787129 | 0 |
| 22308 | 9579 | 0.608327155 | 0 | 22336 | 9607 | 0.606852469 | 0 | 22364 | 9635 | 0.606035358 | 0 | 22392 | 9663 | 0.60469287 | 0 |
| 22309 | 9580 | 0.608327155 | 0 | 22337 | 9608 | 0.606852469 | 0 | 22365 | 9636 | 0.606035358 | 0 | 22393 | 9664 | 0.60469287 | 0 |
| 22310 | 9581 | 0.608327155 | 0 | 22338 | 9609 | 0.606852469 | 0 | 22366 | 9637 | 0.606035358 | 0 | 22394 | 9665 | 0.60469287 | 0 |
| 22311 | 9582 | 0.608327155 | 0 | 22339 | 9610 | 0.606852469 | 0 | 22367 | 9638 | 0.606035358 | 0 | 22395 | 9666 | 0.60469287 | 0 |
| 22312 | 9583 | 0.608327155 | 0 | 22340 | 9611 | 0.606852469 | 0 | 22368 | 9639 | 0.606035358 | 0 | 22396 | 9667 | 0.60469287 | 0 |
| 22313 | 9584 | 0.608327155 | -0.226211509 | 22341 | 9612 | 0.606852469 | 0 | 22369 | 9640 | 0.606035358 | -0.228503306 | 22397 | 9668 | 0.60469287 | 0 |
| 22314 | 9585 | 0.608327155 | -1.226211509 | 22342 | 9613 | 0.606852469 | 0 | 22370 | 9641 | 0.605749732 | 0 | 22398 | 9669 | 0.60469287 | 0 |
| 22315 | 9586 | 0.607944348 | 0 | 22343 | 9614 | 0.606852469 | 0 | 22371 | 9642 | 0.605749732 | 0 | 22399 | 9670 | 0.604534166 | 0 |
| 22316 | 9587 | 0.607857394 | -1.393012692 | 22344 | 9615 | 0.606852469 | 0 | 22372 | 9643 | 0.605749732 | 0 | 22400 | 9671 | 0.604534166 | 0 |
| 22317 | 9588 | 0.607719325 | 0 | 22345 | 9616 | 0.606852469 | 0 | 22373 | 9644 | 0.605749732 | 0 | 22401 | 9672 | 0.604534166 | 0 |
| 22318 | 9589 | 0.607719325 | 0 | 22346 | 9617 | 0.606852469 | -0.197722971 | 22374 | 9645 | 0.605749732 | 0 | 22402 | 9673 | 0.604534166 | 0 |
| 22319 | 9590 | 0.607719325 | 0 | 22347 | 9618 | 0.606852469 | -0.37381423 | 22375 | 9646 | 0.605749732 | -0.353727668 | 22403 | 9674 | 0.604534166 | 0 |
| 22320 | 9591 | 0.607719325 | 0 | 22348 | 9619 | 0.606653571 | 0 | 22376 | 9647 | 0.605516178 | 0 | 22404 | 9675 | 0.604534166 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22405 | 9676 | 0.604534166 | 0 | 22433 | 9704 | 0.603187515 | 0 | 22461 | 9732 | 0.602414061 | 0 | 22489 | 9760 | 0.60168736 | 0 |
| 22406 | 9677 | 0.604534166 | 0 | 22434 | 9705 | 0.603187515 | 0 | 22462 | 9733 | 0.602364208 | 0 | 22490 | 9761 | 0.60168736 | 0 |
| 22407 | 9678 | 0.604534166 | 0 | 22435 | 9706 | 0.603187515 | 0 | 22463 | 9734 | 0.602307486 | 0 | 22491 | 9762 | 0.60168736 | 0 |
| 22408 | 9679 | 0.604405734 | 0 | 22436 | 9707 | 0.603187515 | 0 | 22464 | 9735 | 0.602307486 | 0 | 22492 | 9763 | 0.60168736 | 0 |
| 22409 | 9680 | 0.604405734 | 0 | 22437 | 9708 | 0.603187515 | 0 | 22465 | 9736 | 0.602242369 | 0 | 22493 | 9764 | 0.601487731 | 0 |
| 22410 | 9681 | 0.604405734 | 0 | 22438 | 9709 | 0.603187515 | 0 | 22466 | 9737 | 0.602242369 | 0 | 22494 | 9765 | 0.601487731 | 0 |
| 22411 | 9682 | 0.604405734 | 0 | 22439 | 9710 | 0.603187515 | 0 | 22467 | 9738 | 0.602166846 | 0 | 22495 | 9766 | 0.601487731 | 0 |
| 22412 | 9683 | 0.604299666 | 0 | 22440 | 9711 | 0.603187515 | 0 | 22468 | 9739 | 0.602166846 | 0 | 22496 | 9767 | 0.601487731 | 0 |
| 22413 | 9684 | 0.604299666 | 0 | 22441 | 9712 | 0.603187515 | 0 | 22469 | 9740 | 0.602166846 | 0 | 22497 | 9768 | 0.601487731 | 0 |
| 22414 | 9685 | 0.604210589 | 0 | 22442 | 9713 | 0.603187515 | 0 | 22470 | 9741 | 0.602166846 | -0.223771646 | 22498 | 9769 | 0.601487731 | 0 |
| 22415 | 9686 | 0.604210589 | 0 | 22443 | 9714 | 0.603187515 | 0 | 22471 | 9742 | 0.602078206 | 0 | 22499 | 9770 | 0.601487731 | 0 |
| 22416 | 9687 | 0.604134723 | 0 | 22444 | 9715 | 0.603187515 | 0 | 22472 | 9743 | 0.602078206 | 0 | 22500 | 9771 | 0.601366572 | 0 |
| 22417 | 9688 | 0.604069332 | 0 | 22445 | 9716 | 0.603187515 | 0 | 22473 | 9744 | 0.601972705 | 0 | 22501 | 9772 | 0.601366572 | 0 |
| 22418 | 9689 | 0.604069332 | -1.516776071 | 22446 | 9717 | 0.603187515 | 0 | 22474 | 9745 | 0.601972705 | 0 | 22502 | 9773 | 0.601366572 | 0 |
| 22419 | 9690 | 0.604012386 | 0 | 22447 | 9718 | 0.603187515 | 0 | 22475 | 9746 | 0.601972705 | 0 | 22503 | 9774 | 0.601226815 | 0 |
| 22420 | 9691 | 0.60396235 | 0 | 22448 | 9719 | 0.603187515 | 0 | 22476 | 9747 | 0.601972705 | 0 | 22504 | 9775 | 0.601226815 | 0 |
| 22421 | 9692 | 0.603878517 | 0 | 22449 | 9720 | 0.603187515 | 0 | 22477 | 9748 | 0.601972705 | 0 | 22505 | 9776 | 0.601226815 | 0 |
| 22422 | 9693 | 0.603187515 | 0 | 22450 | 9721 | 0.603187515 | 0 | 22478 | 9749 | 0.601972705 | 0 | 22506 | 9777 | 0.601226815 | 0 |
| 22423 | 9694 | 0.603187515 | 0 | 22451 | 9722 | 0.603187515 | 0 | 22479 | 9750 | 0.601972705 | 0 | 22507 | 9778 | 0.601226815 | 0 |
| 22424 | 9695 | 0.603187515 | 0 | 22452 | 9723 | 0.603187515 | 0 | 22480 | 9751 | 0.601972705 | 0 | 22508 | 9779 | 0.601226815 | 0 |
| 22425 | 9696 | 0.603187515 | 0 | 22453 | 9724 | 0.603187515 | 0 | 22481 | 9752 | 0.601972705 | 0 | 22509 | 9780 | 0.601226815 | 0 |
| 22426 | 9697 | 0.603187515 | 0 | 22454 | 9725 | 0.603187515 | 0 | 22482 | 9753 | 0.601972705 | -0.264750642 | 22510 | 9781 | 0.601226815 | 0 |
| 22427 | 9698 | 0.603187515 | 0 | 22455 | 9726 | 0.603187515 | 0 | 22483 | 9754 | 0.601845028 | 0 | 22511 | 9782 | 0.601226815 | 0 |
| 22428 | 9699 | 0.603187515 | 0 | 22456 | 9727 | 0.603187515 | 0 | 22484 | 9755 | 0.601845028 | 0 | 22512 | 9783 | 0.601226815 | 0 |
| 22429 | 9700 | 0.603187515 | 0 | 22457 | 9728 | 0.603187515 | 0 | 22485 | 9756 | 0.601845028 | 0 | 22513 | 9784 | 0.601063822 | -1.437594825 |
| 22430 | 9701 | 0.603187515 | 0 | 22458 | 9729 | 0.603187515 | 0 | 22486 | 9757 | 0.601845028 | 0 | 22514 | 9785 | 0.600871273 | 0 |
| 22431 | 9702 | 0.603187515 | 0 | 22459 | 9730 | 0.603187515 | 0 | 22487 | 9758 | 0.601845028 | 0 | 22515 | 9786 | 0.600871273 | 0 |
| 22432 | 9703 | 0.603187515 | 0 | 22460 | 9731 | 0.603187515 | -0.771263233 | 22488 | 9759 | 0.601845028 | 0 | 22516 | 9787 | 0.600871273 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22517 | 9788 | 0.600871273 | 0 | 22545 | 9816 | 0.599553231 | 0 | 22573 | 9844 | 0.598702507 | 0 | 22601 | 9872 | 0.597547248 | 0 |
| 22518 | 9789 | 0.600871273 | 0 | 22546 | 9817 | 0.599553231 | 0 | 22574 | 9845 | 0.598702507 | 0 | 22602 | 9873 | 0.597547248 | 0 |
| 22519 | 9790 | 0.600871273 | -0.320817567 | 22547 | 9818 | 0.599553231 | 0 | 22575 | 9846 | 0.598567318 | 0 | 22603 | 9874 | 0.597547248 | -1.015142666 |
| 22520 | 9791 | 0.600640326 | 0 | 22548 | 9819 | 0.599553231 | 0 | 22576 | 9847 | 0.598567318 | 0 | 22604 | 9875 | 0.597547248 | -1.617202658 |
| 22521 | 9792 | 0.600640326 | 0 | 22549 | 9820 | 0.599553231 | 0 | 22577 | 9848 | 0.598567318 | 0 | 22605 | 9876 | 0.597331771 | 0 |
| 22522 | 9793 | 0.600640326 | 0 | 22550 | 9821 | 0.599553231 | 0 | 22578 | 9849 | 0.598567318 | 0 | 22606 | 9877 | 0.597331771 | 0 |
| 22523 | 9794 | 0.600640326 | 0 | 22551 | 9822 | 0.599553231 | 0 | 22579 | 9850 | 0.598567318 | 0 | 22607 | 9878 | 0.597331771 | 0 |
| 22524 | 9795 | 0.600640326 | 0 | 22552 | 9823 | 0.599333945 | 0 | 22580 | 9851 | 0.598567318 | 0 | 22608 | 9879 | 0.597331771 | 0 |
| 22525 | 9796 | 0.600640326 | -1.358837074 | 22553 | 9824 | 0.599172438 | 0 | 22581 | 9852 | 0.598567318 | -1.402302768 | 22609 | 9880 | 0.597331771 | 0 |
| 22526 | 9797 | 0.600552758 | -0.057894647 | 22554 | 9825 | 0.599172438 | 0 | 22582 | 9853 | 0.598567318 | -1.402302768 | 22610 | 9881 | 0.597331771 | -0.572998995 |
| 22527 | 9798 | 0.600358225 | 0 | 22555 | 9826 | 0.599172438 | 0 | 22583 | 9854 | 0.59848222 | 0 | 22611 | 9882 | 0.597147161 | 0 |
| 22528 | 9799 | 0.600358225 | 0 | 22556 | 9827 | 0.599172438 | 0 | 22584 | 9855 | 0.59848222 | 0 | 22612 | 9883 | 0.597147161 | 0 |
| 22529 | 9800 | 0.600358225 | 0 | 22557 | 9828 | 0.599172438 | 0 | 22585 | 9856 | 0.598423726 | -0.963113666 | 22613 | 9884 | 0.597147161 | 0 |
| 22530 | 9801 | 0.600358225 | 0 | 22558 | 9829 | 0.599172438 | 0 | 22586 | 9857 | 0.598381045 | 0 | 22614 | 9885 | 0.597147161 | 0 |
| 22531 | 9802 | 0.600358225 | 0 | 22559 | 9830 | 0.598950462 | 0 | 22587 | 9858 | 0.59810799 | 0 | 22615 | 9886 | 0.597147161 | -0.304338292 |
| 22532 | 9803 | 0.600358225 | -0.271968999 | 22560 | 9831 | 0.598950462 | 0 | 22588 | 9859 | 0.59810799 | 0 | 22616 | 9887 | 0.59706443 | 0 |
| 22533 | 9804 | 0.600192369 | -1.589733953 | 22561 | 9832 | 0.598950462 | 0 | 22589 | 9860 | 0.59810799 | 0 | 22617 | 9888 | 0.596847337 | 0 |
| 22534 | 9805 | 0.600132676 | -0.155224741 | 22562 | 9833 | 0.598950462 | 0 | 22590 | 9861 | 0.59810799 | 0 | 22618 | 9889 | 0.596847337 | 0 |
| 22535 | 9806 | 0.600005857 | 0 | 22563 | 9834 | 0.598950462 | 0 | 22591 | 9862 | 0.59810799 | 0 | 22619 | 9890 | 0.596847337 | 0 |
| 22536 | 9807 | 0.600005857 | 0 | 22564 | 9835 | 0.598950462 | 0 | 22592 | 9863 | 0.59810799 | 0 | 22620 | 9891 | 0.596847337 | 0 |
| 22537 | 9808 | 0.600005857 | 0 | 22565 | 9836 | 0.598950462 | -0.837648193 | 22593 | 9864 | 0.59810799 | 0 | 22621 | 9892 | 0.596847337 | 0 |
| 22538 | 9809 | 0.600005857 | 0 | 22566 | 9837 | 0.598805092 | 0 | 22594 | 9865 | 0.59810799 | 0 | 22622 | 9893 | 0.596847337 | 0 |
| 22539 | 9810 | 0.600005857 | 0 | 22567 | 9838 | 0.598702507 | 0 | 22595 | 9866 | 0.59810799 | -1.060339415 | 22623 | 9894 | 0.596847337 | 0 |
| 22540 | 9811 | 0.599868051 | 0 | 22568 | 9839 | 0.598702507 | 0 | 22596 | 9867 | 0.59810799 | -1.361369411 | 22624 | 9895 | 0.596847337 | 0 |
| 22541 | 9812 | 0.599868051 | 0 | 22569 | 9840 | 0.598702507 | 0 | 22597 | 9868 | 0.59774743 | 0 | 22625 | 9896 | 0.596847337 | 0 |
| 22542 | 9813 | 0.599868051 | 0 | 22570 | 9841 | 0.598702507 | 0 | 22598 | 9869 | 0.59774743 | -1.507858006 | 22626 | 9897 | 0.596847337 | 0 |
| 22543 | 9814 | 0.599553231 | 0 | 22571 | 9842 | 0.598702507 | 0 | 22599 | 9870 | 0.597547248 | 0 | 22627 | 9898 | 0.596847337 | 0 |
| 22544 | 9815 | 0.599553231 | 0 | 22572 | 9843 | 0.598702507 | 0 | 22600 | 9871 | 0.597547248 | 0 | 22628 | 9899 | 0.596516194 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22629 | 9900 | 0.596516194 | 0 | 22657 | 9928 | 0.595397271 | 0 | 22685 | 9956 | 0.594754348 | 0 | 22713 | 9984 | 0.593711624 | 0 |
| 22630 | 9901 | 0.596516194 | 0 | 22658 | 9929 | 0.595397271 | 0 | 22686 | 9957 | 0.594754348 | 0 | 22714 | 9985 | 0.59347135 | 0 |
| 22631 | 9902 | 0.596516194 | 0 | 22659 | 9930 | 0.595397271 | 0 | 22687 | 9958 | 0.594754348 | 0 | 22715 | 9986 | 0.59347135 | 0 |
| 22632 | 9903 | 0.596516194 | 0 | 22660 | 9931 | 0.595330718 | 0 | 22688 | 9959 | 0.594754348 | 0 | 22716 | 9987 | 0.59347135 | 0 |
| 22633 | 9904 | 0.596387036 | 0 | 22661 | 9932 | 0.595330718 | -1.525514685 | 22689 | 9960 | 0.594754348 | 0 | 22717 | 9988 | 0.59347135 | 0 |
| 22634 | 9905 | 0.596275521 | 0 | 22662 | 9933 | 0.594754348 | 0 | 22690 | 9961 | 0.594754348 | 0 | 22718 | 9989 | 0.59347135 | 0 |
| 22635 | 9906 | 0.596275521 | -0.501504578 | 22663 | 9934 | 0.594754348 | 0 | 22691 | 9962 | 0.594754348 | 0 | 22719 | 9990 | 0.59347135 | 0 |
| 22636 | 9907 | 0.596275521 | -0.70562456 | 22664 | 9935 | 0.594754348 | 0 | 22692 | 9963 | 0.594754348 | 0 | 22720 | 9991 | 0.593304281 | 0 |
| 22637 | 9908 | 0.596275521 | -0.08237527 | 22665 | 9936 | 0.594754348 | 0 | 22693 | 9964 | 0.594754348 | 0 | 22721 | 9992 | 0.593304281 | 0 |
| 22638 | 9909 | 0.596275521 | -1.103564569 | 22666 | 9937 | 0.594754348 | 0 | 22694 | 9965 | 0.594754348 | 0 | 22722 | 9993 | 0.593304281 | 0 |
| 22639 | 9910 | 0.596092699 | 0 | 22667 | 9938 | 0.594754348 | 0 | 22695 | 9966 | 0.594754348 | 0 | 22723 | 9994 | 0.593087189 | 0 |
| 22640 | 9911 | 0.595949106 | 0 | 22668 | 9939 | 0.594754348 | 0 | 22696 | 9967 | 0.594336958 | 0 | 22724 | 9995 | 0.593087189 | 0 |
| 22641 | 9912 | 0.595949106 | 0 | 22669 | 9940 | 0.594754348 | 0 | 22697 | 9968 | 0.594086716 | 0 | 22725 | 9996 | 0.592793647 | 0 |
| 22642 | 9913 | 0.595949106 | 0 | 22670 | 9941 | 0.594754348 | 0 | 22698 | 9969 | 0.593995755 | 0 | 22726 | 9997 | 0.592793647 | 0 |
| 22643 | 9914 | 0.595949106 | 0 | 22671 | 9942 | 0.594754348 | 0 | 22699 | 9970 | 0.593995755 | 0 | 22727 | 9998 | 0.592793647 | 0 |
| 22644 | 9915 | 0.595949106 | -1.50965633 | 22672 | 9943 | 0.594754348 | 0 | 22700 | 9971 | 0.593995755 | 0 | 22728 | 9999 | 0.592793647 | 0 |
| 22645 | 9916 | 0.595738028 | 0 | 22673 | 9944 | 0.594754348 | 0 | 22701 | 9972 | 0.593995755 | 0 | 22729 | 10000 | 0.592793647 | 0 |
| 22646 | 9917 | 0.595738028 | 0 | 22674 | 9945 | 0.594754348 | 0 | 22702 | 9973 | 0.593995755 | 0 | 22730 | 10001 | 0.592671397 | 0 |
| 22647 | 9918 | 0.595738028 | 0 | 22675 | 9946 | 0.594754348 | 0 | 22703 | 9974 | 0.593876098 | 0 | 22731 | 10002 | 0.592671397 | 0 |
| 22648 | 9919 | 0.595738028 | 0 | 22676 | 9947 | 0.594754348 | 0 | 22704 | 9975 | 0.593876098 | 0 | 22732 | 10003 | 0.592671397 | 0 |
| 22649 | 9920 | 0.595590334 | 0 | 22677 | 9948 | 0.594754348 | 0 | 22705 | 9976 | 0.593876098 | 0 | 22733 | 10004 | 0.592671397 | -0.843927258 |
| 22650 | 9921 | 0.595590334 | 0 | 22678 | 9949 | 0.594754348 | 0 | 22706 | 9977 | 0.593876098 | -0.229381556 | 22734 | 10005 | 0.592604371 | 0 |
| 22651 | 9922 | 0.595590334 | 0 | 22679 | 9950 | 0.594754348 | 0 | 22707 | 9978 | 0.593711624 | 0 | 22735 | 10006 | 0.592374646 | 0 |
| 22652 | 9923 | 0.595590334 | 0 | 22680 | 9951 | 0.594754348 | 0 | 22708 | 9979 | 0.593711624 | 0 | 22736 | 10007 | 0.592374646 | 0 |
| 22653 | 9924 | 0.595590334 | 0 | 22681 | 9952 | 0.594754348 | 0 | 22709 | 9980 | 0.593711624 | 0 | 22737 | 10008 | 0.592374646 | 0 |
| 22654 | 9925 | 0.595481201 | 0 | 22682 | 9953 | 0.594754348 | 0 | 22710 | 9981 | 0.593711624 | 0 | 22738 | 10009 | 0.592374646 | 0 |
| 22655 | 9926 | 0.595481201 | 0 | 22683 | 9954 | 0.594754348 | 0 | 22711 | 9982 | 0.593711624 | 0 | 22739 | 10010 | 0.592374646 | 0 |
| 22656 | 9927 | 0.595481201 | 0 | 22684 | 9955 | 0.594754348 | 0 | 22712 | 9983 | 0.593711624 | 0 | 22740 | 10011 | 0.592374646 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22741 | 10012 | 0.592374646 | 0 | 22769 | 10040 | 0.591727893 | 0 | 22797 | 10068 | 0.590598388 | 0 | 22825 | 10096 | 0.589869094 | 0 |
| 22742 | 10013 | 0.592374646 | 0 | 22770 | 10041 | 0.591553932 | 0 | 22798 | 10069 | 0.590598388 | 0 | 22826 | 10097 | 0.589869094 | 0 |
| 22743 | 10014 | 0.592374646 | 0 | 22771 | 10042 | 0.591553932 | 0 | 22799 | 10070 | 0.590598388 | 0 | 22827 | 10098 | 0.589771947 | 0 |
| 22744 | 10015 | 0.592374646 | 0 | 22772 | 10043 | 0.591426405 | 0 | 22800 | 10071 | 0.590598388 | 0 | 22828 | 10099 | 0.589771947 | 0 |
| 22745 | 10016 | 0.592374646 | 0 | 22773 | 10044 | 0.591426405 | 0 | 22801 | 10072 | 0.590598388 | 0 | 22829 | 10100 | 0.589644942 | 0 |
| 22746 | 10017 | 0.592374646 | 0 | 22774 | 10045 | 0.591426405 | 0 | 22802 | 10073 | 0.590598388 | 0 | 22830 | 10101 | 0.589644942 | 0 |
| 22747 | 10018 | 0.592374646 | 0 | 22775 | 10046 | 0.591426405 | 0 | 22803 | 10074 | 0.590598388 | 0 | 22831 | 10102 | 0.589644942 | 0 |
| 22748 | 10019 | 0.592374646 | -1.212200794 | 22776 | 10047 | 0.591426405 | 0 | 22804 | 10075 | 0.590598388 | 0 | 22832 | 10103 | 0.589644942 | 0 |
| 22749 | 10020 | 0.592374646 | -1.212200794 | 22777 | 10048 | 0.591426405 | -0.942082264 | 22805 | 10076 | 0.590598388 | 0 | 22833 | 10104 | 0.589644942 | 0 |
| 22750 | 10021 | 0.592089956 | 0 | 22778 | 10049 | 0.591251954 | 0 | 22806 | 10077 | 0.590598388 | -0.125840964 | 22834 | 10105 | 0.589644942 | 0 |
| 22751 | 10022 | 0.592089956 | 0 | 22779 | 10050 | 0.591251954 | 0 | 22807 | 10078 | 0.590598388 | -0.544970271 | 22835 | 10106 | 0.589471813 | 0 |
| 22752 | 10023 | 0.591979294 | 0 | 22780 | 10051 | 0.59113822 | 0 | 22808 | 10079 | 0.590222538 | 0 | 22836 | 10107 | 0.589221859 | 0 |
| 22753 | 10024 | 0.591979294 | 0 | 22781 | 10052 | 0.59113822 | 0 | 22809 | 10080 | 0.590222538 | 0 | 22837 | 10108 | 0.589221859 | 0 |
| 22754 | 10025 | 0.591979294 | 0 | 22782 | 10053 | 0.59113822 | 0 | 22810 | 10081 | 0.590102335 | 0 | 22838 | 10109 | 0.589221859 | 0 |
| 22755 | 10026 | 0.591979294 | 0 | 22783 | 10054 | 0.59113822 | 0 | 22811 | 10082 | 0.590102335 | 0 | 22839 | 10110 | 0.589221859 | 0 |
| 22756 | 10027 | 0.591979294 | 0 | 22784 | 10055 | 0.59113822 | 0 | 22812 | 10083 | 0.590102335 | 0 | 22840 | 10111 | 0.589221859 | 0 |
| 22757 | 10028 | 0.591979294 | 0 | 22785 | 10056 | 0.59113822 | 0 | 22813 | 10084 | 0.590007913 | 0 | 22841 | 10112 | 0.589221859 | 0 |
| 22758 | 10029 | 0.591979294 | 0 | 22786 | 10057 | 0.590998844 | 0 | 22814 | 10085 | 0.590007913 | 0 | 22842 | 10113 | 0.589221859 | 0 |
| 22759 | 10030 | 0.591979294 | 0 | 22787 | 10058 | 0.590998844 | 0 | 22815 | 10086 | 0.590007913 | 0 | 22843 | 10114 | 0.589221859 | 0 |
| 22760 | 10031 | 0.591979294 | 0 | 22788 | 10059 | 0.590953059 | -1.61156239 | 22816 | 10087 | 0.590007913 | 0 | 22844 | 10115 | 0.589221859 | 0 |
| 22761 | 10032 | 0.591883918 | 0 | 22789 | 10060 | 0.590598388 | 0 | 22817 | 10088 | 0.590007913 | 0 | 22845 | 10116 | 0.589221859 | 0 |
| 22762 | 10033 | 0.591727893 | 0 | 22790 | 10061 | 0.590598388 | 0 | 22818 | 10089 | 0.590007913 | 0 | 22846 | 10117 | 0.589221859 | 0 |
| 22763 | 10034 | 0.591727893 | 0 | 22791 | 10062 | 0.590598388 | 0 | 22819 | 10090 | 0.590007913 | 0 | 22847 | 10118 | 0.589221859 | -1.324498051 |
| 22764 | 10035 | 0.591727893 | 0 | 22792 | 10063 | 0.590598388 | 0 | 22820 | 10091 | 0.589869094 | 0 | 22848 | 10119 | 0.589221859 | -1.324498051 |
| 22765 | 10036 | 0.591727893 | 0 | 22793 | 10064 | 0.590598388 | 0 | 22821 | 10092 | 0.589869094 | 0 | 22849 | 10120 | 0.5890501 | 0 |
| 22766 | 10037 | 0.591727893 | 0 | 22794 | 10065 | 0.590598388 | 0 | 22822 | 10093 | 0.589869094 | 0 | 22850 | 10121 | 0.588982908 | 0 |
| 22767 | 10038 | 0.591727893 | 0 | 22795 | 10066 | 0.590598388 | 0 | 22823 | 10094 | 0.589869094 | 0 | 22851 | 10122 | 0.588982908 | 0 |
| 22768 | 10039 | 0.591727893 | 0 | 22796 | 10067 | 0.590598388 | 0 | 22824 | 10095 | 0.589869094 | 0 | 22852 | 10123 | 0.588982908 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22853 | 10124 | 0.588982908 | 0 | 22881 | 10152 | 0.588123769 | 0 | 22909 | 10180 | 0.587227392 | 0 | 22937 | 10208 | 0.586481822 | 0 |
| 22854 | 10125 | 0.588829365 | 0 | 22882 | 10153 | 0.588123769 | 0 | 22910 | 10181 | 0.587227392 | 0 | 22938 | 10209 | 0.586481822 | 0 |
| 22855 | 10126 | 0.588829365 | 0 | 22883 | 10154 | 0.588123769 | 0 | 22911 | 10182 | 0.587227392 | 0 | 22939 | 10210 | 0.586481822 | 0 |
| 22856 | 10127 | 0.588829365 | 0 | 22884 | 10155 | 0.588123769 | 0 | 22912 | 10183 | 0.587227392 | 0 | 22940 | 10211 | 0.586481822 | 0 |
| 22857 | 10128 | 0.588829365 | 0 | 22885 | 10156 | 0.587654007 | 0 | 22913 | 10184 | 0.587227392 | 0 | 22941 | 10212 | 0.586481822 | 0 |
| 22858 | 10129 | 0.588829365 | 0 | 22886 | 10157 | 0.587654007 | 0 | 22914 | 10185 | 0.587227392 | 0 | 22942 | 10213 | 0.586481822 | -1.151146829 |
| 22859 | 10130 | 0.588829365 | 0 | 22887 | 10158 | 0.587654007 | 0 | 22915 | 10186 | 0.587227392 | 0 | 22943 | 10214 | 0.586481822 | -1.151146829 |
| 22860 | 10131 | 0.588643571 | 0 | 22888 | 10159 | 0.587654007 | 0 | 22916 | 10187 | 0.587227392 | 0 | 22944 | 10215 | 0.586481822 | -1.327238088 |
| 22861 | 10132 | 0.588643571 | 0 | 22889 | 10160 | 0.587654007 | 0 | 22917 | 10188 | 0.587227392 | 0 | 22945 | 10216 | 0.586154176 | 0 |
| 22862 | 10133 | 0.588643571 | 0 | 22890 | 10161 | 0.587654007 | 0 | 22918 | 10189 | 0.587227392 | -0.158370188 | 22946 | 10217 | 0.586154176 | 0 |
| 22863 | 10134 | 0.588643571 | 0 | 22891 | 10162 | 0.587654007 | 0 | 22919 | 10190 | 0.587067519 | 0 | 22947 | 10218 | 0.586154176 | 0 |
| 22864 | 10135 | 0.588643571 | 0 | 22892 | 10163 | 0.587507311 | 0 | 22920 | 10191 | 0.586964103 | 0 | 22948 | 10219 | 0.586154176 | 0 |
| 22865 | 10136 | 0.588643571 | 0 | 22893 | 10164 | 0.587507311 | 0 | 22921 | 10192 | 0.586964103 | 0 | 22949 | 10220 | 0.58605076 | 0 |
| 22866 | 10137 | 0.588643571 | -1.348557435 | 22894 | 10165 | 0.587507311 | 0 | 22922 | 10193 | 0.586964103 | 0 | 22950 | 10221 | 0.58605076 | -0.874028991 |
| 22867 | 10138 | 0.588535228 | 0 | 22895 | 10166 | 0.587507311 | 0 | 22923 | 10194 | 0.586964103 | -1.301932223 | 22951 | 10222 | 0.585851953 | 0 |
| 22868 | 10139 | 0.588535228 | 0 | 22896 | 10167 | 0.587507311 | 0 | 22924 | 10195 | 0.586838239 | 0 | 22952 | 10223 | 0.585851953 | 0 |
| 22869 | 10140 | 0.588535228 | 0 | 22897 | 10168 | 0.587507311 | 0 | 22925 | 10196 | 0.586838239 | 0 | 22953 | 10224 | 0.585851953 | 0 |
| 22870 | 10141 | 0.588535228 | -1.149093423 | 22898 | 10169 | 0.587507311 | 0 | 22926 | 10197 | 0.586838239 | 0 | 22954 | 10225 | 0.585851953 | 0 |
| 22871 | 10142 | 0.588123769 | 0 | 22899 | 10170 | 0.587507311 | 0 | 22927 | 10198 | 0.586838239 | 0 | 22955 | 10226 | 0.585851953 | 0 |
| 22872 | 10143 | 0.588123769 | 0 | 22900 | 10171 | 0.587393248 | 0 | 22928 | 10199 | 0.586764474 | 0 | 22956 | 10227 | 0.585851953 | 0 |
| 22873 | 10144 | 0.588123769 | 0 | 22901 | 10172 | 0.587393248 | 0 | 22929 | 10200 | 0.586764474 | 0 | 22957 | 10228 | 0.585851953 | -0.145146119 |
| 22874 | 10145 | 0.588123769 | 0 | 22902 | 10173 | 0.587393248 | 0 | 22930 | 10201 | 0.586481822 | 0 | 22958 | 10229 | 0.585851953 | -1.186538804 |
| 22875 | 10146 | 0.588123769 | 0 | 22903 | 10174 | 0.587227392 | 0 | 22931 | 10202 | 0.586481822 | 0 | 22959 | 10230 | 0.58573753 | 0 |
| 22876 | 10147 | 0.588123769 | 0 | 22904 | 10175 | 0.587227392 | 0 | 22932 | 10203 | 0.586481822 | 0 | 22960 | 10231 | 0.58566317 | 0 |
| 22877 | 10148 | 0.588123769 | 0 | 22905 | 10176 | 0.587227392 | 0 | 22933 | 10204 | 0.586481822 | 0 | 22961 | 10232 | 0.58566317 | 0 |
| 22878 | 10149 | 0.588123769 | 0 | 22906 | 10177 | 0.587227392 | 0 | 22934 | 10205 | 0.586481822 | 0 | 22962 | 10233 | 0.585572304 | 0 |
| 22879 | 10150 | 0.588123769 | 0 | 22907 | 10178 | 0.587227392 | 0 | 22935 | 10206 | 0.586481822 | 0 | 22963 | 10234 | 0.585312792 | 0 |
| 22880 | 10151 | 0.588123769 | 0 | 22908 | 10179 | 0.587227392 | 0 | 22936 | 10207 | 0.586481822 | 0 | 22964 | 10235 | 0.585312792 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 22965 | 10236 | 0.585312792 | 0 | 22993 | 10264 | 0.584438079 | 0 | 23021 | 10292 | 0.583565125 | 0 | 23049 | 10320 | 0.582403909 | 0 |
| 22966 | 10237 | 0.585312792 | 0 | 22994 | 10265 | 0.584438079 | 0 | 23022 | 10293 | 0.583473337 | 0 | 23050 | 10321 | 0.582403909 | -1.155224741 |
| 22967 | 10238 | 0.585312792 | 0 | 22995 | 10266 | 0.584438079 | 0 | 23023 | 10294 | 0.583473337 | 0 | 23051 | 10322 | 0.582241587 | 0 |
| 22968 | 10239 | 0.585312792 | 0 | 22996 | 10267 | 0.584438079 | 0 | 23024 | 10295 | 0.583473337 | 0 | 23052 | 10323 | 0.582091804 | 0 |
| 22969 | 10240 | 0.585312792 | 0 | 22997 | 10268 | 0.584078415 | 0 | 23025 | 10296 | 0.583473337 | 0 | 23053 | 10324 | 0.582091804 | 0 |
| 22970 | 10241 | 0.585312792 | 0 | 22998 | 10269 | 0.584078415 | 0 | 23026 | 10297 | 0.583384733 | -1.53746067 | 23054 | 10325 | 0.582091804 | 0 |
| 22971 | 10242 | 0.585312792 | 0 | 22999 | 10270 | 0.584078415 | 0 | 23027 | 10298 | 0.583216434 | 0 | 23055 | 10326 | 0.582091804 | 0 |
| 22972 | 10243 | 0.585312792 | 0 | 23000 | 10271 | 0.584078415 | 0 | 23028 | 10299 | 0.583216434 | 0 | 23056 | 10327 | 0.581953163 | 0 |
| 22973 | 10244 | 0.585312792 | 0 | 23001 | 10272 | 0.584078415 | 0 | 23029 | 10300 | 0.583216434 | 0 | 23057 | 10328 | 0.581953163 | 0 |
| 22974 | 10245 | 0.585312792 | 0 | 23002 | 10273 | 0.584078415 | 0 | 23030 | 10301 | 0.583216434 | 0 | 23058 | 10329 | 0.581953163 | 0 |
| 22975 | 10246 | 0.585312792 | 0 | 23003 | 10274 | 0.584078415 | -1.304817911 | 23031 | 10302 | 0.583216434 | 0 | 23059 | 10330 | 0.581824464 | 0 |
| 22976 | 10247 | 0.584994511 | 0 | 23004 | 10275 | 0.583967809 | 0 | 23032 | 10303 | 0.582984129 | 0 | 23060 | 10331 | 0.581824464 | 0 |
| 22977 | 10248 | 0.584994511 | 0 | 23005 | 10276 | 0.583967809 | 0 | 23033 | 10304 | 0.582984129 | 0 | 23061 | 10332 | 0.581824464 | 0 |
| 22978 | 10249 | 0.584994511 | 0 | 23006 | 10277 | 0.583967809 | 0 | 23034 | 10305 | 0.582984129 | 0 | 23062 | 10333 | 0.581824464 | 0 |
| 22979 | 10250 | 0.584994511 | 0 | 23007 | 10278 | 0.583967809 | 0 | 23035 | 10306 | 0.582984129 | 0 | 23063 | 10334 | 0.581824464 | -1.523780972 |
| 22980 | 10251 | 0.584846059 | 0 | 23008 | 10279 | 0.583758964 | 0 | 23036 | 10307 | 0.582984129 | 0 | 23064 | 10335 | 0.581592902 | 0 |
| 22981 | 10252 | 0.584846059 | 0 | 23009 | 10280 | 0.583758964 | 0 | 23037 | 10308 | 0.582773051 | 0 | 23065 | 10336 | 0.581592902 | 0 |
| 22982 | 10253 | 0.584846059 | 0 | 23010 | 10281 | 0.583758964 | 0 | 23038 | 10309 | 0.582773051 | 0 | 23066 | 10337 | 0.581592902 | 0 |
| 22983 | 10254 | 0.584846059 | 0 | 23011 | 10282 | 0.583758964 | 0 | 23039 | 10310 | 0.582773051 | 0 | 23067 | 10338 | 0.581592902 | 0 |
| 22984 | 10255 | 0.584846059 | 0 | 23012 | 10283 | 0.583758964 | 0 | 23040 | 10311 | 0.582773051 | 0 | 23068 | 10339 | 0.581488366 | 0 |
| 22985 | 10256 | 0.584846059 | 0 | 23013 | 10284 | 0.583758964 | 0 | 23041 | 10312 | 0.582773051 | 0 | 23069 | 10340 | 0.581488366 | -0.225898052 |
| 22986 | 10257 | 0.584846059 | -1.249692605 | 23014 | 10285 | 0.583758964 | 0 | 23042 | 10313 | 0.582773051 | 0 | 23070 | 10341 | 0.581390386 | 0 |
| 22987 | 10258 | 0.58470411 | 0 | 23015 | 10286 | 0.583758964 | 0 | 23043 | 10314 | 0.582580416 | 0 | 23071 | 10342 | 0.581390386 | 0 |
| 22988 | 10259 | 0.58470411 | 0 | 23016 | 10287 | 0.583758964 | 0 | 23044 | 10315 | 0.582580416 | 0 | 23072 | 10343 | 0.581390386 | 0 |
| 22989 | 10260 | 0.58470411 | 0 | 23017 | 10288 | 0.583758964 | 0 | 23045 | 10316 | 0.582580416 | 0 | 23073 | 10344 | 0.581390386 | 0 |
| 22990 | 10261 | 0.58470411 | 0 | 23018 | 10289 | 0.583758964 | 0 | 23046 | 10317 | 0.582403909 | 0 | 23074 | 10345 | 0.581390386 | 0 |
| 22991 | 10262 | 0.58470411 | -0.736501127 | 23019 | 10290 | 0.583758964 | 0 | 23047 | 10318 | 0.582403909 | 0 | 23075 | 10346 | 0.581211775 | 0 |
| 22992 | 10263 | 0.584438079 | 0 | 23020 | 10291 | 0.583758964 | -0.727900955 | 23048 | 10319 | 0.582403909 | 0 | 23076 | 10347 | 0.581211775 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23077 | 10348 | 0.581211775 | 0 | 23105 | 10376 | 0.578363932 | 0 | 23133 | 10404 | 0.578363932 | 0 | 23161 | 10432 | 0.578363932 | 0 |
| 23078 | 10349 | 0.58105307 | 0 | 23106 | 10377 | 0.578363932 | 0 | 23134 | 10405 | 0.578363932 | 0 | 23162 | 10433 | 0.578363932 | 0 |
| 23079 | 10350 | 0.58105307 | 0 | 23107 | 10378 | 0.578363932 | 0 | 23135 | 10406 | 0.578363932 | 0 | 23163 | 10434 | 0.578363932 | 0 |
| 23080 | 10351 | 0.58105307 | 0 | 23108 | 10379 | 0.578363932 | 0 | 23136 | 10407 | 0.578363932 | 0 | 23164 | 10435 | 0.578363932 | 0 |
| 23081 | 10352 | 0.580911121 | 0 | 23109 | 10380 | 0.578363932 | 0 | 23137 | 10408 | 0.578363932 | 0 | 23165 | 10436 | 0.578363932 | 0 |
| 23082 | 10353 | 0.580911121 | 0 | 23110 | 10381 | 0.578363932 | 0 | 23138 | 10409 | 0.578363932 | 0 | 23166 | 10437 | 0.578363932 | 0 |
| 23083 | 10354 | 0.580783406 | 0 | 23111 | 10382 | 0.578363932 | 0 | 23139 | 10410 | 0.578363932 | 0 | 23167 | 10438 | 0.578363932 | 0 |
| 23084 | 10355 | 0.580783406 | 0 | 23112 | 10383 | 0.578363932 | 0 | 23140 | 10411 | 0.578363932 | 0 | 23168 | 10439 | 0.578363932 | 0 |
| 23085 | 10356 | 0.580783406 | 0 | 23113 | 10384 | 0.578363932 | 0 | 23141 | 10412 | 0.578363932 | 0 | 23169 | 10440 | 0.578363932 | 0 |
| 23086 | 10357 | 0.580783406 | 0 | 23114 | 10385 | 0.578363932 | 0 | 23142 | 10413 | 0.578363932 | 0 | 23170 | 10441 | 0.578363932 | 0 |
| 23087 | 10358 | 0.580783406 | 0 | 23115 | 10386 | 0.578363932 | 0 | 23143 | 10414 | 0.578363932 | 0 | 23171 | 10442 | 0.578363932 | 0 |
| 23088 | 10359 | 0.580783406 | 0 | 23116 | 10387 | 0.578363932 | 0 | 23144 | 10415 | 0.578363932 | 0 | 23172 | 10443 | 0.578363932 | 0 |
| 23089 | 10360 | 0.580667887 | 0 | 23117 | 10388 | 0.578363932 | 0 | 23145 | 10416 | 0.578363932 | 0 | 23173 | 10444 | 0.578363932 | 0 |
| 23090 | 10361 | 0.580562896 | -1.42030719 | 23118 | 10389 | 0.578363932 | 0 | 23146 | 10417 | 0.578363932 | 0 | 23174 | 10445 | 0.578363932 | 0 |
| 23091 | 10362 | 0.580467057 | 0 | 23119 | 10390 | 0.578363932 | 0 | 23147 | 10418 | 0.578363932 | 0 | 23175 | 10446 | 0.578363932 | 0 |
| 23092 | 10363 | 0.580467057 | 0 | 23120 | 10391 | 0.578363932 | 0 | 23148 | 10419 | 0.578363932 | 0 | 23176 | 10447 | 0.578363932 | 0 |
| 23093 | 10364 | 0.580298431 | 0 | 23121 | 10392 | 0.578363932 | 0 | 23149 | 10420 | 0.578363932 | 0 | 23177 | 10448 | 0.578363932 | 0 |
| 23094 | 10365 | 0.580298431 | 0 | 23122 | 10393 | 0.578363932 | 0 | 23150 | 10421 | 0.578363932 | 0 | 23178 | 10449 | 0.578363932 | -0.314166679 |
| 23095 | 10366 | 0.580298431 | 0 | 23123 | 10394 | 0.578363932 | 0 | 23151 | 10422 | 0.578363932 | 0 | 23179 | 10450 | 0.578363932 | -0.343324908 |
| 23096 | 10367 | 0.580298431 | 0 | 23124 | 10395 | 0.578363932 | 0 | 23152 | 10423 | 0.578363932 | 0 | 23180 | 10451 | 0.578363932 | -0.858234723 |
| 23097 | 10368 | 0.580223868 | 0 | 23125 | 10396 | 0.578363932 | 0 | 23153 | 10424 | 0.578363932 | 0 | 23181 | 10452 | 0.578363932 | -0.955144736 |
| 23098 | 10369 | 0.580154839 | 0 | 23126 | 10397 | 0.578363932 | 0 | 23154 | 10425 | 0.578363932 | 0 | 23182 | 10453 | 0.578363932 | -1.034325983 |
| 23099 | 10370 | 0.580090751 | 0 | 23127 | 10398 | 0.578363932 | 0 | 23155 | 10426 | 0.578363932 | 0 | 23183 | 10454 | 0.578363932 | -1.478023482 |
| 23100 | 10371 | 0.580031091 | 0 | 23128 | 10399 | 0.578363932 | 0 | 23156 | 10427 | 0.578363932 | 0 | 23184 | 10455 | 0.578363932 | -0.495056821 |
| 23101 | 10372 | 0.579975416 | 0 | 23129 | 10400 | 0.578363932 | 0 | 23157 | 10428 | 0.578363932 | 0 | 23185 | 10456 | 0.578363932 | -1.460294715 |
| 23102 | 10373 | 0.579975416 | 0 | 23130 | 10401 | 0.578363932 | 0 | 23158 | 10429 | 0.578363932 | 0 | 23186 | 10457 | 0.576703148 | 0 |
| 23103 | 10374 | 0.579923339 | 0 | 23131 | 10402 | 0.578363932 | 0 | 23159 | 10430 | 0.578363932 | 0 | 23187 | 10458 | 0.576580379 | 0 |
| 23104 | 10375 | 0.579923339 | -1.268855764 | 23132 | 10403 | 0.578363932 | 0 | 23160 | 10431 | 0.578363932 | 0 | 23188 | 10459 | 0.576511927 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23189 | 10460 | 0.576438011 | 0 | 23217 | 10488 | 0.575534642 | 0 | 23245 | 10516 | 0.574361189 | 0 | 23273 | 10544 | 0.573792369 | 0 |
| 23190 | 10461 | 0.576438011 | 0 | 23218 | 10489 | 0.575449193 | 0 | 23246 | 10517 | 0.574361189 | 0 | 23274 | 10545 | 0.573792369 | 0 |
| 23191 | 10462 | 0.576438011 | 0 | 23219 | 10490 | 0.575358422 | 0 | 23247 | 10518 | 0.574361189 | 0 | 23275 | 10546 | 0.573792369 | 0 |
| 23192 | 10463 | 0.576270942 | 0 | 23220 | 10491 | 0.575358422 | 0 | 23248 | 10519 | 0.574361189 | 0 | 23276 | 10547 | 0.573565049 | 0 |
| 23193 | 10464 | 0.576270942 | 0 | 23221 | 10492 | 0.575358422 | 0 | 23249 | 10520 | 0.574361189 | 0 | 23277 | 10548 | 0.573565049 | 0 |
| 23194 | 10465 | 0.576176046 | 0 | 23222 | 10493 | 0.575358422 | -0.083088983 | 23250 | 10521 | 0.574361189 | 0 | 23278 | 10549 | 0.573565049 | 0 |
| 23195 | 10466 | 0.576176046 | 0 | 23223 | 10494 | 0.575158792 | 0 | 23251 | 10522 | 0.574361189 | 0 | 23279 | 10550 | 0.573565049 | 0 |
| 23196 | 10467 | 0.576176046 | 0 | 23224 | 10495 | 0.575158792 | 0 | 23252 | 10523 | 0.574361189 | 0 | 23280 | 10551 | 0.573565049 | 0 |
| 23197 | 10468 | 0.576176046 | 0 | 23225 | 10496 | 0.575158792 | 0 | 23253 | 10524 | 0.574361189 | 0 | 23281 | 10552 | 0.573565049 | 0 |
| 23198 | 10469 | 0.576176046 | 0 | 23226 | 10497 | 0.575158792 | 0 | 23254 | 10525 | 0.574361189 | 0 | 23282 | 10553 | 0.573565049 | 0 |
| 23199 | 10470 | 0.576072135 | 0 | 23227 | 10498 | 0.575158792 | 0 | 23255 | 10526 | 0.574361189 | 0 | 23283 | 10554 | 0.573565049 | 0 |
| 23200 | 10471 | 0.576072135 | 0 | 23228 | 10499 | 0.575048691 | 0 | 23256 | 10527 | 0.574361189 | 0 | 23284 | 10555 | 0.573565049 | 0 |
| 23201 | 10472 | 0.576072135 | -1.103564569 | 23229 | 10500 | 0.574930756 | 0 | 23257 | 10528 | 0.574361189 | 0 | 23285 | 10556 | 0.573565049 | 0 |
| 23202 | 10473 | 0.575957862 | 0 | 23230 | 10501 | 0.574930756 | 0 | 23258 | 10529 | 0.574361189 | 0 | 23286 | 10557 | 0.573565049 | 0 |
| 23203 | 10474 | 0.575957862 | 0 | 23231 | 10502 | 0.574930756 | 0 | 23259 | 10530 | 0.574361189 | 0 | 23287 | 10558 | 0.573565049 | 0 |
| 23204 | 10475 | 0.575957862 | 0 | 23232 | 10503 | 0.574930756 | 0 | 23260 | 10531 | 0.574247365 | 0 | 23288 | 10559 | 0.573565049 | -1.084882356 |
| 23205 | 10476 | 0.575957862 | 0 | 23233 | 10504 | 0.574930756 | 0 | 23261 | 10532 | 0.574187991 | 0 | 23289 | 10560 | 0.573400512 | 0 |
| 23206 | 10477 | 0.575957862 | -1.383519539 | 23234 | 10505 | 0.574930756 | 0 | 23262 | 10533 | 0.574187991 | 0 | 23290 | 10561 | 0.573400512 | 0 |
| 23207 | 10478 | 0.575831595 | 0 | 23235 | 10506 | 0.574930756 | 0 | 23263 | 10534 | 0.573999126 | 0 | 23291 | 10562 | 0.573313939 | 0 |
| 23208 | 10479 | 0.575831595 | 0 | 23236 | 10507 | 0.574804121 | 0 | 23264 | 10535 | 0.573999126 | 0 | 23292 | 10563 | 0.573313939 | -1.363887067 |
| 23209 | 10480 | 0.575831595 | -1.361369411 | 23237 | 10508 | 0.574804121 | 0 | 23265 | 10536 | 0.573999126 | 0 | 23293 | 10564 | 0.573224292 | 0 |
| 23210 | 10481 | 0.575691342 | 0 | 23238 | 10509 | 0.574667786 | 0 | 23266 | 10537 | 0.573999126 | 0 | 23294 | 10565 | 0.573035098 | 0 |
| 23211 | 10482 | 0.575691342 | 0 | 23239 | 10510 | 0.574667786 | 0 | 23267 | 10538 | 0.573999126 | 0 | 23295 | 10566 | 0.573035098 | 0 |
| 23212 | 10483 | 0.575691342 | 0 | 23240 | 10511 | 0.574667786 | 0 | 23268 | 10539 | 0.573999126 | 0 | 23296 | 10567 | 0.573035098 | 0 |
| 23213 | 10484 | 0.575691342 | 0 | 23241 | 10512 | 0.574667786 | 0 | 23269 | 10540 | 0.573999126 | 0 | 23297 | 10568 | 0.573035098 | 0 |
| 23214 | 10485 | 0.575691342 | 0 | 23242 | 10513 | 0.574667786 | 0 | 23270 | 10541 | 0.573999126 | 0 | 23298 | 10569 | 0.573035098 | 0 |
| 23215 | 10486 | 0.575534642 | 0 | 23243 | 10514 | 0.574520593 | 0 | 23271 | 10542 | 0.573999126 | 0 | 23299 | 10570 | 0.573035098 | 0 |
| 23216 | 10487 | 0.575534642 | 0 | 23244 | 10515 | 0.574520593 | -0.335738785 | 23272 | 10543 | 0.573792369 | 0 | 23300 | 10571 | 0.573035098 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23301 | 10572 | 0.573035098 | -0.671678031 | 23329 | 10600 | 0.571833065 | 0 | 23357 | 10628 | 0.571002832 | 0 | 23385 | 10656 | 0.569930764 | 0 |
| 23302 | 10573 | 0.573035098 | -0.340684812 | 23330 | 10601 | 0.571833065 | -1.429037021 | 23358 | 10629 | 0.571002832 | 0 | 23386 | 10657 | 0.569930764 | 0 |
| 23303 | 10574 | 0.572723664 | 0 | 23331 | 10602 | 0.571524507 | 0 | 23359 | 10630 | 0.570810794 | 0 | 23387 | 10658 | 0.569930764 | 0 |
| 23304 | 10575 | 0.572723664 | -0.236991416 | 23332 | 10603 | 0.571524507 | 0 | 23360 | 10631 | 0.570810794 | 0 | 23388 | 10659 | 0.569930764 | 0 |
| 23305 | 10576 | 0.572611603 | 0 | 23333 | 10604 | 0.571524507 | 0 | 23361 | 10632 | 0.570810794 | 0 | 23389 | 10660 | 0.569930764 | 0 |
| 23306 | 10577 | 0.572611603 | 0 | 23334 | 10605 | 0.571524507 | 0 | 23362 | 10633 | 0.570810794 | 0 | 23390 | 10661 | 0.569930764 | 0 |
| 23307 | 10578 | 0.572611603 | 0 | 23335 | 10606 | 0.571524507 | 0 | 23363 | 10634 | 0.570710967 | 0 | 23391 | 10662 | 0.569930764 | 0 |
| 23308 | 10579 | 0.572373568 | 0 | 23336 | 10607 | 0.571524507 | 0 | 23364 | 10635 | 0.570710967 | 0 | 23392 | 10663 | 0.569831349 | 0 |
| 23309 | 10580 | 0.572373568 | 0 | 23337 | 10608 | 0.571524507 | 0 | 23365 | 10636 | 0.570395002 | 0 | 23393 | 10664 | 0.569677752 | 0 |
| 23310 | 10581 | 0.572373568 | 0 | 23338 | 10609 | 0.571524507 | 0 | 23366 | 10637 | 0.570395002 | 0 | 23394 | 10665 | 0.569677752 | 0 |
| 23311 | 10582 | 0.572373568 | 0 | 23339 | 10610 | 0.571524507 | 0 | 23367 | 10638 | 0.570395002 | 0 | 23395 | 10666 | 0.569677752 | 0 |
| 23312 | 10583 | 0.572373568 | 0 | 23340 | 10611 | 0.571524507 | 0 | 23368 | 10639 | 0.570395002 | 0 | 23396 | 10667 | 0.569677752 | 0 |
| 23313 | 10584 | 0.572373568 | 0 | 23341 | 10612 | 0.571524507 | 0 | 23369 | 10640 | 0.570395002 | 0 | 23397 | 10668 | 0.569677752 | 0 |
| 23314 | 10585 | 0.572373568 | 0 | 23342 | 10613 | 0.571524507 | 0 | 23370 | 10641 | 0.570395002 | 0 | 23398 | 10669 | 0.569677752 | 0 |
| 23315 | 10586 | 0.572373568 | 0 | 23343 | 10614 | 0.571524507 | 0 | 23371 | 10642 | 0.570395002 | 0 | 23399 | 10670 | 0.569677752 | 0 |
| 23316 | 10587 | 0.572373568 | 0 | 23344 | 10615 | 0.571524507 | 0 | 23372 | 10643 | 0.570395002 | 0 | 23400 | 10671 | 0.569677752 | 0 |
| 23317 | 10588 | 0.572373568 | 0 | 23345 | 10616 | 0.571273252 | 0 | 23373 | 10644 | 0.570395002 | 0 | 23401 | 10672 | 0.569677752 | 0 |
| 23318 | 10589 | 0.572114982 | 0 | 23346 | 10617 | 0.571273252 | 0 | 23374 | 10645 | 0.570395002 | 0 | 23402 | 10673 | 0.569677752 | 0 |
| 23319 | 10590 | 0.571977133 | 0 | 23347 | 10618 | 0.571185347 | 0 | 23375 | 10646 | 0.570395002 | 0 | 23403 | 10674 | 0.569677752 | 0 |
| 23320 | 10591 | 0.571977133 | 0 | 23348 | 10619 | 0.571185347 | 0 | 23376 | 10647 | 0.570395002 | 0 | 23404 | 10675 | 0.569677752 | -1.130162337 |
| 23321 | 10592 | 0.571977133 | 0 | 23349 | 10620 | 0.571185347 | 0 | 23377 | 10648 | 0.570395002 | 0 | 23405 | 10676 | 0.569518524 | 0 |
| 23322 | 10593 | 0.571977133 | 0 | 23350 | 10621 | 0.571185347 | 0 | 23378 | 10649 | 0.570395002 | 0 | 23406 | 10677 | 0.569409089 | 0 |
| 23323 | 10594 | 0.571977133 | 0 | 23351 | 10622 | 0.571185347 | 0 | 23379 | 10650 | 0.570395002 | 0 | 23407 | 10678 | 0.569409089 | 0 |
| 23324 | 10595 | 0.571977133 | 0 | 23352 | 10623 | 0.571185347 | 0 | 23380 | 10651 | 0.570395002 | 0 | 23408 | 10679 | 0.569409089 | 0 |
| 23325 | 10596 | 0.571977133 | 0 | 23353 | 10624 | 0.571113438 | 0 | 23381 | 10652 | 0.570395002 | -0.042294912 | 23409 | 10680 | 0.569409089 | 0 |
| 23326 | 10597 | 0.571977133 | 0 | 23354 | 10625 | 0.571002832 | 0 | 23382 | 10653 | 0.570051822 | 0 | 23410 | 10681 | 0.569409089 | 0 |
| 23327 | 10598 | 0.571891465 | 0 | 23355 | 10626 | 0.571002832 | 0 | 23383 | 10654 | 0.570051822 | 0 | 23411 | 10682 | 0.569409089 | 0 |
| 23328 | 10599 | 0.571833065 | 0 | 23356 | 10627 | 0.571002832 | 0 | 23384 | 10655 | 0.570051822 | -1.450123419 | 23412 | 10683 | 0.569409089 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23413 | 10684 | 0.569409089 | 0 | 23441 | 10712 | 0.568321993 | 0 | 23469 | 10740 | 0.567368547 | 0 | 23497 | 10768 | 0.566464708 | 0 |
| 23414 | 10685 | 0.569409089 | -0.251765613 | 23442 | 10713 | 0.568321993 | 0 | 23470 | 10741 | 0.567368547 | 0 | 23498 | 10769 | 0.566464708 | 0 |
| 23415 | 10686 | 0.569409089 | -0.816037044 | 23443 | 10714 | 0.568321993 | 0 | 23471 | 10742 | 0.567368547 | 0 | 23499 | 10770 | 0.566464708 | 0 |
| 23416 | 10687 | 0.569268427 | 0 | 23444 | 10715 | 0.568246797 | 0 | 23472 | 10743 | 0.567368547 | -1.20502221 | 23500 | 10771 | 0.566464708 | 0 |
| 23417 | 10688 | 0.569268427 | 0 | 23445 | 10716 | 0.568246797 | 0 | 23473 | 10744 | 0.56715571 | 0 | 23501 | 10772 | 0.566464708 | 0 |
| 23418 | 10689 | 0.569268427 | 0 | 23446 | 10717 | 0.568144767 | 0 | 23474 | 10745 | 0.56715571 | 0 | 23502 | 10773 | 0.566464708 | -0.393012692 |
| 23419 | 10690 | 0.569268427 | -1.110368277 | 23447 | 10718 | 0.568144767 | 0 | 23475 | 10746 | 0.56715571 | 0 | 23503 | 10774 | 0.565954674 | 0 |
| 23420 | 10691 | 0.569181888 | 0 | 23448 | 10719 | 0.568144767 | 0 | 23476 | 10747 | 0.56715571 | 0 | 23504 | 10775 | 0.565847374 | 0 |
| 23421 | 10692 | 0.568818614 | 0 | 23449 | 10720 | 0.568144767 | 0 | 23477 | 10748 | 0.56715571 | -1.02071062 | 23505 | 10776 | 0.565847374 | 0 |
| 23422 | 10693 | 0.568818614 | 0 | 23450 | 10721 | 0.568144767 | 0 | 23478 | 10749 | 0.567024006 | 0 | 23506 | 10777 | 0.565847374 | 0 |
| 23423 | 10694 | 0.568818614 | 0 | 23451 | 10722 | 0.568144767 | 0 | 23479 | 10750 | 0.56693447 | 0 | 23507 | 10778 | 0.565847374 | 0 |
| 23424 | 10695 | 0.568818614 | 0 | 23452 | 10723 | 0.568144767 | -0.810461942 | 23480 | 10751 | 0.56693447 | 0 | 23508 | 10779 | 0.565847374 | 0 |
| 23425 | 10696 | 0.568818614 | 0 | 23453 | 10724 | 0.567998416 | 0 | 23481 | 10752 | 0.56693447 | 0 | 23509 | 10780 | 0.565847374 | 0 |
| 23426 | 10697 | 0.568818614 | 0 | 23454 | 10725 | 0.567998416 | 0 | 23482 | 10753 | 0.566464708 | 0 | 23510 | 10781 | 0.565847374 | 0 |
| 23427 | 10698 | 0.568818614 | 0 | 23455 | 10726 | 0.567770858 | 0 | 23483 | 10754 | 0.566464708 | 0 | 23511 | 10782 | 0.565847374 | -1.371353631 |
| 23428 | 10699 | 0.568818614 | 0 | 23456 | 10727 | 0.567770858 | 0 | 23484 | 10755 | 0.566464708 | 0 | 23512 | 10783 | 0.5656829 | 0 |
| 23429 | 10700 | 0.568818614 | 0 | 23457 | 10728 | 0.567770858 | 0 | 23485 | 10756 | 0.566464708 | 0 | 23513 | 10784 | 0.5656829 | 0 |
| 23430 | 10701 | 0.568818614 | 0 | 23458 | 10729 | 0.567770858 | 0 | 23486 | 10757 | 0.566464708 | 0 | 23514 | 10785 | 0.5656829 | 0 |
| 23431 | 10702 | 0.568818614 | 0 | 23459 | 10730 | 0.567770858 | 0 | 23487 | 10758 | 0.566464708 | 0 | 23515 | 10786 | 0.5656829 | 0 |
| 23432 | 10703 | 0.568818614 | 0 | 23460 | 10731 | 0.567770858 | 0 | 23488 | 10759 | 0.566464708 | 0 | 23516 | 10787 | 0.5656829 | 0 |
| 23433 | 10704 | 0.568818614 | 0 | 23461 | 10732 | 0.567770858 | 0 | 23489 | 10760 | 0.566464708 | 0 | 23517 | 10788 | 0.565562747 | 0 |
| 23434 | 10705 | 0.568818614 | 0 | 23462 | 10733 | 0.567770858 | 0 | 23490 | 10761 | 0.566464708 | 0 | 23518 | 10789 | 0.565562747 | 0 |
| 23435 | 10706 | 0.568818614 | 0 | 23463 | 10734 | 0.567770858 | 0 | 23491 | 10762 | 0.566464708 | 0 | 23519 | 10790 | 0.565514045 | 0 |
| 23436 | 10707 | 0.568818614 | 0 | 23464 | 10735 | 0.567770858 | 0 | 23492 | 10763 | 0.566464708 | 0 | 23520 | 10791 | 0.565398955 | 0 |
| 23437 | 10708 | 0.568493178 | 0 | 23465 | 10736 | 0.567770858 | 0 | 23493 | 10764 | 0.566464708 | 0 | 23521 | 10792 | 0.565398955 | 0 |
| 23438 | 10709 | 0.568425409 | 0 | 23466 | 10737 | 0.567770858 | 0 | 23494 | 10765 | 0.566464708 | 0 | 23522 | 10793 | 0.565398955 | 0 |
| 23439 | 10710 | 0.568425409 | 0 | 23467 | 10738 | 0.567770858 | -1.522040311 | 23495 | 10766 | 0.566464708 | 0 | 23523 | 10794 | 0.565398955 | 0 |
| 23440 | 10711 | 0.568321993 | 0 | 23468 | 10739 | 0.567533084 | 0 | 23496 | 10767 | 0.566464708 | 0 | 23524 | 10795 | 0.565398955 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23525 | 10796 | 0.564791124 | 0 | 23553 | 10824 | 0.563920504 | 0 | 23581 | 10852 | 0.562569664 | 0 | 23609 | 10880 | 0.561895817 | 0 |
| 23526 | 10797 | 0.564791124 | 0 | 23554 | 10825 | 0.563764423 | 0 | 23582 | 10853 | 0.562569664 | 0 | 23610 | 10881 | 0.561895817 | 0 |
| 23527 | 10798 | 0.564791124 | 0 | 23555 | 10826 | 0.563764423 | 0 | 23583 | 10854 | 0.562569664 | 0 | 23611 | 10882 | 0.561895817 | 0 |
| 23528 | 10799 | 0.564791124 | 0 | 23556 | 10827 | 0.563764423 | 0 | 23584 | 10855 | 0.562569664 | 0 | 23612 | 10883 | 0.561895817 | 0 |
| 23529 | 10800 | 0.564791124 | 0 | 23557 | 10828 | 0.563764423 | 0 | 23585 | 10856 | 0.562569664 | 0 | 23613 | 10884 | 0.56179483 | 0 |
| 23530 | 10801 | 0.564791124 | 0 | 23558 | 10829 | 0.563764423 | 0 | 23586 | 10857 | 0.562569664 | 0 | 23614 | 10885 | 0.56179483 | 0 |
| 23531 | 10802 | 0.564791124 | 0 | 23559 | 10830 | 0.563764423 | 0 | 23587 | 10858 | 0.562569664 | 0 | 23615 | 10886 | 0.56179483 | 0 |
| 23532 | 10803 | 0.564791124 | 0 | 23560 | 10831 | 0.563764423 | -0.731505079 | 23588 | 10859 | 0.562569664 | 0 | 23616 | 10887 | 0.56179483 | 0 |
| 23533 | 10804 | 0.564791124 | 0 | 23561 | 10832 | 0.563540155 | 0 | 23589 | 10860 | 0.562569664 | 0 | 23617 | 10888 | 0.56179483 | 0 |
| 23534 | 10805 | 0.564791124 | -1.415875575 | 23562 | 10833 | 0.563540155 | 0 | 23590 | 10861 | 0.562569664 | 0 | 23618 | 10889 | 0.561658238 | 0 |
| 23535 | 10806 | 0.56451282 | 0 | 23563 | 10834 | 0.563540155 | 0 | 23591 | 10862 | 0.562569664 | 0 | 23619 | 10890 | 0.561658238 | 0 |
| 23536 | 10807 | 0.564398276 | 0 | 23564 | 10835 | 0.563540155 | 0 | 23592 | 10863 | 0.562569664 | 0 | 23620 | 10891 | 0.561658238 | 0 |
| 23537 | 10808 | 0.564398276 | 0 | 23565 | 10836 | 0.563540155 | 0 | 23593 | 10864 | 0.562569664 | 0 | 23621 | 10892 | 0.561658238 | 0 |
| 23538 | 10809 | 0.564398276 | 0 | 23566 | 10837 | 0.563540155 | 0 | 23594 | 10865 | 0.562569664 | 0 | 23622 | 10893 | 0.561658238 | 0 |
| 23539 | 10810 | 0.564398276 | -1.324498051 | 23567 | 10838 | 0.563540155 | 0 | 23595 | 10866 | 0.562569664 | 0 | 23623 | 10894 | 0.561463181 | 0 |
| 23540 | 10811 | 0.564123493 | 0 | 23568 | 10839 | 0.563540155 | 0 | 23596 | 10867 | 0.562569664 | 0 | 23624 | 10895 | 0.561463181 | 0 |
| 23541 | 10812 | 0.564123493 | 0 | 23569 | 10840 | 0.563386776 | 0 | 23597 | 10868 | 0.562569664 | 0 | 23625 | 10896 | 0.561463181 | 0 |
| 23542 | 10813 | 0.564123493 | 0 | 23570 | 10841 | 0.563386776 | 0 | 23598 | 10869 | 0.562569664 | 0 | 23626 | 10897 | 0.561463181 | 0 |
| 23543 | 10814 | 0.564123493 | 0 | 23571 | 10842 | 0.563386776 | 0 | 23599 | 10870 | 0.562569664 | 0 | 23627 | 10898 | 0.561463181 | 0 |
| 23544 | 10815 | 0.564123493 | 0 | 23572 | 10843 | 0.563386776 | 0 | 23600 | 10871 | 0.562569664 | 0 | 23628 | 10899 | 0.561463181 | 0 |
| 23545 | 10816 | 0.564123493 | 0 | 23573 | 10844 | 0.563386776 | 0 | 23601 | 10872 | 0.562569664 | 0 | 23629 | 10900 | 0.561463181 | 0 |
| 23546 | 10817 | 0.564123493 | 0 | 23574 | 10845 | 0.563386776 | 0 | 23602 | 10873 | 0.562569664 | 0 | 23630 | 10901 | 0.561463181 | 0 |
| 23547 | 10818 | 0.564123493 | 0 | 23575 | 10846 | 0.563386776 | 0 | 23603 | 10874 | 0.562569664 | 0 | 23631 | 10902 | 0.561463181 | 0 |
| 23548 | 10819 | 0.564123493 | 0 | 23576 | 10847 | 0.563386776 | 0 | 23604 | 10875 | 0.562569664 | 0 | 23632 | 10903 | 0.561463181 | 0 |
| 23549 | 10820 | 0.563982006 | -1.612979339 | 23577 | 10848 | 0.563386776 | 0 | 23605 | 10876 | 0.562569664 | 0 | 23633 | 10904 | 0.561463181 | 0 |
| 23550 | 10821 | 0.563920504 | 0 | 23578 | 10849 | 0.563190529 | 0 | 23606 | 10877 | 0.562569664 | -0.426870959 | 23634 | 10905 | 0.561463181 | -0.243112259 |
| 23551 | 10822 | 0.563920504 | 0 | 23579 | 10850 | 0.563123965 | 0 | 23607 | 10878 | 0.562569664 | -0.874028991 | 23635 | 10906 | 0.561330592 | 0 |
| 23552 | 10823 | 0.563920504 | 0 | 23580 | 10851 | 0.562569664 | 0 | 23608 | 10879 | 0.562569664 | -1.175058986 | 23636 | 10907 | 0.561330592 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23637 | 10908 | 0.561330592 | 0 | 23665 | 10936 | 0.560635165 | -1.301932223 | 23693 | 10964 | 0.559478588 | 0 | 23721 | 10992 | 0.55893538 | 0 |
| 23638 | 10909 | 0.561161902 | 0 | 23666 | 10937 | 0.56035951 | 0 | 23694 | 10965 | 0.559478588 | 0 | 23722 | 10993 | 0.55893538 | 0 |
| 23639 | 10910 | 0.561161902 | 0 | 23667 | 10938 | 0.56035951 | 0 | 23695 | 10966 | 0.559478588 | 0 | 23723 | 10994 | 0.558841792 | -1.562003611 |
| 23640 | 10911 | 0.561161902 | 0 | 23668 | 10939 | 0.56035951 | 0 | 23696 | 10967 | 0.559478588 | 0 | 23724 | 10995 | 0.558709244 | 0 |
| 23641 | 10912 | 0.561161902 | 0 | 23669 | 10940 | 0.56035951 | 0 | 23697 | 10968 | 0.559478588 | 0 | 23725 | 10996 | 0.558709244 | 0 |
| 23642 | 10913 | 0.561161902 | 0 | 23670 | 10941 | 0.56035951 | 0 | 23698 | 10969 | 0.559478588 | 0 | 23726 | 10997 | 0.558709244 | 0 |
| 23643 | 10914 | 0.561161902 | 0 | 23671 | 10942 | 0.56035951 | 0 | 23699 | 10970 | 0.559478588 | 0 | 23727 | 10998 | 0.558709244 | 0 |
| 23644 | 10915 | 0.561161902 | -1.439708184 | 23672 | 10943 | 0.560189963 | 0 | 23700 | 10971 | 0.559478588 | 0 | 23728 | 10999 | 0.558709244 | 0 |
| 23645 | 10916 | 0.56094004 | 0 | 23673 | 10944 | 0.560189963 | 0 | 23701 | 10972 | 0.559478588 | 0 | 23729 | 11000 | 0.558709244 | 0 |
| 23646 | 10917 | 0.56094004 | 0 | 23674 | 10945 | 0.560189963 | 0 | 23702 | 10973 | 0.559478588 | 0 | 23730 | 11001 | 0.558709244 | 0 |
| 23647 | 10918 | 0.56094004 | 0 | 23675 | 10946 | 0.560189963 | 0 | 23703 | 10974 | 0.559478588 | 0 | 23731 | 11002 | 0.558709244 | 0 |
| 23648 | 10919 | 0.56094004 | 0 | 23676 | 10947 | 0.560189963 | 0 | 23704 | 10975 | 0.559478588 | 0 | 23732 | 11003 | 0.558709244 | -1.479949403 |
| 23649 | 10920 | 0.56094004 | 0 | 23677 | 10948 | 0.560189963 | 0 | 23705 | 10976 | 0.559478588 | 0 | 23733 | 11004 | 0.558507011 | 0 |
| 23650 | 10921 | 0.56094004 | -1.376260966 | 23678 | 10949 | 0.560189963 | 0 | 23706 | 10977 | 0.559478588 | 0 | 23734 | 11005 | 0.558507011 | 0 |
| 23651 | 10922 | 0.56094004 | -1.376260966 | 23679 | 10950 | 0.560189963 | 0 | 23707 | 10978 | 0.559478588 | 0 | 23735 | 11006 | 0.558507011 | 0 |
| 23652 | 10923 | 0.56094004 | -1.376260966 | 23680 | 10951 | 0.560189963 | 0 | 23708 | 10979 | 0.559478588 | 0 | 23736 | 11007 | 0.558507011 | 0 |
| 23653 | 10924 | 0.560849684 | 0 | 23681 | 10952 | 0.560189963 | 0 | 23709 | 10980 | 0.559478588 | -1.399998813 | 23737 | 11008 | 0.558507011 | 0 |
| 23654 | 10925 | 0.560800642 | 0 | 23682 | 10953 | 0.560189963 | -1.212200794 | 23710 | 10981 | 0.559136489 | 0 | 23738 | 11009 | 0.558507011 | -1.077663999 |
| 23655 | 10926 | 0.560635165 | 0 | 23683 | 10954 | 0.559992242 | 0 | 23711 | 10982 | 0.559058776 | 0 | 23739 | 11010 | 0.558507011 | -0.600542744 |
| 23656 | 10927 | 0.560635165 | 0 | 23684 | 10955 | 0.559992242 | 0 | 23712 | 10983 | 0.559058776 | 0 | 23740 | 11011 | 0.558413705 | 0 |
| 23657 | 10928 | 0.560635165 | 0 | 23685 | 10956 | 0.559880526 | 0 | 23713 | 10984 | 0.559058776 | 0 | 23741 | 11012 | 0.558160546 | 0 |
| 23658 | 10929 | 0.560635165 | 0 | 23686 | 10957 | 0.559880526 | 0 | 23714 | 10985 | 0.559058776 | 0 | 23742 | 11013 | 0.558160546 | 0 |
| 23659 | 10930 | 0.560635165 | 0 | 23687 | 10958 | 0.559880526 | 0 | 23715 | 10986 | 0.559058776 | 0 | 23743 | 11014 | 0.558160546 | 0 |
| 23660 | 10931 | 0.560635165 | 0 | 23688 | 10959 | 0.559880526 | 0 | 23716 | 10987 | 0.559058776 | 0 | 23744 | 11015 | 0.558160546 | 0 |
| 23661 | 10932 | 0.560635165 | 0 | 23689 | 10960 | 0.559880526 | 0 | 23717 | 10988 | 0.559058776 | 0 | 23745 | 11016 | 0.558160546 | 0 |
| 23662 | 10933 | 0.560635165 | 0 | 23690 | 10961 | 0.559880526 | 0 | 23718 | 10989 | 0.55893538 | 0 | 23746 | 11017 | 0.558160546 | 0 |
| 23663 | 10934 | 0.560635165 | 0 | 23691 | 10962 | 0.559880526 | -1.159264719 | 23719 | 10990 | 0.55893538 | 0 | 23747 | 11018 | 0.558160546 | 0 |
| 23664 | 10935 | 0.560635165 | -0.824810968 | 23692 | 10963 | 0.559758687 | -1.617202658 | 23720 | 10991 | 0.55893538 | 0 | 23748 | 11019 | 0.558160546 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23749 | 11020 | 0.558160546 | 0 | 23777 | 11048 | 0.556965787 | 0 | 23805 | 11076 | 0.556087537 | 0 | 23833 | 11104 | 0.554882836 | 0 |
| 23750 | 11021 | 0.558160546 | -0.468263644 | 23778 | 11049 | 0.556965787 | 0 | 23806 | 11077 | 0.556087537 | -0.779053477 | 23834 | 11105 | 0.554882836 | 0 |
| 23751 | 11022 | 0.558160546 | -1.070323636 | 23779 | 11050 | 0.556965787 | 0 | 23807 | 11078 | 0.555972659 | 0 | 23835 | 11106 | 0.554882836 | 0 |
| 23752 | 11023 | 0.557874543 | 0 | 23780 | 11051 | 0.556965787 | 0 | 23808 | 11079 | 0.555972659 | 0 | 23836 | 11107 | 0.554882836 | 0 |
| 23753 | 11024 | 0.557874543 | 0 | 23781 | 11052 | 0.556965787 | -1.443904299 | 23809 | 11080 | 0.555972659 | 0 | 23837 | 11108 | 0.554882836 | 0 |
| 23754 | 11025 | 0.557749476 | 0 | 23782 | 11053 | 0.556791826 | 0 | 23810 | 11081 | 0.555972659 | 0 | 23838 | 11109 | 0.554882836 | 0 |
| 23755 | 11026 | 0.557749476 | 0 | 23783 | 11054 | 0.556791826 | 0 | 23811 | 11082 | 0.555972659 | 0 | 23839 | 11110 | 0.554882836 | 0 |
| 23756 | 11027 | 0.557749476 | 0 | 23784 | 11055 | 0.556644682 | 0 | 23812 | 11083 | 0.555877784 | 0 | 23840 | 11111 | 0.554882836 | 0 |
| 23757 | 11028 | 0.557749476 | 0 | 23785 | 11056 | 0.556644682 | 0 | 23813 | 11084 | 0.55573024 | 0 | 23841 | 11112 | 0.554882836 | 0 |
| 23758 | 11029 | 0.557749476 | -0.526666661 | 23786 | 11057 | 0.556644682 | 0 | 23814 | 11085 | 0.554882836 | 0 | 23842 | 11113 | 0.554882836 | 0 |
| 23759 | 11030 | 0.557634447 | 0 | 23787 | 11058 | 0.556644682 | 0 | 23815 | 11086 | 0.554882836 | 0 | 23843 | 11114 | 0.554882836 | 0 |
| 23760 | 11031 | 0.557430025 | 0 | 23788 | 11059 | 0.556644682 | 0 | 23816 | 11087 | 0.554882836 | 0 | 23844 | 11115 | 0.554882836 | 0 |
| 23761 | 11032 | 0.557430025 | 0 | 23789 | 11060 | 0.556644682 | 0 | 23817 | 11088 | 0.554882836 | 0 | 23845 | 11116 | 0.554882836 | 0 |
| 23762 | 11033 | 0.557430025 | 0 | 23790 | 11061 | 0.556644682 | -1.039654816 | 23818 | 11089 | 0.554882836 | 0 | 23846 | 11117 | 0.554882836 | 0 |
| 23763 | 11034 | 0.557430025 | 0 | 23791 | 11062 | 0.556409356 | 0 | 23819 | 11090 | 0.554882836 | 0 | 23847 | 11118 | 0.554882836 | 0 |
| 23764 | 11035 | 0.557430025 | 0 | 23792 | 11063 | 0.556409356 | 0 | 23820 | 11091 | 0.554882836 | 0 | 23848 | 11119 | 0.554882836 | 0 |
| 23765 | 11036 | 0.557430025 | 0 | 23793 | 11064 | 0.556409356 | -1.579159304 | 23821 | 11092 | 0.554882836 | 0 | 23849 | 11120 | 0.554882836 | 0 |
| 23766 | 11037 | 0.557430025 | 0 | 23794 | 11065 | 0.556229486 | 0 | 23822 | 11093 | 0.554882836 | 0 | 23850 | 11121 | 0.554882836 | 0 |
| 23767 | 11038 | 0.557430025 | 0 | 23795 | 11066 | 0.556229486 | 0 | 23823 | 11094 | 0.554882836 | 0 | 23851 | 11122 | 0.554882836 | -0.667835999 |
| 23768 | 11039 | 0.557430025 | -0.3148972 | 23796 | 11067 | 0.556229486 | 0 | 23824 | 11095 | 0.554882836 | 0 | 23852 | 11123 | 0.554882836 | -1.006654556 |
| 23769 | 11040 | 0.557174633 | 0 | 23797 | 11068 | 0.556229486 | 0 | 23825 | 11096 | 0.554882836 | 0 | 23853 | 11124 | 0.554882836 | -1.307684552 |
| 23770 | 11041 | 0.557174633 | 0 | 23798 | 11069 | 0.556229486 | 0 | 23826 | 11097 | 0.554882836 | 0 | 23854 | 11125 | 0.554882836 | -1.404594565 |
| 23771 | 11042 | 0.557174633 | 0 | 23799 | 11070 | 0.556229486 | 0 | 23827 | 11098 | 0.554882836 | 0 | 23855 | 11126 | 0.554190733 | 0 |
| 23772 | 11043 | 0.557174633 | 0 | 23800 | 11071 | 0.556229486 | 0 | 23828 | 11099 | 0.554882836 | 0 | 23856 | 11127 | 0.554037082 | 0 |
| 23773 | 11044 | 0.557174633 | 0 | 23801 | 11072 | 0.556087537 | 0 | 23829 | 11100 | 0.554882836 | 0 | 23857 | 11128 | 0.553969493 | 0 |
| 23774 | 11045 | 0.557174633 | 0 | 23802 | 11073 | 0.556087537 | 0 | 23830 | 11101 | 0.554882836 | 0 | 23858 | 11129 | 0.553969493 | 0 |
| 23775 | 11046 | 0.557174633 | 0 | 23803 | 11074 | 0.556087537 | 0 | 23831 | 11102 | 0.554882836 | 0 | 23859 | 11130 | 0.553890162 | 0 |
| 23776 | 11047 | 0.556965787 | 0 | 23804 | 11075 | 0.556087537 | 0 | 23832 | 11103 | 0.554882836 | 0 | 23860 | 11131 | 0.553890162 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23861 | 11132 | 0.553890162 | 0 | 23889 | 11160 | 0.553128108 | 0 | 23917 | 11188 | 0.552034993 | 0 | 23945 | 11216 | 0.551211686 | 0 |
| 23862 | 11133 | 0.55379574 | 0 | 23890 | 11161 | 0.5529822 | 0 | 23918 | 11189 | 0.552034993 | 0 | 23946 | 11217 | 0.551089847 | 0 |
| 23863 | 11134 | 0.55379574 | 0 | 23891 | 11162 | 0.5529822 | 0 | 23919 | 11190 | 0.552034993 | 0 | 23947 | 11218 | 0.551089847 | 0 |
| 23864 | 11135 | 0.55379574 | 0 | 23892 | 11163 | 0.5529822 | 0 | 23920 | 11191 | 0.551911596 | 0 | 23948 | 11219 | 0.551089847 | 0 |
| 23865 | 11136 | 0.55379574 | 0 | 23893 | 11164 | 0.5529822 | 0 | 23921 | 11192 | 0.551911596 | 0 | 23949 | 11220 | 0.551089847 | 0 |
| 23866 | 11137 | 0.553681467 | 0 | 23894 | 11165 | 0.552809827 | 0 | 23922 | 11193 | 0.551911596 | -0.623165604 | 23950 | 11221 | 0.551089847 | 0 |
| 23867 | 11138 | 0.553681467 | 0 | 23895 | 11166 | 0.552809827 | 0 | 23923 | 11194 | 0.551629678 | 0 | 23951 | 11222 | 0.550959643 | 0 |
| 23868 | 11139 | 0.553681467 | 0 | 23896 | 11167 | 0.552809827 | 0 | 23924 | 11195 | 0.551629678 | 0 | 23952 | 11223 | 0.550867758 | 0 |
| 23869 | 11140 | 0.553681467 | 0 | 23897 | 11168 | 0.552809827 | 0 | 23925 | 11196 | 0.551629678 | 0 | 23953 | 11224 | 0.550867758 | 0 |
| 23870 | 11141 | 0.553681467 | 0 | 23898 | 11169 | 0.552809827 | 0 | 23926 | 11197 | 0.551629678 | 0 | 23954 | 11225 | 0.550867758 | 0 |
| 23871 | 11142 | 0.553681467 | 0 | 23899 | 11170 | 0.552809827 | 0 | 23927 | 11198 | 0.551629678 | 0 | 23955 | 11226 | 0.550867758 | 0 |
| 23872 | 11143 | 0.553681467 | 0 | 23900 | 11171 | 0.552809827 | -1.448060258 | 23928 | 11199 | 0.551629678 | 0 | 23956 | 11227 | 0.550867758 | 0 |
| 23873 | 11144 | 0.553681467 | -0.021791703 | 23901 | 11172 | 0.552676424 | 0 | 23929 | 11200 | 0.551629678 | 0 | 23957 | 11228 | 0.550867758 | 0 |
| 23874 | 11145 | 0.553614822 | 0 | 23902 | 11173 | 0.55260307 | 0 | 23930 | 11201 | 0.551629678 | 0 | 23958 | 11229 | 0.550867758 | 0 |
| 23875 | 11146 | 0.553540348 | 0 | 23903 | 11174 | 0.55260307 | 0 | 23931 | 11202 | 0.551629678 | 0 | 23959 | 11230 | 0.550867758 | 0 |
| 23876 | 11147 | 0.553540348 | 0 | 23904 | 11175 | 0.55260307 | 0 | 23932 | 11203 | 0.551629678 | 0 | 23960 | 11231 | 0.550867758 | -0.296635883 |
| 23877 | 11148 | 0.553540348 | 0 | 23905 | 11176 | 0.55260307 | 0 | 23933 | 11204 | 0.551629678 | 0 | 23961 | 11232 | 0.550867758 | -1.338028568 |
| 23878 | 11149 | 0.553540348 | 0 | 23906 | 11177 | 0.55260307 | -0.707904327 | 23934 | 11205 | 0.551629678 | 0 | 23962 | 11233 | 0.550746667 | 0 |
| 23879 | 11150 | 0.553540348 | 0 | 23907 | 11178 | 0.552350499 | 0 | 23935 | 11206 | 0.551629678 | 0 | 23963 | 11234 | 0.550746667 | 0 |
| 23880 | 11151 | 0.553540348 | 0 | 23908 | 11179 | 0.552350499 | 0 | 23936 | 11207 | 0.551380442 | 0 | 23964 | 11235 | 0.550746667 | 0 |
| 23881 | 11152 | 0.553361663 | 0 | 23909 | 11180 | 0.552350499 | 0 | 23937 | 11208 | 0.551380442 | 0 | 23965 | 11236 | 0.550746667 | 0 |
| 23882 | 11153 | 0.553361663 | 0 | 23910 | 11181 | 0.552350499 | 0 | 23938 | 11209 | 0.551380442 | 0 | 23966 | 11237 | 0.550746667 | 0 |
| 23883 | 11154 | 0.553361663 | 0 | 23911 | 11182 | 0.552350499 | 0 | 23939 | 11210 | 0.551288654 | 0 | 23967 | 11238 | 0.550746667 | 0 |
| 23884 | 11155 | 0.553253211 | 0 | 23912 | 11183 | 0.552350499 | 0 | 23940 | 11211 | 0.551288654 | 0 | 23968 | 11239 | 0.550335208 | 0 |
| 23885 | 11156 | 0.553128108 | 0 | 23913 | 11184 | 0.552350499 | -0.458279424 | 23941 | 11212 | 0.551288654 | 0 | 23969 | 11240 | 0.550335208 | 0 |
| 23886 | 11157 | 0.553128108 | 0 | 23914 | 11185 | 0.552148549 | 0 | 23942 | 11213 | 0.551288654 | 0 | 23970 | 11241 | 0.550335208 | 0 |
| 23887 | 11158 | 0.553128108 | 0 | 23915 | 11186 | 0.552034993 | 0 | 23943 | 11214 | 0.551288654 | 0 | 23971 | 11242 | 0.550335208 | 0 |
| 23888 | 11159 | 0.553128108 | 0 | 23916 | 11187 | 0.552034993 | 0 | 23944 | 11215 | 0.551288654 | -0.431669842 | 23972 | 11243 | 0.550335208 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 23973 | 11244 | 0.550335208 | 0 | 24001 | 11272 | 0.54963978 | 0 | 24029 | 11300 | 0.548529407 | 0 | 24057 | 11328 | 0.547329698 | 0 |
| 23974 | 11245 | 0.550335208 | 0 | 24002 | 11273 | 0.54963978 | -0.181358292 | 24030 | 11301 | 0.548400708 | 0 | 24058 | 11329 | 0.547329698 | 0 |
| 23975 | 11246 | 0.550335208 | 0 | 24003 | 11274 | 0.54963978 | -1.222750977 | 24031 | 11302 | 0.548400708 | 0 | 24059 | 11330 | 0.547329698 | 0 |
| 23976 | 11247 | 0.550335208 | 0 | 24004 | 11275 | 0.549474366 | 0 | 24032 | 11303 | 0.548400708 | 0 | 24060 | 11331 | 0.547329698 | 0 |
| 23977 | 11248 | 0.550335208 | 0 | 24005 | 11276 | 0.549474366 | 0 | 24033 | 11304 | 0.548400708 | 0 | 24061 | 11332 | 0.547329698 | 0 |
| 23978 | 11249 | 0.550335208 | 0 | 24006 | 11277 | 0.549474366 | 0 | 24034 | 11305 | 0.548400708 | 0 | 24062 | 11333 | 0.547329698 | 0 |
| 23979 | 11250 | 0.550335208 | 0 | 24007 | 11278 | 0.549474366 | 0 | 24035 | 11306 | 0.548400708 | 0 | 24063 | 11334 | 0.547329698 | 0 |
| 23980 | 11251 | 0.550335208 | 0 | 24008 | 11279 | 0.549205703 | 0 | 24036 | 11307 | 0.548400708 | 0 | 24064 | 11335 | 0.547329698 | 0 |
| 23981 | 11252 | 0.550335208 | 0 | 24009 | 11280 | 0.549205703 | 0 | 24037 | 11308 | 0.548296947 | -0.601512152 | 24065 | 11336 | 0.547329698 | 0 |
| 23982 | 11253 | 0.550335208 | 0 | 24010 | 11281 | 0.549205703 | 0 | 24038 | 11309 | 0.548211514 | 0 | 24066 | 11337 | 0.547329698 | 0 |
| 23983 | 11254 | 0.550335208 | 0 | 24011 | 11282 | 0.549205703 | 0 | 24039 | 11310 | 0.548211514 | 0 | 24067 | 11338 | 0.547329698 | 0 |
| 23984 | 11255 | 0.550335208 | -0.2507797 | 24012 | 11283 | 0.549205703 | 0 | 24040 | 11311 | 0.548211514 | 0 | 24068 | 11339 | 0.547329698 | 0 |
| 23985 | 11256 | 0.549942003 | 0 | 24013 | 11284 | 0.549205703 | 0 | 24041 | 11312 | 0.548211514 | 0 | 24069 | 11340 | 0.547329698 | 0 |
| 23986 | 11257 | 0.549942003 | 0 | 24014 | 11285 | 0.549205703 | 0 | 24042 | 11313 | 0.548211514 | 0 | 24070 | 11341 | 0.547329698 | 0 |
| 23987 | 11258 | 0.549942003 | 0 | 24015 | 11286 | 0.549205703 | 0 | 24043 | 11314 | 0.548211514 | 0 | 24071 | 11342 | 0.547329698 | 0 |
| 23988 | 11259 | 0.549942003 | 0 | 24016 | 11287 | 0.549205703 | 0 | 24044 | 11315 | 0.548211514 | 0 | 24072 | 11343 | 0.547329698 | 0 |
| 23989 | 11260 | 0.549942003 | 0 | 24017 | 11288 | 0.549205703 | -1.313361685 | 24045 | 11316 | 0.548211514 | -1.039654816 | 24073 | 11344 | 0.547329698 | 0 |
| 23990 | 11261 | 0.549942003 | 0 | 24018 | 11289 | 0.548908952 | 0 | 24046 | 11317 | 0.548079128 | 0 | 24074 | 11345 | 0.547329698 | 0 |
| 23991 | 11262 | 0.549832843 | 0 | 24019 | 11290 | 0.548829853 | 0 | 24047 | 11318 | 0.548079128 | 0 | 24075 | 11346 | 0.547329698 | 0 |
| 23992 | 11263 | 0.549832843 | 0 | 24020 | 11291 | 0.548693261 | 0 | 24048 | 11319 | 0.548079128 | 0 | 24076 | 11347 | 0.547329698 | 0 |
| 23993 | 11264 | 0.549751871 | 0 | 24021 | 11292 | 0.548693261 | 0 | 24049 | 11320 | 0.548079128 | 0 | 24077 | 11348 | 0.547329698 | 0 |
| 23994 | 11265 | 0.54963978 | 0 | 24022 | 11293 | 0.548693261 | 0 | 24050 | 11321 | 0.548079128 | -1.411398273 | 24078 | 11349 | 0.547329698 | 0 |
| 23995 | 11266 | 0.54963978 | 0 | 24023 | 11294 | 0.548693261 | 0 | 24051 | 11322 | 0.548079128 | -1.411398273 | 24079 | 11350 | 0.547329698 | 0 |
| 23996 | 11267 | 0.54963978 | 0 | 24024 | 11295 | 0.548693261 | 0 | 24052 | 11323 | 0.547981303 | 0 | 24080 | 11351 | 0.547329698 | 0 |
| 23997 | 11268 | 0.54963978 | 0 | 24025 | 11296 | 0.548693261 | 0 | 24053 | 11324 | 0.547906068 | 0 | 24081 | 11352 | 0.547329698 | 0 |
| 23998 | 11269 | 0.54963978 | 0 | 24026 | 11297 | 0.548693261 | 0 | 24054 | 11325 | 0.547906068 | 0 | 24082 | 11353 | 0.547329698 | 0 |
| 23999 | 11270 | 0.54963978 | 0 | 24027 | 11298 | 0.548529407 | 0 | 24055 | 11326 | 0.547846408 | 0 | 24083 | 11354 | 0.547329698 | 0 |
| 24000 | 11271 | 0.54963978 | 0 | 24028 | 11299 | 0.548529407 | 0 | 24056 | 11327 | 0.547329698 | 0 | 24084 | 11355 | 0.547329698 | -0.889268957 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24085 | 11356 | 0.546795182 | 0 | 24113 | 11384 | 0.546029414 | 0 | 24141 | 11412 | 0.545195568 | 0 | 24169 | 11440 | 0.544344844 | 0 |
| 24086 | 11357 | 0.546731084 | 0 | 24114 | 11385 | 0.546029414 | 0 | 24142 | 11413 | 0.545195568 | 0 | 24170 | 11441 | 0.544344844 | 0 |
| 24087 | 11358 | 0.546649519 | 0 | 24115 | 11386 | 0.546029414 | -1.474145827 | 24143 | 11414 | 0.545195568 | 0 | 24171 | 11442 | 0.544344844 | 0 |
| 24088 | 11359 | 0.546649519 | 0 | 24116 | 11387 | 0.545834707 | 0 | 24144 | 11415 | 0.545195568 | 0 | 24172 | 11443 | 0.544188314 | 0 |
| 24089 | 11360 | 0.546649519 | 0 | 24117 | 11388 | 0.545834707 | 0 | 24145 | 11416 | 0.544940176 | 0 | 24173 | 11444 | 0.544188314 | 0 |
| 24090 | 11361 | 0.546649519 | 0 | 24118 | 11389 | 0.545834707 | 0 | 24146 | 11417 | 0.544940176 | 0 | 24174 | 11445 | 0.544188314 | 0 |
| 24091 | 11362 | 0.546649519 | 0 | 24119 | 11390 | 0.545834707 | -0.568544654 | 24147 | 11418 | 0.544840898 | 0 | 24175 | 11446 | 0.544086259 | 0 |
| 24092 | 11363 | 0.546649519 | -0.175466966 | 24120 | 11391 | 0.545668914 | 0 | 24148 | 11419 | 0.544840898 | 0 | 24176 | 11447 | 0.544086259 | 0 |
| 24093 | 11364 | 0.546542219 | 0 | 24121 | 11392 | 0.545668914 | 0 | 24149 | 11420 | 0.544840898 | 0 | 24177 | 11448 | 0.544086259 | 0 |
| 24094 | 11365 | 0.546542219 | 0 | 24122 | 11393 | 0.545668914 | 0 | 24150 | 11421 | 0.544840898 | 0 | 24178 | 11449 | 0.544086259 | 0 |
| 24095 | 11366 | 0.546542219 | 0 | 24123 | 11394 | 0.545571418 | 0 | 24151 | 11422 | 0.544840898 | 0 | 24179 | 11450 | 0.544086259 | 0 |
| 24096 | 11367 | 0.546542219 | 0 | 24124 | 11395 | 0.545571418 | 0 | 24152 | 11423 | 0.544840898 | 0 | 24180 | 11451 | 0.543601825 | 0 |
| 24097 | 11368 | 0.546542219 | 0 | 24125 | 11396 | 0.545571418 | 0 | 24153 | 11424 | 0.544840898 | 0 | 24181 | 11452 | 0.543601825 | 0 |
| 24098 | 11369 | 0.546542219 | -0.135386282 | 24126 | 11397 | 0.545571418 | 0 | 24154 | 11425 | 0.544615349 | 0 | 24182 | 11453 | 0.543601825 | 0 |
| 24099 | 11370 | 0.546394726 | 0 | 24127 | 11398 | 0.545571418 | 0 | 24155 | 11426 | 0.544615349 | 0 | 24183 | 11454 | 0.543601825 | 0 |
| 24100 | 11371 | 0.546394726 | 0 | 24128 | 11399 | 0.545571418 | 0 | 24156 | 11427 | 0.544615349 | 0 | 24184 | 11455 | 0.543601825 | 0 |
| 24101 | 11372 | 0.546394726 | 0 | 24129 | 11400 | 0.545571418 | 0 | 24157 | 11428 | 0.544615349 | 0 | 24185 | 11456 | 0.543601825 | 0 |
| 24102 | 11373 | 0.546394726 | 0 | 24130 | 11401 | 0.545571418 | 0 | 24158 | 11429 | 0.544615349 | 0 | 24186 | 11457 | 0.543601825 | 0 |
| 24103 | 11374 | 0.546394726 | 0 | 24131 | 11402 | 0.545571418 | 0 | 24159 | 11430 | 0.544615349 | -1.155224741 | 24187 | 11458 | 0.543601825 | 0 |
| 24104 | 11375 | 0.546394726 | 0 | 24132 | 11403 | 0.545571418 | 0 | 24160 | 11431 | 0.544459268 | 0 | 24188 | 11459 | 0.543601825 | 0 |
| 24105 | 11376 | 0.546298119 | -1.097426029 | 24133 | 11404 | 0.545571418 | 0 | 24161 | 11432 | 0.544344844 | 0 | 24189 | 11460 | 0.543601825 | 0 |
| 24106 | 11377 | 0.546179248 | 0 | 24134 | 11405 | 0.545195568 | 0 | 24162 | 11433 | 0.544344844 | 0 | 24190 | 11461 | 0.543601825 | 0 |
| 24107 | 11378 | 0.546179248 | 0 | 24135 | 11406 | 0.545195568 | 0 | 24163 | 11434 | 0.544344844 | 0 | 24191 | 11462 | 0.543601825 | 0 |
| 24108 | 11379 | 0.546179248 | 0 | 24136 | 11407 | 0.545195568 | 0 | 24164 | 11435 | 0.544344844 | 0 | 24192 | 11463 | 0.543601825 | 0 |
| 24109 | 11380 | 0.546179248 | 0 | 24137 | 11408 | 0.545195568 | 0 | 24165 | 11436 | 0.544344844 | 0 | 24193 | 11464 | 0.543601825 | 0 |
| 24110 | 11381 | 0.546179248 | 0 | 24138 | 11409 | 0.545195568 | 0 | 24166 | 11437 | 0.544344844 | 0 | 24194 | 11465 | 0.543601825 | 0 |
| 24111 | 11382 | 0.546179248 | -1.527241504 | 24139 | 11410 | 0.545195568 | 0 | 24167 | 11438 | 0.544344844 | 0 | 24195 | 11466 | 0.543601825 | 0 |
| 24112 | 11383 | 0.546029414 | 0 | 24140 | 11411 | 0.545195568 | 0 | 24168 | 11439 | 0.544344844 | 0 | 24196 | 11467 | 0.543601825 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24197 | 11468 | 0.543601825 | 0 | 24225 | 11496 | 0.542366278 | 0 | 24253 | 11524 | 0.541380365 | 0 | 24281 | 11552 | 0.540958515 | 0 |
| 24198 | 11469 | 0.543601825 | 0 | 24226 | 11497 | 0.542366278 | 0 | 24254 | 11525 | 0.541380365 | 0 | 24282 | 11553 | 0.540958515 | 0 |
| 24199 | 11470 | 0.543601825 | 0 | 24227 | 11498 | 0.542366278 | 0 | 24255 | 11526 | 0.541380365 | 0 | 24283 | 11554 | 0.540958515 | 0 |
| 24200 | 11471 | 0.543601825 | 0 | 24228 | 11499 | 0.542366278 | 0 | 24256 | 11527 | 0.541380365 | 0 | 24284 | 11555 | 0.540958515 | 0 |
| 24201 | 11472 | 0.543601825 | 0 | 24229 | 11500 | 0.542366278 | 0 | 24257 | 11528 | 0.541380365 | 0 | 24285 | 11556 | 0.540826771 | 0 |
| 24202 | 11473 | 0.543601825 | 0 | 24230 | 11501 | 0.542366278 | 0 | 24258 | 11529 | 0.541380365 | 0 | 24286 | 11557 | 0.540826771 | 0 |
| 24203 | 11474 | 0.543601825 | -0.591966834 | 24231 | 11502 | 0.542366278 | 0 | 24259 | 11530 | 0.541380365 | 0 | 24287 | 11558 | 0.540826771 | 0 |
| 24204 | 11475 | 0.543601825 | -1.495056821 | 24232 | 11503 | 0.542366278 | 0 | 24260 | 11531 | 0.541380365 | 0 | 24288 | 11559 | 0.540826771 | 0 |
| 24205 | 11476 | 0.543156623 | 0 | 24233 | 11504 | 0.542366278 | 0 | 24261 | 11532 | 0.541380365 | 0 | 24289 | 11560 | 0.540826771 | 0 |
| 24206 | 11477 | 0.543071875 | 0 | 24234 | 11505 | 0.542151759 | 0 | 24262 | 11533 | 0.541380365 | 0 | 24290 | 11561 | 0.540826771 | 0 |
| 24207 | 11478 | 0.543071875 | 0 | 24235 | 11506 | 0.542151759 | 0 | 24263 | 11534 | 0.541380365 | 0 | 24291 | 11562 | 0.540826771 | 0 |
| 24208 | 11479 | 0.543071875 | 0 | 24236 | 11507 | 0.54201391 | 0 | 24264 | 11535 | 0.541380365 | 0 | 24292 | 11563 | 0.540575371 | 0 |
| 24209 | 11480 | 0.543071875 | 0 | 24237 | 11508 | 0.54201391 | 0 | 24265 | 11536 | 0.541380365 | 0 | 24293 | 11564 | 0.540575371 | 0 |
| 24210 | 11481 | 0.542947274 | 0 | 24238 | 11509 | 0.54201391 | 0 | 24266 | 11537 | 0.541380365 | 0 | 24294 | 11565 | 0.540575371 | 0 |
| 24211 | 11482 | 0.542947274 | 0 | 24239 | 11510 | 0.54201391 | 0 | 24267 | 11538 | 0.541380365 | 0 | 24295 | 11566 | 0.540575371 | 0 |
| 24212 | 11483 | 0.542947274 | 0 | 24240 | 11511 | 0.54201391 | 0 | 24268 | 11539 | 0.541380365 | 0 | 24296 | 11567 | 0.540575371 | 0 |
| 24213 | 11484 | 0.542860075 | 0 | 24241 | 11512 | 0.54201391 | 0 | 24269 | 11540 | 0.541380365 | 0 | 24297 | 11568 | 0.540575371 | 0 |
| 24214 | 11485 | 0.542746072 | 0 | 24242 | 11513 | 0.54201391 | 0 | 24270 | 11541 | 0.541380365 | 0 | 24298 | 11569 | 0.540575371 | 0 |
| 24215 | 11486 | 0.542746072 | 0 | 24243 | 11514 | 0.541847098 | 0 | 24271 | 11542 | 0.541380365 | 0 | 24299 | 11570 | 0.540575371 | 0 |
| 24216 | 11487 | 0.542746072 | 0 | 24244 | 11515 | 0.541847098 | 0 | 24272 | 11543 | 0.541380365 | 0 | 24300 | 11571 | 0.540575371 | -1.460294715 |
| 24217 | 11488 | 0.542746072 | 0 | 24245 | 11516 | 0.541847098 | 0 | 24273 | 11544 | 0.541380365 | 0 | 24301 | 11572 | 0.540575371 | -0.381113469 |
| 24218 | 11489 | 0.542746072 | 0 | 24246 | 11517 | 0.541847098 | 0 | 24274 | 11545 | 0.541380365 | -1.515007048 | 24302 | 11573 | 0.540338891 | 0 |
| 24219 | 11490 | 0.542590662 | 0 | 24247 | 11518 | 0.541847098 | 0 | 24275 | 11546 | 0.541094551 | 0 | 24303 | 11574 | 0.540338891 | 0 |
| 24220 | 11491 | 0.542590662 | 0 | 24248 | 11519 | 0.541847098 | 0 | 24276 | 11547 | 0.541039609 | 0 | 24304 | 11575 | 0.540338891 | 0 |
| 24221 | 11492 | 0.542590662 | 0 | 24249 | 11520 | 0.541847098 | 0 | 24277 | 11548 | 0.541039609 | 0 | 24305 | 11576 | 0.540338891 | 0 |
| 24222 | 11493 | 0.542366278 | 0 | 24250 | 11521 | 0.541749821 | 0 | 24278 | 11549 | 0.540958515 | 0 | 24306 | 11577 | 0.540338891 | 0 |
| 24223 | 11494 | 0.542366278 | 0 | 24251 | 11522 | 0.541749821 | 0 | 24279 | 11550 | 0.540958515 | 0 | 24307 | 11578 | 0.540225838 | 0 |
| 24224 | 11495 | 0.542366278 | 0 | 24252 | 11523 | 0.541686099 | 0 | 24280 | 11551 | 0.540958515 | 0 | 24308 | 11579 | 0.540225838 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24309 | 11580 | 0.540225838 | 0 | 24337 | 11608 | 0.539339824 | 0 | 24365 | 11636 | 0.538435985 | 0 | 24393 | 11664 | 0.537202193 | 0 |
| 24310 | 11581 | 0.53990568 | 0 | 24338 | 11609 | 0.539339824 | 0 | 24366 | 11637 | 0.538435985 | -0.216921433 | 24394 | 11665 | 0.536971247 | 0 |
| 24311 | 11582 | 0.53990568 | 0 | 24339 | 11610 | 0.539339824 | 0 | 24367 | 11638 | 0.538435985 | -1.296102679 | 24395 | 11666 | 0.536971247 | 0 |
| 24312 | 11583 | 0.53990568 | 0 | 24340 | 11611 | 0.539339824 | 0 | 24368 | 11639 | 0.53830842 | 0 | 24396 | 11667 | 0.536971247 | 0 |
| 24313 | 11584 | 0.53990568 | 0 | 24341 | 11612 | 0.539170211 | 0 | 24369 | 11640 | 0.538069337 | 0 | 24397 | 11668 | 0.536971247 | 0 |
| 24314 | 11585 | 0.53990568 | 0 | 24342 | 11613 | 0.539170211 | 0 | 24370 | 11641 | 0.538069337 | 0 | 24398 | 11669 | 0.536971247 | 0 |
| 24315 | 11586 | 0.53990568 | 0 | 24343 | 11614 | 0.539170211 | 0 | 24371 | 11642 | 0.538069337 | 0 | 24399 | 11670 | 0.536971247 | 0 |
| 24316 | 11587 | 0.53990568 | 0 | 24344 | 11615 | 0.539170211 | 0 | 24372 | 11643 | 0.538069337 | 0 | 24400 | 11671 | 0.536971247 | 0 |
| 24317 | 11588 | 0.53990568 | 0 | 24345 | 11616 | 0.53885539 | 0 | 24373 | 11644 | 0.538069337 | 0 | 24401 | 11672 | 0.536829759 | 0 |
| 24318 | 11589 | 0.53990568 | 0 | 24346 | 11617 | 0.53885539 | 0 | 24374 | 11645 | 0.538069337 | -0.370255541 | 24402 | 11673 | 0.536762401 | 0 |
| 24319 | 11590 | 0.53990568 | 0 | 24347 | 11618 | 0.53885539 | 0 | 24375 | 11646 | 0.538069337 | -0.722438059 | 24403 | 11674 | 0.536762401 | 0 |
| 24320 | 11591 | 0.53990568 | 0 | 24348 | 11619 | 0.53885539 | 0 | 24376 | 11647 | 0.537746081 | 0 | 24404 | 11675 | 0.536762401 | 0 |
| 24321 | 11592 | 0.53990568 | 0 | 24349 | 11620 | 0.53885539 | 0 | 24377 | 11648 | 0.537746081 | 0 | 24405 | 11676 | 0.536572628 | 0 |
| 24322 | 11593 | 0.53990568 | 0 | 24350 | 11621 | 0.53885539 | 0 | 24378 | 11649 | 0.537746081 | 0 | 24406 | 11677 | 0.536572628 | 0 |
| 24323 | 11594 | 0.539668296 | 0 | 24351 | 11622 | 0.53885539 | 0 | 24379 | 11650 | 0.537746081 | 0 | 24407 | 11678 | 0.536572628 | 0 |
| 24324 | 11595 | 0.539518436 | 0 | 24352 | 11623 | 0.53885539 | 0 | 24380 | 11651 | 0.537646666 | 0 | 24408 | 11679 | 0.536572628 | 0 |
| 24325 | 11596 | 0.539518436 | 0 | 24353 | 11624 | 0.53885539 | 0 | 24381 | 11652 | 0.537646666 | 0 | 24409 | 11680 | 0.536572628 | 0 |
| 24326 | 11597 | 0.539518436 | 0 | 24354 | 11625 | 0.53885539 | 0 | 24382 | 11653 | 0.537458944 | 0 | 24410 | 11681 | 0.536572628 | 0 |
| 24327 | 11598 | 0.539518436 | 0 | 24355 | 11626 | 0.53885539 | 0 | 24383 | 11654 | 0.537458944 | 0 | 24411 | 11682 | 0.536572628 | -1.163267462 |
| 24328 | 11599 | 0.539518436 | 0 | 24356 | 11627 | 0.538638406 | 0 | 24384 | 11655 | 0.537458944 | 0 | 24412 | 11683 | 0.53639943 | 0 |
| 24329 | 11600 | 0.539339824 | 0 | 24357 | 11628 | 0.538569388 | 0 | 24385 | 11656 | 0.537458944 | 0 | 24413 | 11684 | 0.53639943 | 0 |
| 24330 | 11601 | 0.539339824 | 0 | 24358 | 11629 | 0.538569388 | 0 | 24386 | 11657 | 0.537458944 | 0 | 24414 | 11685 | 0.53639943 | 0 |
| 24331 | 11602 | 0.539339824 | 0 | 24359 | 11630 | 0.538435985 | 0 | 24387 | 11658 | 0.537458944 | 0 | 24415 | 11686 | 0.536240726 | 0 |
| 24332 | 11603 | 0.539339824 | 0 | 24360 | 11631 | 0.538435985 | 0 | 24388 | 11659 | 0.537458944 | 0 | 24416 | 11687 | 0.536240726 | 0 |
| 24333 | 11604 | 0.539339824 | 0 | 24361 | 11632 | 0.538435985 | 0 | 24389 | 11660 | 0.537458944 | 0 | 24417 | 11688 | 0.536240726 | 0 |
| 24334 | 11605 | 0.539339824 | 0 | 24362 | 11633 | 0.538435985 | 0 | 24390 | 11661 | 0.537458944 | 0 | 24418 | 11689 | 0.536094769 | 0 |
| 24335 | 11606 | 0.539339824 | 0 | 24363 | 11634 | 0.538435985 | 0 | 24391 | 11662 | 0.537458944 | -0.262317614 | 24419 | 11690 | 0.536094769 | 0 |
| 24336 | 11607 | 0.539339824 | 0 | 24364 | 11635 | 0.538435985 | 0 | 24392 | 11663 | 0.537202193 | 0 | 24420 | 11691 | 0.536094769 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24421 | 11692 | 0.535960083 | 0 | 24449 | 11720 | 0.535329299 | 0 | 24477 | 11748 | 0.53467945 | 0 | 24505 | 11776 | 0.532606441 | 0 |
| 24422 | 11693 | 0.535960083 | 0 | 24450 | 11721 | 0.535168658 | 0 | 24478 | 11749 | 0.53467945 | 0 | 24506 | 11777 | 0.532606441 | 0 |
| 24423 | 11694 | 0.535960083 | 0 | 24451 | 11722 | 0.535168658 | 0 | 24479 | 11750 | 0.534585007 | 0 | 24507 | 11778 | 0.532606441 | 0 |
| 24424 | 11695 | 0.535960083 | 0 | 24452 | 11723 | 0.535168658 | 0 | 24480 | 11751 | 0.534585007 | 0 | 24508 | 11779 | 0.532606441 | 0 |
| 24425 | 11696 | 0.535960083 | 0 | 24453 | 11724 | 0.535168658 | 0 | 24481 | 11752 | 0.534585007 | 0 | 24509 | 11780 | 0.532606441 | 0 |
| 24426 | 11697 | 0.535960083 | 0 | 24454 | 11725 | 0.535168658 | 0 | 24482 | 11753 | 0.534585007 | -1.466285079 | 24510 | 11781 | 0.532606441 | 0 |
| 24427 | 11698 | 0.535960083 | 0 | 24455 | 11726 | 0.535168658 | 0 | 24483 | 11754 | 0.534498795 | 0 | 24511 | 11782 | 0.532606441 | 0 |
| 24428 | 11699 | 0.535835411 | -0.349855775 | 24456 | 11727 | 0.535025915 | 0 | 24484 | 11755 | 0.534498795 | 0 | 24512 | 11783 | 0.532606441 | 0 |
| 24429 | 11700 | 0.535835411 | -0.035461818 | 24457 | 11728 | 0.535025915 | 0 | 24485 | 11756 | 0.534498795 | 0 | 24513 | 11784 | 0.532606441 | 0 |
| 24430 | 11701 | 0.535719677 | 0 | 24458 | 11729 | 0.535025915 | 0 | 24486 | 11757 | 0.534498795 | 0 | 24514 | 11785 | 0.532606441 | 0 |
| 24431 | 11702 | 0.535719677 | 0 | 24459 | 11730 | 0.535025915 | 0 | 24487 | 11758 | 0.534498795 | -0.786706442 | 24515 | 11786 | 0.532606441 | 0 |
| 24432 | 11703 | 0.535719677 | 0 | 24460 | 11731 | 0.535025915 | 0 | 24488 | 11759 | 0.534419782 | 0 | 24516 | 11787 | 0.532606441 | 0 |
| 24433 | 11704 | 0.535719677 | 0 | 24461 | 11732 | 0.535025915 | 0 | 24489 | 11760 | 0.534419782 | 0 | 24517 | 11788 | 0.532606441 | 0 |
| 24434 | 11705 | 0.535719677 | 0 | 24462 | 11733 | 0.535025915 | 0 | 24490 | 11761 | 0.534419782 | 0 | 24518 | 11789 | 0.532606441 | 0 |
| 24435 | 11706 | 0.535611951 | 0 | 24463 | 11734 | 0.535025915 | 0 | 24491 | 11762 | 0.534347103 | 0 | 24519 | 11790 | 0.532606441 | 0 |
| 24436 | 11707 | 0.535611951 | 0 | 24464 | 11735 | 0.535025915 | 0 | 24492 | 11763 | 0.534280025 | 0 | 24520 | 11791 | 0.532606441 | 0 |
| 24437 | 11708 | 0.535611951 | 0 | 24465 | 11736 | 0.535025915 | 0 | 24493 | 11764 | 0.534280025 | 0 | 24521 | 11792 | 0.532606441 | 0 |
| 24438 | 11709 | 0.535511432 | 0 | 24466 | 11737 | 0.534898238 | 0 | 24494 | 11765 | 0.533924483 | 0 | 24522 | 11793 | 0.532606441 | 0 |
| 24439 | 11710 | 0.535511432 | 0 | 24467 | 11738 | 0.534898238 | 0 | 24495 | 11766 | 0.532606441 | 0 | 24523 | 11794 | 0.532606441 | 0 |
| 24440 | 11711 | 0.535511432 | 0 | 24468 | 11739 | 0.534898238 | 0 | 24496 | 11767 | 0.532606441 | 0 | 24524 | 11795 | 0.532606441 | 0 |
| 24441 | 11712 | 0.535329299 | 0 | 24469 | 11740 | 0.534898238 | 0 | 24497 | 11768 | 0.532606441 | 0 | 24525 | 11796 | 0.532606441 | 0 |
| 24442 | 11713 | 0.535329299 | 0 | 24470 | 11741 | 0.534898238 | 0 | 24498 | 11769 | 0.532606441 | 0 | 24526 | 11797 | 0.532606441 | 0 |
| 24443 | 11714 | 0.535329299 | 0 | 24471 | 11742 | 0.534898238 | 0 | 24499 | 11770 | 0.532606441 | 0 | 24527 | 11798 | 0.532606441 | 0 |
| 24444 | 11715 | 0.535329299 | 0 | 24472 | 11743 | 0.53478336 | 0 | 24500 | 11771 | 0.532606441 | 0 | 24528 | 11799 | 0.532606441 | 0 |
| 24445 | 11716 | 0.535329299 | 0 | 24473 | 11744 | 0.53478336 | 0 | 24501 | 11772 | 0.532606441 | 0 | 24529 | 11800 | 0.532606441 | 0 |
| 24446 | 11717 | 0.535329299 | 0 | 24474 | 11745 | 0.53478336 | 0 | 24502 | 11773 | 0.532606441 | 0 | 24530 | 11801 | 0.532606441 | 0 |
| 24447 | 11718 | 0.535329299 | 0 | 24475 | 11746 | 0.53467945 | 0 | 24503 | 11774 | 0.532606441 | 0 | 24531 | 11802 | 0.532606441 | 0 |
| 24448 | 11719 | 0.535329299 | 0 | 24476 | 11747 | 0.53467945 | 0 | 24504 | 11775 | 0.532606441 | 0 | 24532 | 11803 | 0.532606441 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24533 | 11804 | 0.532606441 | 0 | 24561 | 11832 | 0.532606441 | 0 | 24589 | 11860 | 0.530326675 | 0 | 24617 | 11888 | 0.529515364 | 0 |
| 24534 | 11805 | 0.532606441 | 0 | 24562 | 11833 | 0.532606441 | 0 | 24590 | 11861 | 0.530326675 | 0 | 24618 | 11889 | 0.529515364 | 0 |
| 24535 | 11806 | 0.532606441 | 0 | 24563 | 11834 | 0.532606441 | 0 | 24591 | 11862 | 0.530326675 | 0 | 24619 | 11890 | 0.529401301 | 0 |
| 24536 | 11807 | 0.532606441 | 0 | 24564 | 11835 | 0.532606441 | 0 | 24592 | 11863 | 0.530326675 | -0.12812073 | 24620 | 11891 | 0.529401301 | 0 |
| 24537 | 11808 | 0.532606441 | 0 | 24565 | 11836 | 0.532606441 | 0 | 24593 | 11864 | 0.530200371 | 0 | 24621 | 11892 | 0.529278498 | 0 |
| 24538 | 11809 | 0.532606441 | 0 | 24566 | 11837 | 0.532606441 | 0 | 24594 | 11865 | 0.530200371 | 0 | 24622 | 11893 | 0.529278498 | 0 |
| 24539 | 11810 | 0.532606441 | 0 | 24567 | 11838 | 0.532606441 | -0.2507797 | 24595 | 11866 | 0.530059252 | 0 | 24623 | 11894 | 0.529278498 | 0 |
| 24540 | 11811 | 0.532606441 | 0 | 24568 | 11839 | 0.532606441 | -0.329960946 | 24596 | 11867 | 0.530059252 | 0 | 24624 | 11895 | 0.529278498 | 0 |
| 24541 | 11812 | 0.532606441 | 0 | 24569 | 11840 | 0.532606441 | -0.807082201 | 24597 | 11868 | 0.530059252 | 0 | 24625 | 11896 | 0.529278498 | 0 |
| 24542 | 11813 | 0.532606441 | 0 | 24570 | 11841 | 0.532606441 | -0.93875432 | 24598 | 11869 | 0.530059252 | 0 | 24626 | 11897 | 0.529145909 | 0 |
| 24543 | 11814 | 0.532606441 | 0 | 24571 | 11842 | 0.532606441 | -1.271968999 | 24599 | 11870 | 0.530059252 | -0.756777083 | 24627 | 11898 | 0.529002317 | 0 |
| 24544 | 11815 | 0.532606441 | 0 | 24572 | 11843 | 0.531207746 | 0 | 24600 | 11871 | 0.529900548 | 0 | 24628 | 11899 | 0.529002317 | 0 |
| 24545 | 11816 | 0.532606441 | 0 | 24573 | 11844 | 0.531000914 | 0 | 24601 | 11872 | 0.529900548 | 0 | 24629 | 11900 | 0.529002317 | 0 |
| 24546 | 11817 | 0.532606441 | 0 | 24574 | 11845 | 0.530872728 | 0 | 24602 | 11873 | 0.529900548 | 0 | 24630 | 11901 | 0.529002317 | 0 |
| 24547 | 11818 | 0.532606441 | 0 | 24575 | 11846 | 0.530872728 | 0 | 24603 | 11874 | 0.529900548 | 0 | 24631 | 11902 | 0.529002317 | 0 |
| 24548 | 11819 | 0.532606441 | 0 | 24576 | 11847 | 0.53080064 | 0 | 24604 | 11875 | 0.529900548 | 0 | 24632 | 11903 | 0.529002317 | 0 |
| 24549 | 11820 | 0.532606441 | 0 | 24577 | 11848 | 0.53080064 | 0 | 24605 | 11876 | 0.529900548 | 0 | 24633 | 11904 | 0.529002317 | 0 |
| 24550 | 11821 | 0.532606441 | 0 | 24578 | 11849 | 0.530636848 | 0 | 24606 | 11877 | 0.529900548 | 0 | 24634 | 11905 | 0.528846292 | 0 |
| 24551 | 11822 | 0.532606441 | 0 | 24579 | 11850 | 0.530636848 | 0 | 24607 | 11878 | 0.529900548 | 0 | 24635 | 11906 | 0.528846292 | -1.491328949 |
| 24552 | 11823 | 0.532606441 | 0 | 24580 | 11851 | 0.530636848 | 0 | 24608 | 11879 | 0.529900548 | 0 | 24636 | 11907 | 0.528676147 | 0 |
| 24553 | 11824 | 0.532606441 | 0 | 24581 | 11852 | 0.530543281 | 0 | 24609 | 11880 | 0.529900548 | 0 | 24637 | 11908 | 0.528676147 | 0 |
| 24554 | 11825 | 0.532606441 | 0 | 24582 | 11853 | 0.530440379 | 0 | 24610 | 11881 | 0.529720753 | 0 | 24638 | 11909 | 0.528676147 | 0 |
| 24555 | 11826 | 0.532606441 | 0 | 24583 | 11854 | 0.530440379 | 0 | 24611 | 11882 | 0.529720753 | 0 | 24639 | 11910 | 0.528676147 | 0 |
| 24556 | 11827 | 0.532606441 | 0 | 24584 | 11855 | 0.530326675 | 0 | 24612 | 11883 | 0.529720753 | 0 | 24640 | 11911 | 0.528676147 | 0 |
| 24557 | 11828 | 0.532606441 | 0 | 24585 | 11856 | 0.530326675 | 0 | 24613 | 11884 | 0.529720753 | 0 | 24641 | 11912 | 0.528676147 | 0 |
| 24558 | 11829 | 0.532606441 | 0 | 24586 | 11857 | 0.530326675 | 0 | 24614 | 11885 | 0.529720753 | 0 | 24642 | 11913 | 0.528489875 | 0 |
| 24559 | 11830 | 0.532606441 | 0 | 24587 | 11858 | 0.530326675 | 0 | 24615 | 11886 | 0.529621588 | 0 | 24643 | 11914 | 0.528489875 | 0 |
| 24560 | 11831 | 0.532606441 | 0 | 24588 | 11859 | 0.530326675 | 0 | 24616 | 11887 | 0.529515364 | 0 | 24644 | 11915 | 0.528489875 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24645 | 11916 | 0.528489875 | 0 | 24673 | 11944 | 0.527807558 | 0 | 24701 | 11972 | 0.526854112 | 0 | 24729 | 12000 | 0.525975862 | 0 |
| 24646 | 11917 | 0.528489875 | 0 | 24674 | 11945 | 0.527807558 | 0 | 24702 | 11973 | 0.526854112 | 0 | 24730 | 12001 | 0.525975862 | 0 |
| 24647 | 11918 | 0.528489875 | 0 | 24675 | 11946 | 0.527807558 | -0.863033606 | 24703 | 11974 | 0.526854112 | 0 | 24731 | 12002 | 0.525975862 | 0 |
| 24648 | 11919 | 0.528489875 | -0.850116833 | 24676 | 11947 | 0.527807558 | -1.084882356 | 24704 | 11975 | 0.526854112 | 0 | 24732 | 12003 | 0.525975862 | 0 |
| 24649 | 11920 | 0.528285067 | 0 | 24677 | 11948 | 0.527526916 | 0 | 24705 | 11976 | 0.526854112 | 0 | 24733 | 12004 | 0.525975862 | 0 |
| 24650 | 11921 | 0.528285067 | 0 | 24678 | 11949 | 0.527526916 | 0 | 24706 | 11977 | 0.526854112 | 0 | 24734 | 12005 | 0.525975862 | 0 |
| 24651 | 11922 | 0.528285067 | 0 | 24679 | 11950 | 0.527526916 | 0 | 24707 | 11978 | 0.526854112 | 0 | 24735 | 12006 | 0.525802733 | 0 |
| 24652 | 11923 | 0.528285067 | 0 | 24680 | 11951 | 0.527526916 | 0 | 24708 | 11979 | 0.526854112 | 0 | 24736 | 12007 | 0.525802733 | 0 |
| 24653 | 11924 | 0.528285067 | 0 | 24681 | 11952 | 0.527526916 | 0 | 24709 | 11980 | 0.526854112 | 0 | 24737 | 12008 | 0.525802733 | 0 |
| 24654 | 11925 | 0.528285067 | 0 | 24682 | 11953 | 0.527526916 | 0 | 24710 | 11981 | 0.526854112 | 0 | 24738 | 12009 | 0.525802733 | 0 |
| 24655 | 11926 | 0.528285067 | 0 | 24683 | 11954 | 0.527526916 | 0 | 24711 | 11982 | 0.526446132 | 0 | 24739 | 12010 | 0.525802733 | 0 |
| 24656 | 11927 | 0.528285067 | 0 | 24684 | 11955 | 0.527526916 | 0 | 24712 | 11983 | 0.526446132 | 0 | 24740 | 12011 | 0.525802733 | 0 |
| 24657 | 11928 | 0.528285067 | 0 | 24685 | 11956 | 0.527526916 | 0 | 24713 | 11984 | 0.526446132 | 0 | 24741 | 12012 | 0.525802733 | -1.411398273 |
| 24658 | 11929 | 0.528285067 | -0.732222329 | 24686 | 11957 | 0.527526916 | 0 | 24714 | 11985 | 0.526446132 | 0 | 24742 | 12013 | 0.525712733 | 0 |
| 24659 | 11930 | 0.528285067 | -1.431192333 | 24687 | 11958 | 0.527526916 | 0 | 24715 | 11986 | 0.526446132 | 0 | 24743 | 12014 | 0.525712733 | 0 |
| 24660 | 11931 | 0.528058813 | 0 | 24688 | 11959 | 0.527526916 | 0 | 24716 | 11987 | 0.526446132 | 0 | 24744 | 12015 | 0.525712733 | 0 |
| 24661 | 11932 | 0.528058813 | 0 | 24689 | 11960 | 0.527425929 | 0 | 24717 | 11988 | 0.526446132 | 0 | 24745 | 12016 | 0.525427856 | 0 |
| 24662 | 11933 | 0.528058813 | 0 | 24690 | 11961 | 0.527425929 | 0 | 24718 | 11989 | 0.526446132 | 0 | 24746 | 12017 | 0.525427856 | 0 |
| 24663 | 11934 | 0.528058813 | 0 | 24691 | 11962 | 0.527425929 | 0 | 24719 | 11990 | 0.526446132 | 0 | 24747 | 12018 | 0.525427856 | 0 |
| 24664 | 11935 | 0.528058813 | -1.409142192 | 24692 | 11963 | 0.527211409 | 0 | 24720 | 11991 | 0.526446132 | 0 | 24748 | 12019 | 0.525427856 | 0 |
| 24665 | 11936 | 0.528058813 | -1.409142192 | 24693 | 11964 | 0.527211409 | 0 | 24721 | 11992 | 0.526446132 | -1.454220567 | 24749 | 12020 | 0.525427856 | 0 |
| 24666 | 11937 | 0.527978037 | 0 | 24694 | 11965 | 0.527211409 | 0 | 24722 | 11993 | 0.526219642 | 0 | 24750 | 12021 | 0.525427856 | 0 |
| 24667 | 11938 | 0.527807558 | 0 | 24695 | 11966 | 0.527211409 | 0 | 24723 | 11994 | 0.526140399 | 0 | 24751 | 12022 | 0.525427856 | 0 |
| 24668 | 11939 | 0.527807558 | 0 | 24696 | 11967 | 0.527211409 | 0 | 24724 | 11995 | 0.526140399 | 0 | 24752 | 12023 | 0.525427856 | 0 |
| 24669 | 11940 | 0.527807558 | 0 | 24697 | 11968 | 0.527211409 | 0 | 24725 | 11996 | 0.526140399 | 0 | 24753 | 12024 | 0.525427856 | 0 |
| 24670 | 11941 | 0.527807558 | 0 | 24698 | 11969 | 0.527211409 | -1.335355978 | 24726 | 11997 | 0.526140399 | 0 | 24754 | 12025 | 0.525427856 | 0 |
| 24671 | 11942 | 0.527807558 | 0 | 24699 | 11970 | 0.526978356 | 0 | 24727 | 11998 | 0.525975862 | 0 | 24755 | 12026 | 0.525427856 | 0 |
| 24672 | 11943 | 0.527807558 | 0 | 24700 | 11971 | 0.526854112 | 0 | 24728 | 11999 | 0.525975862 | 0 | 24756 | 12027 | 0.525427856 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24757 | 12028 | 0.52511842 | 0 | 24785 | 12056 | 0.524006269 | 0 | 24813 | 12084 | 0.523061123 | -0.545560747 | 24841 | 12112 | 0.521882576 | 0 |
| 24758 | 12029 | 0.52511842 | -1.495056821 | 24786 | 12057 | 0.524006269 | 0 | 24814 | 12085 | 0.522846604 | 0 | 24842 | 12113 | 0.521882576 | 0 |
| 24759 | 12030 | 0.525009259 | 0 | 24787 | 12058 | 0.524006269 | 0 | 24815 | 12086 | 0.522846604 | 0 | 24843 | 12114 | 0.521882576 | 0 |
| 24760 | 12031 | 0.525009259 | 0 | 24788 | 12059 | 0.524006269 | -0.465434354 | 24816 | 12087 | 0.522846604 | 0 | 24844 | 12115 | 0.521882576 | 0 |
| 24761 | 12032 | 0.525009259 | 0 | 24789 | 12060 | 0.524006269 | -0.289343095 | 24817 | 12088 | 0.522846604 | 0 | 24845 | 12116 | 0.521882576 | 0 |
| 24762 | 12033 | 0.525009259 | 0 | 24790 | 12061 | 0.523651598 | 0 | 24818 | 12089 | 0.522846604 | 0 | 24846 | 12117 | 0.521882576 | 0 |
| 24763 | 12034 | 0.524919612 | 0 | 24791 | 12062 | 0.523558312 | 0 | 24819 | 12090 | 0.522698152 | 0 | 24847 | 12118 | 0.521882576 | 0 |
| 24764 | 12035 | 0.524781104 | 0 | 24792 | 12063 | 0.523558312 | 0 | 24820 | 12091 | 0.522698152 | 0 | 24848 | 12119 | 0.521882576 | 0 |
| 24765 | 12036 | 0.524781104 | 0 | 24793 | 12064 | 0.523558312 | 0 | 24821 | 12092 | 0.522698152 | 0 | 24849 | 12120 | 0.521882576 | 0 |
| 24766 | 12037 | 0.524637511 | 0 | 24794 | 12065 | 0.523558312 | 0 | 24822 | 12093 | 0.522698152 | 0 | 24850 | 12121 | 0.521882576 | 0 |
| 24767 | 12038 | 0.524538819 | 0 | 24795 | 12066 | 0.523558312 | 0 | 24823 | 12094 | 0.522698152 | 0 | 24851 | 12122 | 0.521882576 | 0 |
| 24768 | 12039 | 0.524538819 | 0 | 24796 | 12067 | 0.523398439 | 0 | 24824 | 12095 | 0.522698152 | 0 | 24852 | 12123 | 0.521882576 | 0 |
| 24769 | 12040 | 0.524538819 | 0 | 24797 | 12068 | 0.523398439 | 0 | 24825 | 12096 | 0.522698152 | 0 | 24853 | 12124 | 0.521882576 | 0 |
| 24770 | 12041 | 0.524538819 | 0 | 24798 | 12069 | 0.523398439 | 0 | 24826 | 12097 | 0.522506114 | 0 | 24854 | 12125 | 0.521882576 | 0 |
| 24771 | 12042 | 0.524538819 | 0 | 24799 | 12070 | 0.523398439 | -0.105085742 | 24827 | 12098 | 0.522506114 | 0 | 24855 | 12126 | 0.521882576 | 0 |
| 24772 | 12043 | 0.524538819 | 0 | 24800 | 12071 | 0.523266415 | 0 | 24828 | 12099 | 0.522506114 | 0 | 24856 | 12127 | 0.521882576 | 0 |
| 24773 | 12044 | 0.524538819 | 0 | 24801 | 12072 | 0.523266415 | 0 | 24829 | 12100 | 0.522506114 | 0 | 24857 | 12128 | 0.521882576 | 0 |
| 24774 | 12045 | 0.524538819 | -0.639058564 | 24802 | 12073 | 0.523266415 | 0 | 24830 | 12101 | 0.522506114 | 0 | 24858 | 12129 | 0.521882576 | 0 |
| 24775 | 12046 | 0.524538819 | -1.338028568 | 24803 | 12074 | 0.523061123 | 0 | 24831 | 12102 | 0.522506114 | 0 | 24859 | 12130 | 0.521882576 | 0 |
| 24776 | 12047 | 0.524006269 | 0 | 24804 | 12075 | 0.523061123 | 0 | 24832 | 12103 | 0.522506114 | -1.366390212 | 24860 | 12131 | 0.521882576 | 0 |
| 24777 | 12048 | 0.524006269 | 0 | 24805 | 12076 | 0.523061123 | 0 | 24833 | 12104 | 0.522387276 | 0 | 24861 | 12132 | 0.521882576 | 0 |
| 24778 | 12049 | 0.524006269 | 0 | 24806 | 12077 | 0.523061123 | 0 | 24834 | 12105 | 0.522306484 | 0 | 24862 | 12133 | 0.521882576 | 0 |
| 24779 | 12050 | 0.524006269 | 0 | 24807 | 12078 | 0.523061123 | 0 | 24835 | 12106 | 0.522306484 | 0 | 24863 | 12134 | 0.521882576 | -0.562533561 |
| 24780 | 12051 | 0.524006269 | 0 | 24808 | 12079 | 0.523061123 | 0 | 24836 | 12107 | 0.521882576 | 0 | 24864 | 12135 | 0.521882576 | -0.914716079 |
| 24781 | 12052 | 0.524006269 | 0 | 24809 | 12080 | 0.523061123 | 0 | 24837 | 12108 | 0.521882576 | 0 | 24865 | 12136 | 0.521882576 | -1.215746075 |
| 24782 | 12053 | 0.524006269 | 0 | 24810 | 12081 | 0.523061123 | 0 | 24838 | 12109 | 0.521882576 | 0 | 24866 | 12137 | 0.521882576 | -1.437594825 |
| 24783 | 12054 | 0.524006269 | 0 | 24811 | 12082 | 0.523061123 | 0 | 24839 | 12110 | 0.521882576 | 0 | 24867 | 12138 | 0.521422274 | 0 |
| 24784 | 12055 | 0.524006269 | 0 | 24812 | 12083 | 0.523061123 | 0 | 24840 | 12111 | 0.521882576 | 0 | 24868 | 12139 | 0.521325431 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24869 | 12140 | 0.521325431 | 0 | 24897 | 12168 | 0.520613326 | 0 | 24925 | 12196 | 0.519769216 | 0 | 24953 | 12224 | 0.519103971 | 0 |
| 24870 | 12141 | 0.521325431 | 0 | 24898 | 12169 | 0.520613326 | -0.933714096 | 24926 | 12197 | 0.519769216 | 0 | 24954 | 12225 | 0.519103971 | 0 |
| 24871 | 12142 | 0.521325431 | 0 | 24899 | 12170 | 0.520371985 | 0 | 24927 | 12198 | 0.519769216 | -0.059496942 | 24955 | 12226 | 0.519103971 | 0 |
| 24872 | 12143 | 0.521325431 | 0 | 24900 | 12171 | 0.520371985 | 0 | 24928 | 12199 | 0.519769216 | -0.439708184 | 24956 | 12227 | 0.519103971 | -0.816037044 |
| 24873 | 12144 | 0.521325431 | -1.415875575 | 24901 | 12172 | 0.520371985 | 0 | 24929 | 12200 | 0.519769216 | -1.138678188 | 24957 | 12228 | 0.519003265 | 0 |
| 24874 | 12145 | 0.521176979 | 0 | 24902 | 12173 | 0.520371985 | 0 | 24930 | 12201 | 0.519585931 | 0 | 24958 | 12229 | 0.519003265 | 0 |
| 24875 | 12146 | 0.521176979 | 0 | 24903 | 12174 | 0.520371985 | 0 | 24931 | 12202 | 0.519585931 | 0 | 24959 | 12230 | 0.518926744 | 0 |
| 24876 | 12147 | 0.521176979 | 0 | 24904 | 12175 | 0.520371985 | 0 | 24932 | 12203 | 0.519585931 | 0 | 24960 | 12231 | 0.518926744 | 0 |
| 24877 | 12148 | 0.521176979 | 0 | 24905 | 12176 | 0.520371985 | 0 | 24933 | 12204 | 0.519585931 | 0 | 24961 | 12232 | 0.518818157 | -1.630990942 |
| 24878 | 12149 | 0.521176979 | 0 | 24906 | 12177 | 0.520371985 | 0 | 24934 | 12205 | 0.519444995 | 0 | 24962 | 12233 | 0.518366002 | 0 |
| 24879 | 12150 | 0.521176979 | 0 | 24907 | 12178 | 0.520177452 | 0 | 24935 | 12206 | 0.519444995 | 0 | 24963 | 12234 | 0.518366002 | 0 |
| 24880 | 12151 | 0.521176979 | 0 | 24908 | 12179 | 0.52012073 | 0 | 24936 | 12207 | 0.519444995 | 0 | 24964 | 12235 | 0.518366002 | 0 |
| 24881 | 12152 | 0.520920683 | 0 | 24909 | 12180 | 0.520017314 | 0 | 24937 | 12208 | 0.519444995 | 0 | 24965 | 12236 | 0.518366002 | 0 |
| 24882 | 12153 | 0.520920683 | 0 | 24910 | 12181 | 0.520017314 | 0 | 24938 | 12209 | 0.519444995 | 0 | 24966 | 12237 | 0.518366002 | 0 |
| 24883 | 12154 | 0.520920683 | 0 | 24911 | 12182 | 0.520017314 | 0 | 24939 | 12210 | 0.519444995 | 0 | 24967 | 12238 | 0.518366002 | 0 |
| 24884 | 12155 | 0.520920683 | 0 | 24912 | 12183 | 0.520017314 | 0 | 24940 | 12211 | 0.519444995 | 0 | 24968 | 12239 | 0.518366002 | 0 |
| 24885 | 12156 | 0.520920683 | 0 | 24913 | 12184 | 0.520017314 | 0 | 24941 | 12212 | 0.519444995 | 0 | 24969 | 12240 | 0.518366002 | 0 |
| 24886 | 12157 | 0.520920683 | 0 | 24914 | 12185 | 0.520017314 | 0 | 24942 | 12213 | 0.519444995 | 0 | 24970 | 12241 | 0.518366002 | 0 |
| 24887 | 12158 | 0.520920683 | 0 | 24915 | 12186 | 0.520017314 | 0 | 24943 | 12214 | 0.519444995 | 0 | 24971 | 12242 | 0.518366002 | 0 |
| 24888 | 12159 | 0.520920683 | 0 | 24916 | 12187 | 0.520017314 | 0 | 24944 | 12215 | 0.519444995 | 0 | 24972 | 12243 | 0.518366002 | 0 |
| 24889 | 12160 | 0.520707218 | 0 | 24917 | 12188 | 0.519925409 | 0 | 24945 | 12216 | 0.519444995 | -1.252945762 | 24973 | 12244 | 0.518366002 | 0 |
| 24890 | 12161 | 0.520707218 | 0 | 24918 | 12189 | 0.519925409 | 0 | 24946 | 12217 | 0.519333251 | 0 | 24974 | 12245 | 0.518366002 | 0 |
| 24891 | 12162 | 0.520707218 | 0 | 24919 | 12190 | 0.519925409 | 0 | 24947 | 12218 | 0.51924248 | 0 | 24975 | 12246 | 0.518366002 | 0 |
| 24892 | 12163 | 0.520707218 | 0 | 24920 | 12191 | 0.519769216 | 0 | 24948 | 12219 | 0.51924248 | 0 | 24976 | 12247 | 0.518366002 | 0 |
| 24893 | 12164 | 0.520707218 | 0 | 24921 | 12192 | 0.519769216 | 0 | 24949 | 12220 | 0.51924248 | 0 | 24977 | 12248 | 0.518366002 | 0 |
| 24894 | 12165 | 0.520707218 | 0 | 24922 | 12193 | 0.519769216 | 0 | 24950 | 12221 | 0.51924248 | 0 | 24978 | 12249 | 0.518366002 | 0 |
| 24895 | 12166 | 0.520707218 | 0 | 24923 | 12194 | 0.519769216 | 0 | 24951 | 12222 | 0.51924248 | 0 | 24979 | 12250 | 0.518366002 | 0 |
| 24896 | 12167 | 0.520613326 | 0 | 24924 | 12195 | 0.519769216 | 0 | 24952 | 12223 | 0.51924248 | 0 | 24980 | 12251 | 0.518366002 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 24981 | 12252 | 0.518366002 | 0 | 25009 | 12280 | 0.517366475 | 0 | 25037 | 12308 | 0.516618336 | 0 | 25065 | 12336 | 0.515573102 | 0 |
| 24982 | 12253 | 0.518366002 | 0 | 25010 | 12281 | 0.517366475 | 0 | 25038 | 12309 | 0.516618336 | 0 | 25066 | 12337 | 0.515573102 | 0 |
| 24983 | 12254 | 0.518366002 | 0 | 25011 | 12282 | 0.517366475 | 0 | 25039 | 12310 | 0.516618336 | 0 | 25067 | 12338 | 0.515573102 | 0 |
| 24984 | 12255 | 0.518366002 | 0 | 25012 | 12283 | 0.517366475 | -0.287208966 | 25040 | 12311 | 0.516618336 | 0 | 25068 | 12339 | 0.515573102 | 0 |
| 24985 | 12256 | 0.518366002 | 0 | 25013 | 12284 | 0.517246686 | 0 | 25041 | 12312 | 0.516618336 | -0.090676547 | 25069 | 12340 | 0.515573102 | 0 |
| 24986 | 12257 | 0.518366002 | 0 | 25014 | 12285 | 0.517094275 | 0 | 25042 | 12313 | 0.516369242 | 0 | 25070 | 12341 | 0.515573102 | 0 |
| 24987 | 12258 | 0.518366002 | 0 | 25015 | 12286 | 0.517094275 | 0 | 25043 | 12314 | 0.516369242 | 0 | 25071 | 12342 | 0.515573102 | 0 |
| 24988 | 12259 | 0.518366002 | 0 | 25016 | 12287 | 0.517094275 | 0 | 25044 | 12315 | 0.516369242 | 0 | 25072 | 12343 | 0.515573102 | 0 |
| 24989 | 12260 | 0.518366002 | 0 | 25017 | 12288 | 0.517094275 | 0 | 25045 | 12316 | 0.516369242 | 0 | 25073 | 12344 | 0.515573102 | 0 |
| 24990 | 12261 | 0.517965915 | 0 | 25018 | 12289 | 0.517094275 | 0 | 25046 | 12317 | 0.516216025 | 0 | 25074 | 12345 | 0.515573102 | 0 |
| 24991 | 12262 | 0.517827509 | 0 | 25019 | 12290 | 0.517094275 | 0 | 25047 | 12318 | 0.516216025 | 0 | 25075 | 12346 | 0.515573102 | 0 |
| 24992 | 12263 | 0.517666091 | 0 | 25020 | 12291 | 0.517094275 | 0 | 25048 | 12319 | 0.516216025 | 0 | 25076 | 12347 | 0.515573102 | 0 |
| 24993 | 12264 | 0.517666091 | 0 | 25021 | 12292 | 0.516893816 | 0 | 25049 | 12320 | 0.516216025 | 0 | 25077 | 12348 | 0.515573102 | 0 |
| 24994 | 12265 | 0.517666091 | 0 | 25022 | 12293 | 0.516893816 | 0 | 25050 | 12321 | 0.516216025 | 0 | 25078 | 12349 | 0.515573102 | 0 |
| 24995 | 12266 | 0.517542695 | 0 | 25023 | 12294 | 0.516893816 | 0 | 25051 | 12322 | 0.516216025 | 0 | 25079 | 12350 | 0.515573102 | 0 |
| 24996 | 12267 | 0.517542695 | 0 | 25024 | 12295 | 0.516893816 | -0.943185935 | 25052 | 12323 | 0.516216025 | 0 | 25080 | 12351 | 0.515263885 | 0 |
| 24997 | 12268 | 0.517542695 | 0 | 25025 | 12296 | 0.516893816 | -1.42030719 | 25053 | 12324 | 0.51603734 | 0 | 25081 | 12352 | 0.51519364 | 0 |
| 24998 | 12269 | 0.517542695 | 0 | 25026 | 12297 | 0.516812174 | 0 | 25054 | 12325 | 0.51603734 | 0 | 25082 | 12353 | 0.515082096 | 0 |
| 24999 | 12270 | 0.517542695 | 0 | 25027 | 12298 | 0.516618336 | 0 | 25055 | 12326 | 0.51603734 | 0 | 25083 | 12354 | 0.515082096 | 0 |
| 25000 | 12271 | 0.517542695 | 0 | 25028 | 12299 | 0.516618336 | 0 | 25056 | 12327 | 0.51603734 | 0 | 25084 | 12355 | 0.515082096 | 0 |
| 25001 | 12272 | 0.517542695 | 0 | 25029 | 12300 | 0.516618336 | 0 | 25057 | 12328 | 0.51603734 | 0 | 25085 | 12356 | 0.515082096 | 0 |
| 25002 | 12273 | 0.517542695 | 0 | 25030 | 12301 | 0.516618336 | 0 | 25058 | 12329 | 0.515936376 | 0 | 25086 | 12357 | 0.515082096 | 0 |
| 25003 | 12274 | 0.517366475 | 0 | 25031 | 12302 | 0.516618336 | 0 | 25059 | 12330 | 0.515936376 | 0 | 25087 | 12358 | 0.515082096 | 0 |
| 25004 | 12275 | 0.517366475 | 0 | 25032 | 12303 | 0.516618336 | 0 | 25060 | 12331 | 0.515573102 | 0 | 25088 | 12359 | 0.515082096 | 0 |
| 25005 | 12276 | 0.517366475 | 0 | 25033 | 12304 | 0.516618336 | 0 | 25061 | 12332 | 0.515573102 | 0 | 25089 | 12360 | 0.514877674 | 0 |
| 25006 | 12277 | 0.517366475 | 0 | 25034 | 12305 | 0.516618336 | 0 | 25062 | 12333 | 0.515573102 | 0 | 25090 | 12361 | 0.514877674 | 0 |
| 25007 | 12278 | 0.517366475 | 0 | 25035 | 12306 | 0.516618336 | 0 | 25063 | 12334 | 0.515573102 | 0 | 25091 | 12362 | 0.514877674 | 0 |
| 25008 | 12279 | 0.517366475 | 0 | 25036 | 12307 | 0.516618336 | 0 | 25064 | 12335 | 0.515573102 | 0 | 25092 | 12363 | 0.514877674 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 25093 | 12364 | 0.514877674 | 0 | 25121 | 12392 | 0.513721097 | 0 | 25149 | 12420 | 0.51263536 | 0 | 25177 | 12448 | 0.511417142 | 0 |
| 25094 | 12365 | 0.514877674 | 0 | 25122 | 12393 | 0.513721097 | -0.320817567 | 25150 | 12421 | 0.51263536 | 0 | 25178 | 12449 | 0.511417142 | 0 |
| 25095 | 12366 | 0.514877674 | 0 | 25123 | 12394 | 0.513490151 | 0 | 25151 | 12422 | 0.51263536 | 0 | 25179 | 12450 | 0.511417142 | 0 |
| 25096 | 12367 | 0.514877674 | -1.523780972 | 25124 | 12395 | 0.513490151 | 0 | 25152 | 12423 | 0.51263536 | 0 | 25180 | 12451 | 0.511417142 | 0 |
| 25097 | 12368 | 0.514765613 | 0 | 25125 | 12396 | 0.513490151 | 0 | 25153 | 12424 | 0.51263536 | 0 | 25181 | 12452 | 0.511417142 | 0 |
| 25098 | 12369 | 0.514694852 | 0 | 25126 | 12397 | 0.513490151 | 0 | 25154 | 12425 | 0.51263536 | 0 | 25182 | 12453 | 0.511417142 | 0 |
| 25099 | 12370 | 0.514694852 | 0 | 25127 | 12398 | 0.513490151 | 0 | 25155 | 12426 | 0.51263536 | 0 | 25183 | 12454 | 0.511417142 | 0 |
| 25100 | 12371 | 0.514694852 | 0 | 25128 | 12399 | 0.513301286 | 0 | 25156 | 12427 | 0.512506966 | 0 | 25184 | 12455 | 0.511417142 | 0 |
| 25101 | 12372 | 0.514694852 | -1.121476158 | 25129 | 12400 | 0.513301286 | 0 | 25157 | 12428 | 0.512506966 | 0 | 25185 | 12456 | 0.511417142 | 0 |
| 25102 | 12373 | 0.514610498 | 0 | 25130 | 12401 | 0.513301286 | 0 | 25158 | 12429 | 0.512506966 | 0 | 25186 | 12457 | 0.511417142 | 0 |
| 25103 | 12374 | 0.514381621 | 0 | 25131 | 12402 | 0.513301286 | 0 | 25159 | 12430 | 0.512506966 | 0 | 25187 | 12458 | 0.511417142 | 0 |
| 25104 | 12375 | 0.514381621 | 0 | 25132 | 12403 | 0.513301286 | 0 | 25160 | 12431 | 0.512506966 | 0 | 25188 | 12459 | 0.511417142 | 0 |
| 25105 | 12376 | 0.514381621 | 0 | 25133 | 12404 | 0.513301286 | 0 | 25161 | 12432 | 0.512403055 | 0 | 25189 | 12460 | 0.511417142 | 0 |
| 25106 | 12377 | 0.514381621 | 0 | 25134 | 12405 | 0.513301286 | 0 | 25162 | 12433 | 0.512403055 | 0 | 25190 | 12461 | 0.511417142 | 0 |
| 25107 | 12378 | 0.514381621 | 0 | 25135 | 12406 | 0.513143961 | 0 | 25163 | 12434 | 0.512317235 | 0 | 25191 | 12462 | 0.511417142 | 0 |
| 25108 | 12379 | 0.514381621 | 0 | 25136 | 12407 | 0.513010885 | 0 | 25164 | 12435 | 0.512245158 | 0 | 25192 | 12463 | 0.511417142 | 0 |
| 25109 | 12380 | 0.514381621 | -0.086073837 | 25137 | 12408 | 0.513010885 | 0 | 25165 | 12436 | 0.512245158 | 0 | 25193 | 12464 | 0.511417142 | 0 |
| 25110 | 12381 | 0.514381621 | -0.187531478 | 25138 | 12409 | 0.513010885 | 0 | 25166 | 12437 | 0.512245158 | 0 | 25194 | 12465 | 0.511417142 | 0 |
| 25111 | 12382 | 0.514123035 | -1.506052205 | 25139 | 12410 | 0.513010885 | 0 | 25167 | 12438 | 0.512245158 | 0 | 25195 | 12466 | 0.511417142 | 0 |
| 25112 | 12383 | 0.514009953 | 0 | 25140 | 12411 | 0.512798048 | 0 | 25168 | 12439 | 0.512130855 | 0 | 25196 | 12467 | 0.511417142 | 0 |
| 25113 | 12384 | 0.514009953 | 0 | 25141 | 12412 | 0.512798048 | 0 | 25169 | 12440 | 0.512044282 | -0.761827075 | 25197 | 12468 | 0.511417142 | 0 |
| 25114 | 12385 | 0.514009953 | 0 | 25142 | 12413 | 0.512798048 | 0 | 25170 | 12441 | 0.511417142 | 0 | 25198 | 12469 | 0.511417142 | 0 |
| 25115 | 12386 | 0.514009953 | 0 | 25143 | 12414 | 0.512798048 | 0 | 25171 | 12442 | 0.511417142 | 0 | 25199 | 12470 | 0.511417142 | 0 |
| 25116 | 12387 | 0.514009953 | 0 | 25144 | 12415 | 0.512798048 | 0 | 25172 | 12443 | 0.511417142 | 0 | 25200 | 12471 | 0.511417142 | 0 |
| 25117 | 12388 | 0.514009953 | 0 | 25145 | 12416 | 0.512798048 | 0 | 25173 | 12444 | 0.511417142 | 0 | 25201 | 12472 | 0.511417142 | 0 |
| 25118 | 12389 | 0.513721097 | 0 | 25146 | 12417 | 0.512798048 | -0.042987015 | 25174 | 12445 | 0.511417142 | 0 | 25202 | 12473 | 0.511417142 | 0 |
| 25119 | 12390 | 0.513721097 | 0 | 25147 | 12418 | 0.51263536 | 0 | 25175 | 12446 | 0.511417142 | 0 | 25203 | 12474 | 0.511417142 | 0 |
| 25120 | 12391 | 0.513721097 | 0 | 25148 | 12419 | 0.51263536 | 0 | 25176 | 12447 | 0.511417142 | 0 | 25204 | 12475 | 0.511417142 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 25205 | 12476 | 0.511417142 | 0 | 25233 | 12504 | 0.510040613 | 0 | 25261 | 12532 | 0.509125345 | 0 | 25289 | 12560 | 0.508472761 | 0 |
| 25206 | 12477 | 0.511417142 | 0 | 25234 | 12505 | 0.510040613 | -1.324498051 | 25262 | 12533 | 0.509125345 | 0 | 25290 | 12561 | 0.508472761 | 0 |
| 25207 | 12478 | 0.511417142 | 0 | 25235 | 12506 | 0.509942456 | 0 | 25263 | 12534 | 0.509125345 | 0 | 25291 | 12562 | 0.508472761 | 0 |
| 25208 | 12479 | 0.511417142 | 0 | 25236 | 12507 | 0.509829226 | 0 | 25264 | 12535 | 0.509125345 | 0 | 25292 | 12563 | 0.508472761 | 0 |
| 25209 | 12480 | 0.511417142 | 0 | 25237 | 12508 | 0.509829226 | 0 | 25265 | 12536 | 0.509125345 | 0 | 25293 | 12564 | 0.508472761 | 0 |
| 25210 | 12481 | 0.511417142 | 0 | 25238 | 12509 | 0.509829226 | 0 | 25266 | 12537 | 0.509125345 | 0 | 25294 | 12565 | 0.508472761 | 0 |
| 25211 | 12482 | 0.511417142 | 0 | 25239 | 12510 | 0.509829226 | 0 | 25267 | 12538 | 0.509125345 | 0 | 25295 | 12566 | 0.508472761 | 0 |
| 25212 | 12483 | 0.511417142 | -0.448060258 | 25240 | 12511 | 0.509829226 | 0 | 25268 | 12539 | 0.509125345 | 0 | 25296 | 12567 | 0.508163985 | 0 |
| 25213 | 12484 | 0.511417142 | -1.05012025 | 25241 | 12512 | 0.509829226 | 0 | 25269 | 12540 | 0.509125345 | 0 | 25297 | 12568 | 0.508163985 | 0 |
| 25214 | 12485 | 0.511417142 | -1.101272772 | 25242 | 12513 | 0.509829226 | 0 | 25270 | 12541 | 0.509125345 | 0 | 25298 | 12569 | 0.508163985 | 0 |
| 25215 | 12486 | 0.510590701 | -1.545796712 | 25243 | 12514 | 0.509829226 | 0 | 25271 | 12542 | 0.509125345 | 0 | 25299 | 12570 | 0.508163985 | 0 |
| 25216 | 12487 | 0.510433462 | 0 | 25244 | 12515 | 0.509829226 | 0 | 25272 | 12543 | 0.509125345 | 0 | 25300 | 12571 | 0.508163985 | 0 |
| 25217 | 12488 | 0.510330046 | 0 | 25245 | 12516 | 0.509829226 | 0 | 25273 | 12544 | 0.508942523 | 0 | 25301 | 12572 | 0.508163985 | 0 |
| 25218 | 12489 | 0.510330046 | 0 | 25246 | 12517 | 0.509829226 | 0 | 25274 | 12545 | 0.508942523 | 0 | 25302 | 12573 | 0.508163985 | 0 |
| 25219 | 12490 | 0.510330046 | 0 | 25247 | 12518 | 0.509829226 | 0 | 25275 | 12546 | 0.508942523 | 0 | 25303 | 12574 | 0.508163985 | 0 |
| 25220 | 12491 | 0.510202332 | 0 | 25248 | 12519 | 0.509829226 | -1.563591526 | 25276 | 12547 | 0.508839719 | 0 | 25304 | 12575 | 0.507983966 | 0 |
| 25221 | 12492 | 0.510202332 | 0 | 25249 | 12520 | 0.509697162 | 0 | 25277 | 12548 | 0.508839719 | 0 | 25305 | 12576 | 0.507983966 | 0 |
| 25222 | 12493 | 0.510202332 | 0 | 25250 | 12521 | 0.509697162 | 0 | 25278 | 12549 | 0.508839719 | 0 | 25306 | 12577 | 0.507983966 | 0 |
| 25223 | 12494 | 0.510202332 | 0 | 25251 | 12522 | 0.509541137 | 0 | 25279 | 12550 | 0.508839719 | 0 | 25307 | 12578 | 0.507983966 | 0 |
| 25224 | 12495 | 0.510202332 | -0.424451485 | 25252 | 12523 | 0.509541137 | 0 | 25280 | 12551 | 0.508839719 | 0 | 25308 | 12579 | 0.507983966 | 0 |
| 25225 | 12496 | 0.510040613 | 0 | 25253 | 12524 | 0.509541137 | 0 | 25281 | 12552 | 0.508839719 | 0 | 25309 | 12580 | 0.507983966 | 0 |
| 25226 | 12497 | 0.510040613 | 0 | 25254 | 12525 | 0.509541137 | 0 | 25282 | 12553 | 0.508839719 | 0 | 25310 | 12581 | 0.507983966 | 0 |
| 25227 | 12498 | 0.510040613 | 0 | 25255 | 12526 | 0.509541137 | 0 | 25283 | 12554 | 0.508839719 | 0 | 25311 | 12582 | 0.507983966 | 0 |
| 25228 | 12499 | 0.510040613 | 0 | 25256 | 12527 | 0.509353981 | 0 | 25284 | 12555 | 0.508839719 | 0 | 25312 | 12583 | 0.507866064 | 0 |
| 25229 | 12500 | 0.510040613 | 0 | 25257 | 12528 | 0.509353981 | 0 | 25285 | 12556 | 0.508839719 | 0 | 25313 | 12584 | 0.507866064 | -0.121617645 |
| 25230 | 12501 | 0.510040613 | 0 | 25258 | 12529 | 0.509353981 | 0 | 25286 | 12557 | 0.508839719 | 0 | 25314 | 12585 | 0.507782857 | 0 |
| 25231 | 12502 | 0.510040613 | 0 | 25259 | 12530 | 0.509125345 | 0 | 25287 | 12558 | 0.508839719 | -0.575576418 | 25315 | 12586 | 0.507782857 | 0 |
| 25232 | 12503 | 0.510040613 | 0 | 25260 | 12531 | 0.509125345 | 0 | 25288 | 12559 | 0.508728004 | -1.511447237 | 25316 | 12587 | 0.507782857 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 25317 | 12588 | 0.507782857 | 0 | 25345 | 12616 | 0.506845579 | 0 | 25373 | 12644 | 0.505548208 | 0 | 25401 | 12672 | 0.504577718 | 0 |
| 25318 | 12589 | 0.507782857 | 0 | 25346 | 12617 | 0.506845579 | 0 | 25374 | 12645 | 0.505548208 | 0 | 25402 | 12673 | 0.504577718 | 0 |
| 25319 | 12590 | 0.507782857 | 0 | 25347 | 12618 | 0.506845579 | -1.406874331 | 25375 | 12646 | 0.505548208 | 0 | 25403 | 12674 | 0.504577718 | 0 |
| 25320 | 12591 | 0.507782857 | 0 | 25348 | 12619 | 0.506670707 | 0 | 25376 | 12647 | 0.505548208 | 0 | 25404 | 12675 | 0.504577718 | 0 |
| 25321 | 12592 | 0.507782857 | 0 | 25349 | 12620 | 0.506670707 | 0 | 25377 | 12648 | 0.505548208 | 0 | 25405 | 12676 | 0.504577718 | 0 |
| 25322 | 12593 | 0.507300576 | 0 | 25350 | 12621 | 0.506670707 | 0 | 25378 | 12649 | 0.505548208 | 0 | 25406 | 12677 | 0.504577718 | 0 |
| 25323 | 12594 | 0.507300576 | 0 | 25351 | 12622 | 0.506670707 | 0 | 25379 | 12650 | 0.505548208 | 0 | 25407 | 12678 | 0.504577718 | 0 |
| 25324 | 12595 | 0.507300576 | 0 | 25352 | 12623 | 0.506670707 | 0 | 25380 | 12651 | 0.505548208 | 0 | 25408 | 12679 | 0.504577718 | 0 |
| 25325 | 12596 | 0.507300576 | 0 | 25353 | 12624 | 0.506670707 | 0 | 25381 | 12652 | 0.505548208 | 0 | 25409 | 12680 | 0.504577718 | 0 |
| 25326 | 12597 | 0.507300576 | 0 | 25354 | 12625 | 0.506670707 | 0 | 25382 | 12653 | 0.505548208 | 0 | 25410 | 12681 | 0.504577718 | 0 |
| 25327 | 12598 | 0.507300576 | 0 | 25355 | 12626 | 0.506670707 | -1.26572005 | 25383 | 12654 | 0.505548208 | -1.299027232 | 25411 | 12682 | 0.504577718 | 0 |
| 25328 | 12599 | 0.507300576 | 0 | 25356 | 12627 | 0.506520873 | 0 | 25384 | 12655 | 0.505376788 | 0 | 25412 | 12683 | 0.504577718 | 0 |
| 25329 | 12600 | 0.507300576 | 0 | 25357 | 12628 | 0.506520873 | 0 | 25385 | 12656 | 0.505376788 | 0 | 25413 | 12684 | 0.504577718 | 0 |
| 25330 | 12601 | 0.507300576 | 0 | 25358 | 12629 | 0.506520873 | -1.474145827 | 25386 | 12657 | 0.505376788 | 0 | 25414 | 12685 | 0.504577718 | 0 |
| 25331 | 12602 | 0.507300576 | 0 | 25359 | 12630 | 0.506453723 | -0.660149171 | 25387 | 12658 | 0.505376788 | 0 | 25415 | 12686 | 0.504577718 | 0 |
| 25332 | 12603 | 0.507300576 | 0 | 25360 | 12631 | 0.506277502 | 0 | 25388 | 12659 | 0.505256833 | 0 | 25416 | 12687 | 0.504577718 | 0 |
| 25333 | 12604 | 0.507300576 | 0 | 25361 | 12632 | 0.506277502 | 0 | 25389 | 12660 | 0.505256833 | 0 | 25417 | 12688 | 0.504577718 | -0.288568261 |
| 25334 | 12605 | 0.507300576 | 0 | 25362 | 12633 | 0.506277502 | 0 | 25390 | 12661 | 0.505168193 | 0 | 25418 | 12689 | 0.504577718 | -0.434696297 |
| 25335 | 12606 | 0.507300576 | 0 | 25363 | 12634 | 0.506277502 | 0 | 25391 | 12662 | 0.505168193 | 0 | 25419 | 12690 | 0.504577718 | -0.454899683 |
| 25336 | 12607 | 0.507300576 | 0 | 25364 | 12635 | 0.506088309 | 0 | 25392 | 12663 | 0.504965654 | 0 | 25420 | 12691 | 0.504577718 | -0.755929679 |
| 25337 | 12608 | 0.507300576 | 0 | 25365 | 12636 | 0.506008673 | 0 | 25393 | 12664 | 0.504577718 | 0 | 25421 | 12692 | 0.504577718 | -0.755929679 |
| 25338 | 12609 | 0.507300576 | 0 | 25366 | 12637 | 0.506008673 | 0 | 25394 | 12665 | 0.504577718 | 0 | 25422 | 12693 | 0.504577718 | -0.932020938 |
| 25339 | 12610 | 0.507300576 | -0.482140048 | 25367 | 12638 | 0.505813265 | 0 | 25395 | 12666 | 0.504577718 | 0 | 25423 | 12694 | 0.504577718 | -1.233050933 |
| 25340 | 12611 | 0.506944451 | 0 | 25368 | 12639 | 0.505813265 | 0 | 25396 | 12667 | 0.504577718 | 0 | 25424 | 12695 | 0.504577718 | -1.409142192 |
| 25341 | 12612 | 0.506845579 | 0 | 25369 | 12640 | 0.505813265 | 0 | 25397 | 12668 | 0.504577718 | 0 | 25425 | 12696 | 0.504140141 | 0 |
| 25342 | 12613 | 0.506845579 | 0 | 25370 | 12641 | 0.505813265 | -1.495056821 | 25398 | 12669 | 0.504577718 | 0 | 25426 | 12697 | 0.504093284 | 0 |
| 25343 | 12614 | 0.506845579 | 0 | 25371 | 12642 | 0.505664813 | 0 | 25399 | 12670 | 0.504577718 | 0 | 25427 | 12698 | 0.504035188 | 0 |
| 25344 | 12615 | 0.506845579 | 0 | 25372 | 12643 | 0.505664813 | 0 | 25400 | 12671 | 0.504577718 | 0 | 25428 | 12699 | 0.50396126 | 0 |

FIG. 3 (Cont.)

| DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver | DNA SEQ ID NO | AA SEQ ID NO | Log 10 enrichment in the brain | Log 10 enrichment in the liver |
|---|---|---|---|---|---|---|---|---|---|---|---|---|---|---|---|
| 25429 | 12700 | 0.50396126 | 0 | 25440 | 12711 | 0.503730313 | 0 | 25451 | 12722 | 0.503534993 | 0 | 25462 | 12733 | 0.503534993 | -0.56988576 |
| 25430 | 12701 | 0.50396126 | 0 | 25441 | 12712 | 0.503730313 | 0 | 25452 | 12723 | 0.503534993 | 0 | 25463 | 12734 | 0.50339917 | 0 |
| 25431 | 12702 | 0.503864004 | 0 | 25442 | 12713 | 0.503730313 | 0 | 25453 | 12724 | 0.503534993 | 0 | 25464 | 12735 | 0.50339917 | 0 |
| 25432 | 12703 | 0.503864004 | 0 | 25443 | 12714 | 0.503730313 | 0 | 25454 | 12725 | 0.503534993 | 0 | 25465 | 12736 | 0.503222663 | 0 |
| 25433 | 12704 | 0.503864004 | 0 | 25444 | 12715 | 0.503730313 | 0 | 25455 | 12726 | 0.503534993 | 0 | 25466 | 12737 | 0.503222663 | 0 |
| 25434 | 12705 | 0.503864004 | 0 | 25445 | 12716 | 0.503730313 | 0 | 25456 | 12727 | 0.503534993 | 0 | 25467 | 12738 | 0.503222663 | 0 |
| 25435 | 12706 | 0.503864004 | 0 | 25446 | 12717 | 0.503730313 | 0 | 25457 | 12728 | 0.503534993 | 0 | 25468 | 12739 | 0.503222663 | 0 |
| 25436 | 12707 | 0.503864004 | 0 | 25447 | 12718 | 0.503730313 | 0 | 25458 | 12729 | 0.503534993 | 0 | | | | |
| 25437 | 12708 | 0.503864004 | 0 | 25448 | 12719 | 0.503730313 | 0 | 25459 | 12730 | 0.503534993 | 0 | | | | |
| 25438 | 12709 | 0.503864004 | 0 | 25449 | 12720 | 0.503534993 | 0 | 25460 | 12731 | 0.503534993 | 0 | | | | |
| 25439 | 12710 | 0.503864004 | 0 | 25450 | 12721 | 0.503534993 | 0 | 25461 | 12732 | 0.503534993 | 0 | | | | |

FIG. 4

| DNA SEQ ID NO | AA SEQ ID NO | Heart 1 Enrichment Score | Heart 2 Enrichment Score |
|---|---|---|---|
| 35472 | 25469 | 30.1804878 | 17.14982578 |
| 35473 | 25470 | 29.7247619 | 21.78741497 |
| 35474 | 25471 | 27.76 | 57.42857143 |
| 35475 | 25472 | 10.8 | 14.9047619 |
| 35476 | 25473 | 10.672 | 3.285714286 |
| 35477 | 25474 | 9.483076923 | 8.593406593 |
| 35478 | 25475 | 6.111428571 | 3.87244898 |
| 35479 | 25476 | 5.141176471 | 7.634453782 |
| 35480 | 25477 | 4.876 | 4.6 |
| 35481 | 25478 | 4.822068966 | 11.66995074 |
| 35482 | 25479 | 4.6 | 12.73214286 |
| 35483 | 25480 | 4.545882353 | 2.899159664 |
| 35484 | 25481 | 4.416 | 3.395238095 |
| 35485 | 25482 | 3.956 | 3.121428571 |
| 35486 | 25483 | 3.956 | 6.078571429 |
| 35487 | 25484 | 3.873684211 | 22.04887218 |
| 35488 | 25485 | 3.793230769 | 1.718681319 |
| 35489 | 25486 | 3.7536 | 1.577142857 |
| 35490 | 25487 | 3.68 | 1.334821429 |
| 35491 | 25488 | 3.68 | 2.738095238 |
| 35492 | 25489 | 3.571764706 | 6.764705882 |
| 35493 | 25490 | 3.538461538 | 3.95970696 |
| 35494 | 25491 | 3.504761905 | 5.163265306 |
| 35495 | 25492 | 3.475555556 | 1.022222222 |
| 35496 | 25493 | 3.445818182 | 1.254545455 |
| 35497 | 25494 | 3.434666667 | 1.679365079 |
| 35498 | 25495 | 3.434666667 | 4.307936508 |
| 35499 | 25496 | 3.423255814 | 4.661129568 |
| 35500 | 25497 | 3.417142857 | 2.863265306 |
| 35501 | 25498 | 3.3856 | 1.84 |
| 35502 | 25499 | 3.351428571 | 1.877755102 |
| 35503 | 25500 | 3.345454545 | 1.891774892 |
| 35504 | 25501 | 3.30031746 | 1.408163265 |
| 35505 | 25502 | 3.285714286 | 4.459183673 |
| 35506 | 25503 | 3.131914894 | 2.446808511 |
| 35507 | 25504 | 3.094545455 | 3.061688312 |
| 35508 | 25505 | 3.084705882 | 4.783613445 |
| 35509 | 25506 | 3.084705882 | 1.546218487 |
| 35510 | 25507 | 3.066666667 | 5.202380952 |
| 35511 | 25508 | 3.066666667 | 4.459183673 |
| 35512 | 25509 | 3.05509434 | 3.161725067 |
| 35513 | 25510 | 3.05509434 | 3.037735849 |
| 35514 | 25511 | 3.050526316 | 2.939849624 |
| 35515 | 25512 | 3.043076923 | 4.233516484 |
| 35516 | 25513 | 3.041632653 | 1.206997085 |
| 35517 | 25514 | 3.04 | 8.428571429 |
| 35518 | 25515 | 3.014468085 | 3.844984802 |
| 35519 | 25516 | 2.967741935 | 6.253456221 |
| 35520 | 25517 | 2.96 | 1.571428571 |
| 35521 | 25518 | 2.944 | 3.285714286 |
| 35522 | 25519 | 2.944 | 3.203571429 |
| 35523 | 25520 | 2.944 | 2.065306122 |
| 35524 | 25521 | 2.935238095 | 1.017006803 |
| 35525 | 25522 | 2.922352941 | 3.865546218 |
| 35526 | 25523 | 2.891428571 | 4.693877551 |
| 35527 | 25524 | 2.875 | 2.19047619 |
| 35528 | 25525 | 2.869152542 | 1.169491525 |
| 35529 | 25526 | 2.866153846 | 3.159340659 |
| 35530 | 25527 | 2.855172414 | 1.869458128 |
| 35531 | 25528 | 2.849032258 | 3.444700461 |
| 35532 | 25529 | 2.843636364 | 25.38961039 |
| 35533 | 25530 | 2.830769231 | 2.274725275 |
| 35534 | 25531 | 2.824186047 | 1.681063123 |
| 35535 | 25532 | 2.785555556 | 1.916666667 |
| 35536 | 25533 | 2.76 | 3.584415584 |
| 35537 | 25534 | 2.76 | 7.392857143 |
| 35538 | 25535 | 2.739555556 | 1.168253968 |
| 35539 | 25536 | 2.721666667 | 1.505952381 |
| 35540 | 25537 | 2.72 | 3.357142857 |
| 35541 | 25538 | 2.711578947 | 1.729323308 |
| 35542 | 25539 | 2.705882353 | 1.030812325 |
| 35543 | 25540 | 2.694285714 | 3.403061224 |
| 35544 | 25541 | 2.689230769 | 1.326923077 |
| 35545 | 25542 | 2.679298246 | 3.862155388 |
| 35546 | 25543 | 2.678481013 | 3.660036166 |
| 35547 | 25544 | 2.669803922 | 5.025210084 |
| 35548 | 25545 | 2.690110989 | 4.224489796 |
| 35549 | 25546 | 2.668 | 3.367857143 |
| 35550 | 25547 | 2.664827586 | 5.778325123 |
| 35551 | 25548 | 2.657777778 | 1.277777778 |
| 35552 | 25549 | 2.64 | 4 |
| 35553 | 25550 | 2.635675676 | 3.996138996 |
| 35554 | 25551 | 2.622 | 5.503571429 |
| 35555 | 25552 | 2.597647059 | 11.69327731 |
| 35556 | 25553 | 2.597647059 | 2.899159664 |
| 35557 | 25554 | 2.576 | 5.421428571 |
| 35558 | 25555 | 2.576 | 6.9 |
| 35559 | 25556 | 2.576 | 2.19047619 |
| 35560 | 25557 | 2.576 | 2.19047619 |
| 35561 | 25558 | 2.562857143 | 1.408163265 |
| 35562 | 25559 | 2.560559441 | 1.309690031 |
| 35563 | 25560 | 2.540952381 | 3.129251701 |
| 35564 | 25561 | 2.536969697 | 3.285714286 |
| 35565 | 25562 | 2.526101695 | 1.336561743 |
| 35566 | 25563 | 2.512307692 | 1.516483516 |
| 35567 | 25564 | 2.494915254 | 1.113801453 |
| 35568 | 25565 | 2.491076923 | 3.032967033 |
| 35569 | 25566 | 2.453333333 | 2.875 |
| 35570 | 25567 | 2.453333333 | 3.285714286 |
| 35571 | 25568 | 2.453333333 | 3.13968254 |
| 35572 | 25569 | 2.453333333 | 2.19047619 |
| 35573 | 25570 | 2.445263158 | 1.340225564 |
| 35574 | 25571 | 2.440816327 | 3.55393586 |
| 35575 | 25572 | 2.427234043 | 2.376899696 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 35576 | 25573 | 2.427234043 | 2.446808511 | 35604 | 25601 | 2.24 | 4.952380952 | 35632 | 25629 | 2.102857143 | 3.207482993 | 35660 | 25657 | 2.009846154 | 1.162637363 |
| 35577 | 25574 | 2.421052632 | 1.210526316 | 35605 | 25602 | 2.231 | 4.928571429 | 35633 | 25630 | 2.102857143 | 4.506122449 | 35661 | 25658 | 2.003960396 | 1.659123055 |
| 35578 | 25575 | 2.406153846 | 3.159340659 | 35606 | 25603 | 2.229230769 | 3.791208791 | 35634 | 25631 | 2.102857143 | 8.448979592 | 35662 | 25659 | 1.988387097 | 3.656682028 |
| 35579 | 25576 | 2.392 | 4.107142857 | 35607 | 25604 | 2.227368421 | 3.977443609 | 35635 | 25632 | 2.102857143 | 3.473469388 | 35663 | 25660 | 1.967524752 | 1.106082037 |
| 35580 | 25577 | 2.381176471 | 2.06162465 | 35608 | 25605 | 2.227368421 | 1.210526316 | 35636 | 25633 | 2.098245614 | 5.015037594 | 35664 | 25661 | 1.955 | 6.058035714 |
| 35581 | 25578 | 2.377846154 | 4.650549451 | 35609 | 25606 | 2.223333333 | 1.642857143 | 35637 | 25634 | 2.096744186 | 1.833887043 | 35665 | 25662 | 1.951515152 | 1.360750361 |
| 35582 | 25579 | 2.376666667 | 3.285714286 | 35610 | 25607 | 2.208 | 3.942857143 | 35638 | 25635 | 2.096744186 | 1.400885936 | 35666 | 25663 | 1.948235294 | 3.18907563 |
| 35583 | 25580 | 2.374193548 | 3.126728111 | 35611 | 25608 | 2.208 | 4.130612245 | 35639 | 25636 | 2.093793103 | 1.302955665 | 35667 | 25664 | 1.945142857 | 5.444897959 |
| 35584 | 25581 | 2.372631579 | 2.421052632 | 35612 | 25609 | 2.197777778 | 3.468253968 | 35640 | 25637 | 2.089491525 | 2.840193705 | 35668 | 25665 | 1.942222222 | 1.533333333 |
| 35585 | 25582 | 2.372631579 | 2.161654135 | 35613 | 25610 | 2.194698795 | 1.108433735 | 35641 | 25638 | 2.080952381 | 1.603741497 | 35669 | 25666 | 1.936842105 | 2.507518797 |
| 35586 | 25583 | 2.365714286 | 5.444897959 | 35614 | 25611 | 2.180740741 | 3.042328042 | 35642 | 25639 | 2.074181818 | 4.898701299 | 35670 | 25667 | 1.934358974 | 1.347985348 |
| 35587 | 25584 | 2.365714286 | 5.867346939 | 35615 | 25612 | 2.180740741 | 1.46031746 | 35643 | 25640 | 2.072911392 | 1.788426763 | 35671 | 25668 | 1.930491803 | 1.238875878 |
| 35588 | 25585 | 2.3575 | 3.799107143 | 35616 | 25613 | 2.174545455 | 1.672727273 | 35644 | 25641 | 2.07 | 5.75 | 35672 | 25669 | 1.921777778 | 1.606349206 |
| 35589 | 25586 | 2.353488372 | 1.146179402 | 35617 | 25614 | 2.174545455 | 9.409090909 | 35645 | 25642 | 2.067809524 | 4.412244898 | 35673 | 25670 | 1.9136 | 1.927619048 |
| 35590 | 25587 | 2.345098039 | 1.095238095 | 35618 | 25615 | 2.169552239 | 1.275053305 | 35646 | 25643 | 2.065306122 | 3.956268222 | 35674 | 25671 | 1.912631579 | 3.328947368 |
| 35591 | 25588 | 2.335384615 | 1.432234432 | 35619 | 25616 | 2.162 | 1.560714286 | 35647 | 25644 | 2.062068966 | 3.115763547 | 35675 | 25672 | 1.910769231 | 2.337912088 |
| 35592 | 25589 | 2.330666667 | 2.19047619 | 35620 | 25617 | 2.16 | 2 | 35648 | 25645 | 2.059701493 | 1.275053305 | 35676 | 25673 | 1.908148148 | 2.85978836 |
| 35593 | 25590 | 2.306133333 | 2.891428571 | 35621 | 25618 | 2.151384615 | 7.683516484 | 35649 | 25646 | 2.056470588 | 2.512605042 | 35677 | 25674 | 1.904561404 | 3.343358396 |
| 35594 | 25591 | 2.3 | 1.93622449 | 35622 | 25619 | 2.146666667 | 1.861904762 | 35650 | 25647 | 2.056470588 | 1.546218487 | 35678 | 25675 | 1.898412698 | 1.98185941 |
| 35595 | 25592 | 2.2816 | 2.497142857 | 35623 | 25620 | 2.146666667 | 2.628571429 | 35651 | 25648 | 2.053052632 | 2.006015038 | 35679 | 25676 | 1.892571429 | 1.689795918 |
| 35596 | 25593 | 2.28056338 | 1.342052314 | 35624 | 25621 | 2.139534884 | 1.833887043 | 35652 | 25649 | 2.044444444 | 3.285714286 | 35680 | 25677 | 1.888421053 | 4.107142857 |
| 35597 | 25594 | 2.274909091 | 1.135064935 | 35625 | 25622 | 2.137647059 | 1.691176471 | 35653 | 25650 | 2.044444444 | 4.137566138 | 35681 | 25678 | 1.887179487 | 4.886446886 |
| 35598 | 25595 | 2.269333333 | 2.40952381 | 35626 | 25623 | 2.136774194 | 2.755760369 | 35654 | 25651 | 2.037142857 | 1.87755102 | 35682 | 25679 | 1.886 | 1.013095238 |
| 35599 | 25596 | 2.268737864 | 1.882108183 | 35627 | 25624 | 2.130526316 | 3.285714286 | 35655 | 25652 | 2.033684211 | 1.268170426 | 35683 | 25680 | 1.884878049 | 4.24738676 |
| 35600 | 25597 | 2.252413793 | 1.07635468 | 35628 | 25625 | 2.130526316 | 2.593984962 | 35656 | 25653 | 2.033684211 | 1.556390977 | 35684 | 25681 | 1.881818182 | 1.642857143 |
| 35601 | 25598 | 2.251940299 | 1.176972281 | 35629 | 25626 | 2.123076923 | 1.074175824 | 35657 | 25654 | 2.024 | 7.721428571 | 35685 | 25682 | 1.88 | 1.928571429 |
| 35602 | 25599 | 2.248888889 | 1.277777778 | 35630 | 25627 | 2.118787879 | 1.692640693 | 35658 | 25655 | 2.020983607 | 2.585480094 | 35686 | 25683 | 1.874716981 | 3.781671159 |
| 35603 | 25600 | 2.248888889 | 2.920634921 | 35631 | 25628 | 2.116 | 2.053571429 | 35659 | 25656 | 2.019512195 | 1.682926829 | 35687 | 25684 | 1.874074074 | 2.646825397 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 35688 | 25685 | 1.861647059 | 1.58487395 | 35716 | 25713 | 1.736338028 | 2.822937626 | 35744 | 25741 | 1.666415094 | 1.859838275 | 35772 | 25769 | 1.623529412 | 4.058823529 |
| 35689 | 25686 | 1.84 | 1.449579832 | 35717 | 25714 | 1.734857143 | 1.971428571 | 35745 | 25742 | 1.664761905 | 6.727891156 | 35773 | 25770 | 1.623529412 | 4.831932773 |
| 35690 | 25687 | 1.84 | 1.115902965 | 35718 | 25715 | 1.734857143 | 1.595918367 | 35746 | 25743 | 1.660487805 | 2.591173055 | 35774 | 25771 | 1.620952381 | 6.102040816 |
| 35691 | 25688 | 1.84 | 2.324041812 | 35719 | 25716 | 1.734857143 | 2.534693878 | 35747 | 25744 | 1.656 | 1.38 | 35775 | 25772 | 1.616969697 | 6.272727273 |
| 35692 | 25689 | 1.84 | 1.25170068 | 35720 | 25717 | 1.731764706 | 9.277310924 | 35748 | 25745 | 1.656 | 1.204761905 | 35776 | 25773 | 1.614693878 | 2.413994169 |
| 35693 | 25690 | 1.84 | 2.503401361 | 35721 | 25718 | 1.728484848 | 4.779220779 | 35749 | 25746 | 1.656 | 1.642857143 | 35777 | 25774 | 1.614693878 | 1.542274052 |
| 35694 | 25691 | 1.84 | 2.527472527 | 35722 | 25719 | 1.728484848 | 1.692640693 | 35750 | 25747 | 1.656 | 1.807142857 | 35778 | 25775 | 1.614693878 | 4.626822157 |
| 35695 | 25692 | 1.84 | 1.216931217 | 35723 | 25720 | 1.721290323 | 2.437788018 | 35751 | 25748 | 1.656 | 3.203571429 | 35779 | 25776 | 1.601882353 | 1.005042017 |
| 35696 | 25693 | 1.84 | 1.971428571 | 35724 | 25721 | 1.72 | 1.142857143 | 35752 | 25749 | 1.656 | 2.628571429 | 35780 | 25777 | 1.6 | 4.571428571 |
| 35697 | 25694 | 1.815789474 | 1.815789474 | 35725 | 25722 | 1.717333333 | 1.226666667 | 35753 | 25750 | 1.652244898 | 2.145772595 | 35781 | 25778 | 1.598688525 | 2.962529274 |
| 35698 | 25695 | 1.815466667 | 2.497142857 | 35726 | 25723 | 1.717333333 | 1.401904762 | 35754 | 25751 | 1.645384615 | 1.200549451 | 35782 | 25779 | 1.596144578 | 3.008605852 |
| 35699 | 25696 | 1.812121212 | 1.045454545 | 35727 | 25724 | 1.713103448 | 5.21182266 | 35755 | 25752 | 1.642857143 | 8.331632653 | 35783 | 25780 | 1.591351351 | 3.196911197 |
| 35700 | 25697 | 1.806545455 | 2.24025974 | 35728 | 25725 | 1.708571429 | 4.869897959 | 35756 | 25753 | 1.641846154 | 1.567032967 | 35784 | 25781 | 1.590508475 | 1.169491525 |
| 35701 | 25698 | 1.801666667 | 3.62797619 | 35729 | 25726 | 1.708571429 | 1.25170068 | 35757 | 25754 | 1.64 | 2 | 35785 | 25782 | 1.58976 | 1.182857143 |
| 35702 | 25699 | 1.792 | 1.142857143 | 35730 | 25727 | 1.708571429 | 2.229591837 | 35758 | 25755 | 1.635555556 | 2.418650794 | 35786 | 25783 | 1.587945205 | 2.56555773 |
| 35703 | 25700 | 1.788888889 | 2.236111111 | 35731 | 25728 | 1.708571429 | 3.051020408 | 35759 | 25756 | 1.635555556 | 2.068783069 | 35787 | 25784 | 1.58745098 | 4.509803922 |
| 35704 | 25701 | 1.785882353 | 5.991596639 | 35732 | 25729 | 1.703703704 | 4.867724868 | 35760 | 25757 | 1.635555556 | 4.244047619 | 35788 | 25785 | 1.5824 | 4.008571429 |
| 35705 | 25702 | 1.781587302 | 2.920634921 | 35733 | 25730 | 1.702 | 4.764285714 | 35761 | 25758 | 1.635555556 | 4.654761905 | 35789 | 25786 | 1.577142857 | 1.733124019 |
| 35706 | 25703 | 1.771851852 | 1.095238095 | 35734 | 25731 | 1.6928 | 1.095238095 | 35762 | 25759 | 1.635555556 | 2.19047619 | 35790 | 25787 | 1.577142857 | 1.329931973 |
| 35707 | 25704 | 1.771851852 | 2.068783069 | 35735 | 25732 | 1.690810811 | 2.752895753 | 35763 | 25760 | 1.63364486 | 3.285714286 | 35791 | 25788 | 1.577142857 | 1.25170068 |
| 35708 | 25705 | 1.767843137 | 6.635854342 | 35736 | 25733 | 1.689795918 | 1.139941691 | 35764 | 25761 | 1.632 | 2.942857143 | 35792 | 25789 | 1.577142857 | 1.267346939 |
| 35709 | 25706 | 1.7664 | 1.84 | 35737 | 25734 | 1.688470588 | 2.628571429 | 35765 | 25762 | 1.627692308 | 1.769230769 | 35793 | 25790 | 1.577142857 | 1.689795918 |
| 35710 | 25707 | 1.762253521 | 4.6277666 | 35738 | 25735 | 1.687819549 | 2.939849624 | 35766 | 25763 | 1.627692308 | 3.412087912 | 35794 | 25791 | 1.577142857 | 2.413994169 |
| 35711 | 25708 | 1.75375 | 2.310267857 | 35739 | 25736 | 1.686666667 | 2.327380952 | 35767 | 25764 | 1.627692308 | 4.549450549 | 35795 | 25792 | 1.567407407 | 2.494708995 |
| 35712 | 25709 | 1.745641026 | 4.844322344 | 35740 | 25737 | 1.684507042 | 2.915492958 | 35768 | 25765 | 1.626046512 | 1.910299003 | 35796 | 25793 | 1.562264151 | 1.425876011 |
| 35713 | 25710 | 1.745154639 | 1.82916053 | 35741 | 25738 | 1.683404255 | 4.474164134 | 35769 | 25766 | 1.626046512 | 2.139534884 | 35797 | 25794 | 1.561212121 | 3.484848485 |
| 35714 | 25711 | 1.743157895 | 6.398496241 | 35742 | 25739 | 1.670526316 | 4.323308271 | 35770 | 25767 | 1.626046512 | 3.132890365 | 35798 | 25795 | 1.560506329 | 1.164556962 |
| 35715 | 25712 | 1.740540541 | 6.837837838 | 35743 | 25740 | 1.668837209 | 1.299003322 | 35771 | 25768 | 1.623529412 | 3.672268908 | 35799 | 25796 | 1.553027523 | 2.712975098 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 35800 | 25797 | 1.5525 | 1.026785714 | 35828 | 25825 | 1.505454545 | 1.493506494 | 35856 | 25853 | 1.448510638 | 6.082066869 | 35884 | 25881 | 1.411506849 | 2.56555773 |
| 35801 | 25798 | 1.551372549 | 2.254901961 | 35829 | 25826 | 1.505454545 | 4.032467532 | 35857 | 25854 | 1.445714286 | 4.224489796 | 35885 | 25882 | 1.410666667 | 4.326190476 |
| 35802 | 25799 | 1.549473684 | 5.187969925 | 35830 | 25827 | 1.502040816 | 1.810495627 | 35858 | 25855 | 1.445714286 | 4.576530612 | 35886 | 25883 | 1.408395062 | 1.703703704 |
| 35803 | 25800 | 1.548514851 | 1.26874116 | 35831 | 25828 | 1.495 | 6.229166667 | 35859 | 25856 | 1.444301075 | 1.837173579 | 35887 | 25884 | 1.408163265 | 2.179300292 |
| 35804 | 25801 | 1.547272727 | 1.642857143 | 35832 | 25829 | 1.492444444 | 1.788888889 | 35860 | 25857 | 1.443137255 | 2.995798319 | 35888 | 25885 | 1.407058824 | 2.029411765 |
| 35805 | 25802 | 1.546382979 | 1.013677812 | 35833 | 25830 | 1.491891892 | 2.752895753 | 35861 | 25858 | 1.440963855 | 1.425129088 | 35889 | 25886 | 1.407058824 | 1.739495798 |
| 35806 | 25803 | 1.541621622 | 2.575289575 | 35834 | 25831 | 1.486153846 | 6.445054945 | 35862 | 25859 | 1.44 | 2.085714286 | 35890 | 25887 | 1.402772277 | 1.236209335 |
| 35807 | 25804 | 1.537534247 | 2.520547945 | 35835 | 25832 | 1.486153846 | 1.642857143 | 35863 | 25860 | 1.4375 | 3.901785714 | 35891 | 25888 | 1.401904762 | 3.755102041 |
| 35808 | 25805 | 1.533333333 | 1.711309524 | 35836 | 25833 | 1.486153846 | 4.549450549 | 35864 | 25861 | 1.436712329 | 1.350293542 | 35892 | 25889 | 1.3984 | 1.945142857 |
| 35809 | 25806 | 1.533333333 | 2.555555556 | 35837 | 25834 | 1.484912281 | 1.268170426 | 35865 | 25862 | 1.435757576 | 1.493506494 | 35893 | 25890 | 1.397037037 | 1.399470899 |
| 35810 | 25807 | 1.533333333 | 3.230952381 | 35838 | 25835 | 1.482222222 | 3.285714286 | 35866 | 25863 | 1.433766234 | 1.706864564 | 35894 | 25891 | 1.395862069 | 2.719211823 |
| 35811 | 25808 | 1.533333333 | 1.87755102 | 35839 | 25836 | 1.48097561 | 5.048780488 | 35867 | 25864 | 1.433488372 | 2.941860465 | 35895 | 25892 | 1.39483871 | 2.80875576 |
| 35812 | 25809 | 1.533333333 | 1.696619048 | 35840 | 25837 | 1.48097561 | 1.362369338 | 35868 | 25865 | 1.431111111 | 8.214285714 | 35896 | 25893 | 1.393939394 | 1.692640693 |
| 35813 | 25810 | 1.529638554 | 1.425129088 | 35841 | 25838 | 1.478571429 | 1.87755102 | 35869 | 25866 | 1.431111111 | 4.472222222 | 35897 | 25894 | 1.393398058 | 1.435506241 |
| 35814 | 25811 | 1.525853659 | 3.285714286 | 35842 | 25839 | 1.472 | 1.774285714 | 35870 | 25867 | 1.431111111 | 1.135802469 | 35898 | 25895 | 1.392432432 | 5.283783784 |
| 35815 | 25812 | 1.524571429 | 1.971428571 | 35843 | 25840 | 1.472 | 1.117142857 | 35871 | 25868 | 1.431111111 | 2.555555556 | 35899 | 25896 | 1.392432432 | 2.575289575 |
| 35816 | 25813 | 1.52344086 | 5.016897081 | 35844 | 25841 | 1.472 | 6.352380952 | 35872 | 25869 | 1.431111111 | 2.555555556 | 35900 | 25897 | 1.390222222 | 2.044444444 |
| 35817 | 25814 | 1.521975309 | 1.176366843 | 35845 | 25842 | 1.472 | 1.971428571 | 35873 | 25870 | 1.428059701 | 2.452025586 | 35901 | 25898 | 1.388070175 | 1.037593985 |
| 35818 | 25815 | 1.52 | 2.142857143 | 35846 | 25843 | 1.472 | 5.585714286 | 35874 | 25871 | 1.426516854 | 2.399678973 | 35902 | 25899 | 1.385974026 | 1.237476809 |
| 35819 | 25816 | 1.516756757 | 1.50965251 | 35847 | 25844 | 1.467341772 | 1.081374322 | 35875 | 25872 | 1.426 | 2.546428571 | 35903 | 25900 | 1.38 | 1.916666667 |
| 35820 | 25817 | 1.516483516 | 1.083202512 | 35848 | 25845 | 1.466666667 | 2.857142857 | 35876 | 25873 | 1.426 | 2.464285714 | 35904 | 25901 | 1.38 | 2.558163265 |
| 35821 | 25818 | 1.516483516 | 4.982731554 | 35849 | 25846 | 1.465762712 | 1.615012107 | 35877 | 25874 | 1.424516129 | 2.013824885 | 35905 | 25902 | 1.38 | 9.035714286 |
| 35822 | 25819 | 1.514166667 | 1.950892857 | 35850 | 25847 | 1.464736842 | 1.426691729 | 35878 | 25875 | 1.424516129 | 2.755760369 | 35906 | 25903 | 1.38 | 7.275510204 |
| 35823 | 25820 | 1.511428571 | 4.459183673 | 35851 | 25848 | 1.464489796 | 3.151603499 | 35879 | 25876 | 1.419428571 | 1.157823129 | 35907 | 25904 | 1.38 | 1.525510204 |
| 35824 | 25821 | 1.510736842 | 1.62556391 | 35852 | 25849 | 1.461917808 | 2.160469667 | 35880 | 25877 | 1.418333333 | 1.026785714 | 35908 | 25905 | 1.377177914 | 1.471516214 |
| 35825 | 25822 | 1.507047619 | 1.314285714 | 35853 | 25850 | 1.456666667 | 1.163690476 | 35881 | 25878 | 1.415384615 | 2.852433281 | 35909 | 25906 | 1.374945055 | 1.624803768 |
| 35826 | 25823 | 1.505454545 | 1.593073593 | 35854 | 25851 | 1.455824176 | 1.227629513 | 35882 | 25879 | 1.413658537 | 1.162020906 | 35910 | 25907 | 1.373521127 | 1.573440644 |
| 35827 | 25824 | 1.505454545 | 1.792207792 | 35855 | 25852 | 1.44969697 | 2.356421356 | 35883 | 25880 | 1.413333333 | 1.952380952 | 35911 | 25908 | 1.373134328 | 1.275053305 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 35912 | 25909 | 1.373134328 | 5.051172708 | 35940 | 25937 | 1.355789474 | 2.19047619 | 35968 | 25965 | 1.297266187 | 2.08016444 | 35996 | 25993 | 1.257333333 | 3.55952381 |
| 35913 | 25910 | 1.373134328 | 1.324093817 | 35941 | 25938 | 1.351836735 | 2.346938776 | 35969 | 25966 | 1.295510204 | 2.246355685 | 35997 | 25994 | 1.257333333 | 1.478571429 |
| 35914 | 25911 | 1.372698413 | 1.616780045 | 35942 | 25939 | 1.351836735 | 2.816326531 | 35970 | 25967 | 1.294814815 | 2.312169312 | 35998 | 25995 | 1.255193798 | 1.782945736 |
| 35915 | 25912 | 1.37220339 | 3.564164649 | 35943 | 25940 | 1.351504425 | 2.587863464 | 35971 | 25968 | 1.294065934 | 1.588697017 | 35999 | 25996 | 1.253333333 | 3 |
| 35916 | 25913 | 1.371153846 | 2.148351648 | 35944 | 25941 | 1.349333333 | 2.226984127 | 35972 | 25969 | 1.290746269 | 3.089552239 | 36000 | 25997 | 1.252765957 | 3.844984802 |
| 35917 | 25914 | 1.370612245 | 2.548104956 | 35945 | 25942 | 1.349333333 | 1.533333333 | 35973 | 25970 | 1.288 | 4.6 | 36001 | 25998 | 1.25025641 | 3.412087912 |
| 35918 | 25915 | 1.370212766 | 1.118541033 | 35946 | 25943 | 1.347605634 | 1.203219316 | 35974 | 25971 | 1.288 | 1.519642857 | 36002 | 25999 | 1.248571429 | 5.163265306 |
| 35919 | 25916 | 1.370212766 | 7.200607903 | 35947 | 25944 | 1.346341463 | 2.724738676 | 35975 | 25972 | 1.288 | 1.916666667 | 36003 | 26000 | 1.248571429 | 2.757653061 |
| 35920 | 25917 | 1.370212766 | 1.607902736 | 35948 | 25945 | 1.346341463 | 2.885017422 | 35976 | 25973 | 1.286504065 | 1.709639954 | 36004 | 26001 | 1.247457627 | 2.394673123 |
| 35921 | 25918 | 1.36962406 | 2.791621912 | 35949 | 25946 | 1.3432 | 1.544285714 | 35977 | 25974 | 1.284528302 | 1.425876011 | 36005 | 26002 | 1.246451613 | 2.119815668 |
| 35922 | 25919 | 1.369302326 | 1.260797342 | 35950 | 25947 | 1.342702703 | 4.706563707 | 35978 | 25975 | 1.28372093 | 2.139534884 | 36006 | 26003 | 1.245538462 | 2.527472527 |
| 35923 | 25920 | 1.369302326 | 2.139534884 | 35951 | 25948 | 1.33952 | 1.156571429 | 35979 | 25976 | 1.282424242 | 3.683982684 | 36007 | 26004 | 1.244705882 | 2.705882353 |
| 35924 | 25921 | 1.368205128 | 2.232600733 | 35952 | 25949 | 1.338181818 | 1.941558442 | 35980 | 25977 | 1.278644068 | 1.280871671 | 36008 | 26005 | 1.243943662 | 1.249496982 |
| 35925 | 25922 | 1.366857143 | 9.857142857 | 35953 | 25950 | 1.338181818 | 2.19047619 | 35981 | 25978 | 1.278315789 | 2.282706767 | 36009 | 26006 | 1.240930233 | 1.528239203 |
| 35926 | 25923 | 1.365773196 | 3.488954345 | 35954 | 25951 | 1.338181818 | 4.107142857 | 35982 | 25979 | 1.277777778 | 4.426587302 | 36010 | 26007 | 1.240449438 | 1.033707865 |
| 35927 | 25924 | 1.36516129 | 1.589861751 | 35955 | 25952 | 1.332413793 | 1.019704433 | 35983 | 25980 | 1.276396396 | 1.598455598 | 36011 | 26008 | 1.238461538 | 1.200549451 |
| 35928 | 25925 | 1.36516129 | 1.837173579 | 35956 | 25953 | 1.33106383 | 2.097264438 | 35984 | 25981 | 1.273846154 | 1.642857143 | 36012 | 26009 | 1.23625 | 1.283482143 |
| 35929 | 25926 | 1.363571429 | 1.584183673 | 35957 | 25954 | 1.3248 | 3.811428571 | 35985 | 25982 | 1.273846154 | 2.401098901 | 36013 | 26010 | 1.23625 | 2.207589286 |
| 35930 | 25927 | 1.362962963 | 3.529100529 | 35958 | 25955 | 1.32 | 1.142857143 | 35986 | 25983 | 1.272666667 | 1.095238095 | 36014 | 26011 | 1.235428571 | 3.285714286 |
| 35931 | 25928 | 1.362962963 | 1.886243386 | 35959 | 25956 | 1.32 | 3.571428571 | 35987 | 25984 | 1.271272727 | 1.015584416 | 36015 | 26012 | 1.234146341 | 1.722996516 |
| 35932 | 25929 | 1.3616 | 2.825714286 | 35960 | 25957 | 1.319245283 | 3.037735849 | 35988 | 25985 | 1.270927835 | 1.083946981 | 36016 | 26013 | 1.233882353 | 1.816806723 |
| 35933 | 25930 | 1.36 | 1.857142857 | 35961 | 25958 | 1.318666667 | 3.011904762 | 35989 | 25986 | 1.27047619 | 2.738095238 | 36017 | 26014 | 1.233636364 | 3.50974026 |
| 35934 | 25931 | 1.36 | 5 | 35962 | 25959 | 1.317837838 | 1.953667954 | 35990 | 25987 | 1.27047619 | 1.642857143 | 36018 | 26015 | 1.232621359 | 2.041608877 |
| 35935 | 25932 | 1.358095238 | 2.659863946 | 35963 | 25960 | 1.307951807 | 1.148020654 | 35991 | 25988 | 1.262745098 | 1.739495798 | 36019 | 26016 | 1.226666667 | 2.38961039 |
| 35936 | 25933 | 1.358095238 | 4.459183673 | 35964 | 25961 | 1.307368421 | 1.729323308 | 35992 | 25989 | 1.262745098 | 1.030812325 | 36020 | 26017 | 1.226666667 | 1.325814536 |
| 35937 | 25934 | 1.357669903 | 1.850208044 | 35965 | 25962 | 1.304303797 | 2.620253165 | 35993 | 25990 | 1.26214876 | 1.357733176 | 36021 | 26018 | 1.226666667 | 1.684981685 |
| 35938 | 25935 | 1.355789474 | 1.12406015 | 35966 | 25963 | 1.302153846 | 1.87032967 | 35994 | 25991 | 1.258947368 | 1.959899749 | 36022 | 26019 | 1.226666667 | 1.314285714 |
| 35939 | 25936 | 1.355789474 | 1.296992481 | 35967 | 25964 | 1.301463415 | 1.763066202 | 35995 | 25992 | 1.258947368 | 1.971428571 | 36023 | 26020 | 1.226666667 | 1.23655914 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 36024 | 26021 | 1.226666667 | 1.46031746 | 36052 | 26049 | 1.180377358 | 2.23180593 | 36080 | 26077 | 1.157113402 | 1.050073638 | 36108 | 26105 | 1.113684211 | 1.815789474 |
| 36025 | 26022 | 1.226666667 | 4.015873016 | 36053 | 26050 | 1.179487179 | 3.36996337 | 36081 | 26078 | 1.155348837 | 3.285714286 | 36109 | 26106 | 1.110630631 | 1.184041184 |
| 36026 | 26023 | 1.226666667 | 4.107142857 | 36054 | 26051 | 1.179487179 | 2.527472527 | 36082 | 26079 | 1.153898305 | 7.406779661 | 36110 | 26107 | 1.10984127 | 1.616780045 |
| 36027 | 26024 | 1.217647059 | 5.025210084 | 36055 | 26052 | 1.17875 | 2.720982143 | 36083 | 26080 | 1.15 | 1.48489011 | 36111 | 26108 | 1.107572816 | 1.531206657 |
| 36028 | 26025 | 1.2144 | 4.205714286 | 36056 | 26053 | 1.178426966 | 1.476725522 | 36084 | 26081 | 1.15 | 2.258928571 | 36112 | 26109 | 1.104 | 1.567032967 |
| 36029 | 26026 | 1.2144 | 1.314285714 | 36057 | 26054 | 1.1776 | 2.497142857 | 36085 | 26082 | 1.15 | 3.051020408 | 36113 | 26110 | 1.104 | 3.285714286 |
| 36030 | 26027 | 1.213617021 | 2.272036474 | 36058 | 26055 | 1.1776 | 3.417142857 | 36086 | 26083 | 1.15 | 2.738095238 | 36114 | 26111 | 1.098507463 | 1.373134328 |
| 36031 | 26028 | 1.209863014 | 1.485322896 | 36059 | 26056 | 1.174939759 | 1.385542169 | 36087 | 26084 | 1.15 | 1.962301587 | 36115 | 26112 | 1.096923077 | 3.222527473 |
| 36032 | 26029 | 1.2075 | 1.334821429 | 36060 | 26057 | 1.174468085 | 3.565349544 | 36088 | 26085 | 1.147012987 | 1.045454545 | 36116 | 26113 | 1.095238095 | 3.950680272 |
| 36033 | 26030 | 1.2075 | 1.129464286 | 36061 | 26058 | 1.173793103 | 2.379310345 | 36089 | 26086 | 1.143030303 | 2.588744589 | 36117 | 26114 | 1.093333333 | 2.142857143 |
| 36034 | 26031 | 1.206222222 | 2.847619048 | 36062 | 26059 | 1.170909091 | 1.374025974 | 36090 | 26087 | 1.142736842 | 1.279699248 | 36118 | 26115 | 1.093333333 | 1.142857143 |
| 36035 | 26032 | 1.204363636 | 3.464935065 | 36063 | 26060 | 1.170909091 | 4.838961039 | 36091 | 26088 | 1.141686747 | 1.385542169 | 36119 | 26116 | 1.093069307 | 1.301272984 |
| 36036 | 26033 | 1.203076923 | 2.527472527 | 36064 | 26061 | 1.170909091 | 1.493506494 | 36092 | 26089 | 1.139047619 | 4.068027211 | 36120 | 26117 | 1.087883212 | 1.726798749 |
| 36037 | 26034 | 1.203076923 | 1.769230769 | 36065 | 26062 | 1.170909091 | 4.405844156 | 36093 | 26090 | 1.137894737 | 1.556390977 | 36121 | 26118 | 1.087272727 | 5.924242424 |
| 36038 | 26035 | 1.200842105 | 1.798496241 | 36066 | 26063 | 1.170909091 | 1.792207792 | 36094 | 26091 | 1.136470588 | 1.449579832 | 36122 | 26119 | 1.080634921 | 4.328798186 |
| 36039 | 26036 | 1.2 | 3.714285714 | 36067 | 26064 | 1.170909091 | 2.875 | 36095 | 26092 | 1.132307692 | 1.010989011 | 36123 | 26120 | 1.079669421 | 2.145218418 |
| 36040 | 26037 | 1.2 | 2.514285714 | 36068 | 26065 | 1.170909091 | 1.493506494 | 36096 | 26093 | 1.132307692 | 2.527472527 | 36124 | 26121 | 1.07862069 | 2.15270936 |
| 36041 | 26038 | 1.196 | 7.392857143 | 36069 | 26066 | 1.170909091 | 2.150649351 | 36097 | 26094 | 1.132307692 | 2.611721612 | 36125 | 26122 | 1.07862069 | 2.804187192 |
| 36042 | 26039 | 1.196 | 1.04047619 | 36070 | 26067 | 1.168253968 | 1.616780045 | 36098 | 26095 | 1.13060241 | 1.068846816 | 36126 | 26123 | 1.077368421 | 1.988721805 |
| 36043 | 26040 | 1.194805195 | 1.194805195 | 36071 | 26068 | 1.167692308 | 6.192307692 | 36099 | 26096 | 1.124444444 | 5.293650794 | 36127 | 26124 | 1.076226415 | 1.797843666 |
| 36044 | 26041 | 1.194385965 | 2.305764411 | 36072 | 26069 | 1.166829268 | 2.484320557 | 36100 | 26097 | 1.1224 | 3.811428571 | 36128 | 26125 | 1.073333333 | 1.212585034 |
| 36045 | 26042 | 1.194385965 | 2.536340852 | 36073 | 26070 | 1.165333333 | 1.861904762 | 36101 | 26098 | 1.12195122 | 1.322299652 | 36129 | 26126 | 1.073333333 | 1.56462585 |
| 36046 | 26043 | 1.191949686 | 1.260557053 | 36074 | 26071 | 1.162105263 | 4.669172932 | 36102 | 26099 | 1.12 | 2.357142857 | 36130 | 26127 | 1.073333333 | 2.646825397 |
| 36047 | 26044 | 1.190588235 | 1.224089636 | 36075 | 26072 | 1.162105263 | 3.458646617 | 36103 | 26100 | 1.118153846 | 2.856043956 | 36131 | 26128 | 1.071392405 | 4.533453888 |
| 36048 | 26045 | 1.188923077 | 1.263736264 | 36076 | 26073 | 1.161165049 | 2.360610264 | 36104 | 26101 | 1.117142857 | 4.693877551 | 36132 | 26129 | 1.071044776 | 1.83901919 |
| 36049 | 26046 | 1.186542056 | 1.873164219 | 36077 | 26074 | 1.160615385 | 2.78021978 | 36105 | 26102 | 1.115151515 | 1.593073593 | 36133 | 26130 | 1.069767442 | 2.648947951 |
| 36050 | 26047 | 1.185777778 | 4.088888889 | 36078 | 26075 | 1.160615385 | 1.718681319 | 36106 | 26103 | 1.115151515 | 4.430735931 | 36134 | 26131 | 1.069401709 | 1.432234432 |
| 36051 | 26048 | 1.184367816 | 1.775041051 | 36079 | 26076 | 1.16 | 4.142857143 | 36107 | 26104 | 1.113684211 | 1.988721805 | 36135 | 26132 | 1.067857143 | 1.701530612 |

FIG. 4 (Cont.)

| DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score | DNA SEQ ID NO | AA SEQ ID NO | Heart 1 Enrichment Score | Heart 2 Enrichment Score |
|---|---|---|---|---|---|---|---|---|---|---|---|---|---|---|---|
| 36136 | 26133 | 1.0672 | 1.708571429 | 36155 | 26152 | 1.042666667 | 4.819047619 | 36174 | 26171 | 1.02557377 | 1.885245902 | 36193 | 26190 | 1.013033708 | 2.731942215 |
| 36137 | 26134 | 1.066666667 | 1.142857143 | 36156 | 26153 | 1.042666667 | 2.738095238 | 36175 | 26172 | 1.025142857 | 3.520408163 | 36194 | 26191 | 1.013033708 | 1.845906902 |
| 36138 | 26135 | 1.065263158 | 3.156015038 | 36157 | 26154 | 1.041509434 | 2.169811321 | 36176 | 26173 | 1.024 | 2.4 | 36195 | 26192 | 1.010196078 | 1.224089636 |
| 36139 | 26136 | 1.063111111 | 3.212698413 | 36158 | 26155 | 1.041052632 | 1.729323308 | 36177 | 26174 | 1.022222222 | 10.31349206 | 36196 | 26193 | 1.009756098 | 2.203832753 |
| 36140 | 26137 | 1.063111111 | 1.216931217 | 36159 | 26156 | 1.04 | 1.142857143 | 36178 | 26175 | 1.022222222 | 1.861904762 | 36197 | 26194 | 1.009032258 | 3.444700461 |
| 36141 | 26138 | 1.061538462 | 2.085164835 | 36160 | 26157 | 1.037948718 | 2.948717949 | 36179 | 26176 | 1.022222222 | 5.841269841 | 36198 | 26195 | 1.007619048 | 3.911564626 |
| 36142 | 26139 | 1.059393939 | 2.090909091 | 36161 | 26158 | 1.037446809 | 2.446808511 | 36180 | 26177 | 1.022222222 | 1.616780045 | 36199 | 26196 | 1.005866667 | 1.139047619 |
| 36143 | 26140 | 1.059393939 | 2.24025974 | 36162 | 26159 | 1.037446809 | 1.013677812 | 36181 | 26178 | 1.022222222 | 1.049603175 | 36200 | 26197 | 1.005581395 | 1.681063123 |
| 36144 | 26141 | 1.055294118 | 1.594537815 | 36163 | 26160 | 1.035 | 3.422619048 | 36182 | 26179 | 1.022222222 | 2.555555556 | 36201 | 26198 | 1.005185185 | 1.642857143 |
| 36145 | 26142 | 1.055294118 | 2.174369748 | 36164 | 26161 | 1.035 | 4.928571429 | 36183 | 26180 | 1.019759036 | 1.385542169 | 36202 | 26199 | 1.004540541 | 1.687258687 |
| 36146 | 26143 | 1.054166667 | 1.779761905 | 36165 | 26162 | 1.035 | 2.854464286 | 36184 | 26181 | 1.01787234 | 2.446808511 | 36203 | 26200 | 1.003636364 | 4.281385281 |
| 36147 | 26144 | 1.051428571 | 2.464285714 | 36166 | 26163 | 1.035 | 1.505952381 | 36185 | 26182 | 1.01787234 | 1.607902736 | 36204 | 26201 | 1.003636364 | 9.25974026 |
| 36148 | 26145 | 1.051428571 | 1.783673469 | 36167 | 26164 | 1.035 | 1.711309524 | 36186 | 26183 | 1.01787234 | 3.495440729 | 36205 | 26202 | 1.003636364 | 9.25974026 |
| 36149 | 26146 | 1.051428571 | 3.227040816 | 36168 | 26165 | 1.032195122 | 2.644599303 | 36187 | 26184 | 1.01787234 | 1.817629179 | 36206 | 26203 | 1.003636364 | 2.38961039 |
| 36150 | 26147 | 1.049122807 | 1.556390977 | 36169 | 26166 | 1.0304 | 7.885714286 | 36188 | 26185 | 1.016842105 | 2.593984962 | 36207 | 26204 | 1.000701754 | 1.786967419 |
| 36151 | 26148 | 1.045894737 | 2.593984962 | 36170 | 26167 | 1.0304 | 1.445714286 | 36189 | 26186 | 1.016842105 | 3.458646617 | 36208 | 26205 | 1.000701754 | 1.412280702 |
| 36152 | 26149 | 1.044324324 | 1.554054054 | 36171 | 26168 | 1.029724771 | 1.296199214 | 36190 | 26187 | 1.016842105 | 2.334586466 | | | | |
| 36153 | 26150 | 1.044324324 | 4.884169884 | 36172 | 26169 | 1.028661417 | 2.457817773 | 36191 | 26188 | 1.015172414 | 4.022167488 | | | | |
| 36154 | 26151 | 1.042666667 | 2.738095238 | 36173 | 26170 | 1.02557377 | 1.023419204 | 36192 | 26189 | 1.015172414 | 3.0591133 | | | | |

FIG. 5

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36209 | 26206 | 227.125 | 48.80128205 | 36235 | 26232 | 40.38218391 | 10.39846743 | 36261 | 26258 | 31.83955224 | 13.04477612 | 36287 | 26284 | 27.671875 | 1.677083333 |
| 36210 | 26207 | 146.05 | 245.3333333 | 36236 | 26233 | 40.1097561 | 17.57723577 | 36262 | 26259 | 31.39189189 | 21.96396396 | 36288 | 26285 | 27.65267176 | 17.32315522 |
| 36211 | 26208 | 105.2692308 | 60.15384615 | 36237 | 26234 | 40.1097561 | 31.41463415 | 36263 | 26260 | 30.94047619 | 16.79365079 | 36289 | 26286 | 27.55208333 | 38.97222222 |
| 36212 | 26209 | 95.69642857 | 43.80952381 | 36238 | 26235 | 40.05833333 | 27.08888889 | 36264 | 26261 | 30.77941176 | 11.7254902 | 36290 | 26287 | 27.5 | 55.33333333 |
| 36213 | 26210 | 82.14285714 | 48.19047619 | 36239 | 26236 | 39.80769231 | 17.98717949 | 36265 | 26262 | 30.68684211 | 4.357894737 | 36291 | 26288 | 27.1875 | 1.833333333 |
| 36214 | 26211 | 80.40725806 | 6.924731183 | 36240 | 26237 | 39.79605263 | 34.70175439 | 36266 | 26263 | 30.64805825 | 19.35275081 | 36292 | 26289 | 27.15957447 | 28.38297872 |
| 36215 | 26212 | 80.02083333 | 1.277777778 | 36241 | 26238 | 38.64534884 | 6.775193798 | 36267 | 26264 | 30.53888889 | 48.38518519 | 36293 | 26290 | 27.09469697 | 13.93939394 |
| 36216 | 26213 | 76.02777778 | 48.55555556 | 36242 | 26239 | 37 | 4.666666667 | 36268 | 26265 | 30.46276596 | 42.73758865 | 36294 | 26291 | 27.025 | 3.833333333 |
| 36217 | 26214 | 73.05882353 | 42.39215686 | 36243 | 26240 | 36.19117647 | 51.41176471 | 36269 | 26266 | 30.35465116 | 67.03875969 | 36295 | 26292 | 26.80384615 | 1.415384615 |
| 36218 | 26215 | 63.25 | 74.47619048 | 36244 | 26241 | 36.05932203 | 42.10169492 | 36270 | 26267 | 30.01838235 | 9.019607843 | 36296 | 26293 | 26.57432432 | 3.315315315 |
| 36219 | 26216 | 61.83461538 | 2.123076923 | 36245 | 26242 | 35.0175 | 8.893333333 | 36271 | 26268 | 30.01219512 | 46.56097561 | 36297 | 26294 | 26.30625 | 34.88333333 |
| 36220 | 26217 | 58.77777778 | 50.54320988 | 36246 | 26243 | 35.01111111 | 30.32592593 | 36272 | 26269 | 29.98214286 | 30.66666667 | 36298 | 26295 | 26 | 44 |
| 36221 | 26218 | 55.13611111 | 3.918518519 | 36247 | 26244 | 34.7875 | 25.04444444 | 36273 | 26270 | 29.55925926 | 10.79012346 | 36299 | 26296 | 25.99 | 13.49333333 |
| 36222 | 26219 | 52.42954545 | 12.96363636 | 36248 | 26245 | 34.7875 | 13.99166667 | 36274 | 26271 | 29.51102941 | 10.82352941 | 36300 | 26297 | 25.93617021 | 56.76595745 |
| 36223 | 26220 | 50.14247312 | 21.2688172 | 36249 | 26246 | 34.3597561 | 22.43902439 | 36275 | 26272 | 29.49193548 | 24.97849462 | 36301 | 26298 | 25.81111111 | 11.58518519 |
| 36224 | 26221 | 49.28571429 | 6.571428571 | 36250 | 26247 | 34.3525641 | 42.06837607 | 36276 | 26273 | 29.45987654 | 12.11522634 | 36302 | 26299 | 25.71527778 | 3.691358025 |
| 36225 | 26222 | 48.58163265 | 49.75510204 | 36251 | 26248 | 34.32575758 | 13.93939394 | 36277 | 26274 | 29.44 | 36.18666667 | 36303 | 26300 | 25.53 | 61.33333333 |
| 36226 | 26223 | 48.39583333 | 65.16666667 | 36252 | 26249 | 34.18636364 | 13.66060606 | 36278 | 26275 | 29.2242268 | 18.81099656 | 36304 | 26301 | 25.50403226 | 6.677419355 |
| 36227 | 26224 | 48.36388889 | 5.111111111 | 36253 | 26250 | 33.97727273 | 32.06060606 | 36279 | 26276 | 29.18125 | 15.33333333 | 36305 | 26302 | 25.49528302 | 27.19496855 |
| 36228 | 26225 | 46.359375 | 25.39583333 | 36254 | 26251 | 33.6375 | 41.01666667 | 36280 | 26277 | 28.75 | 37.56666667 | 36306 | 26303 | 25.375 | 26.66666667 |
| 36229 | 26226 | 44.72222222 | 50.54320988 | 36255 | 26252 | 33.31034483 | 43.88505747 | 36281 | 26278 | 28.75 | 49.13636364 | 36307 | 26304 | 25.14759036 | 8.682730924 |
| 36230 | 26227 | 43.484375 | 13.03333333 | 36256 | 26253 | 32.75757576 | 14.63636364 | 36282 | 26279 | 28.45258621 | 28.81609195 | 36308 | 26305 | 25.09090909 | 56.22222222 |
| 36231 | 26228 | 42.80555556 | 28.39506173 | 36257 | 26254 | 32.29292929 | 25.24579125 | 36283 | 26280 | 28.40671642 | 29.52238806 | 36309 | 26306 | 25.06132075 | 21.11949686 |
| 36232 | 26229 | 42.5 | 17.33333333 | 36258 | 26255 | 32.24509804 | 12.32679739 | 36284 | 26281 | 28.23888889 | 42.25185185 | 36310 | 26307 | 25.04032258 | 29.67741935 |
| 36233 | 26230 | 41.75 | 27 | 36259 | 26256 | 32.2 | 15.33333333 | 36285 | 26282 | 27.92857143 | 54.76190476 | 36311 | 26308 | 24.91666667 | 16.72727273 |
| 36234 | 26231 | 40.99193548 | 25.72043011 | 36260 | 26257 | 32.11153846 | 11.79487179 | 36286 | 26283 | 27.79166667 | 41.61904762 | 36312 | 26309 | 24.62916667 | 20.95555556 |

FIG. 5 (Cont.)

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36313 | 26310 | 24.57368421 | 37.44561404 | 36341 | 26338 | 21.17460317 | 21.66137566 | 36369 | 26366 | 19.50490196 | 16.53594771 | 36397 | 26394 | 17.81557377 | 31.92349727 |
| 36314 | 26311 | 24.5 | 52 | 36342 | 26339 | 21.14830508 | 34.56497175 | 36370 | 26367 | 19.43103448 | 37.01149425 | 36398 | 26395 | 17.70544554 | 8.349834983 |
| 36315 | 26312 | 24.08235294 | 7.396078431 | 36343 | 26340 | 21.00961538 | 51.8974359 | 36371 | 26368 | 19.43103448 | 16.12643678 | 36399 | 26396 | 17.70098039 | 61.03267974 |
| 36316 | 26313 | 23.94902913 | 10.12297735 | 36344 | 26341 | 20.90909091 | 39.03030303 | 36372 | 26369 | 19.30357143 | 7.392857143 | 36400 | 26397 | 17.67592593 | 9.086419753 |
| 36317 | 26314 | 23.88461538 | 69 | 36345 | 26342 | 20.83529412 | 14.07058824 | 36373 | 26370 | 19.2625 | 1.533333333 | 36401 | 26398 | 17.51538462 | 10.61538462 |
| 36318 | 26315 | 23.82142857 | 11.60952381 | 36346 | 26343 | 20.81896552 | 14.01149425 | 36374 | 26371 | 19.16666667 | 56.22222222 | 36402 | 26399 | 17.46296296 | 7.950617284 |
| 36319 | 26316 | 23.61607143 | 25.19047619 | 36347 | 26344 | 20.77840909 | 14.11363636 | 36375 | 26372 | 19.00882353 | 3.968627451 | 36403 | 26400 | 17.44827586 | 16.91954023 |
| 36320 | 26317 | 23.54761905 | 24.82539683 | 36348 | 26345 | 20.66891892 | 9.738738739 | 36376 | 26373 | 18.95703125 | 9.34375 | 36404 | 26401 | 17.40972222 | 13.2037037 |
| 36321 | 26318 | 23.28395062 | 9.843621399 | 36349 | 26346 | 20.65740741 | 11.92592593 | 36377 | 26374 | 18.85245902 | 56.05464481 | 36405 | 26402 | 17.37777778 | 17.71851852 |
| 36322 | 26319 | 23.22115385 | 36.56410256 | 36350 | 26347 | 20.64457831 | 10.89959839 | 36378 | 26375 | 18.82311321 | 13.01886792 | 36406 | 26403 | 17.36386139 | 8.198019802 |
| 36323 | 26320 | 23.0982906 | 18.08547009 | 36351 | 26348 | 20.60416667 | 27.08888889 | 36379 | 26376 | 18.80532787 | 9.928961749 | 36407 | 26404 | 17.35087719 | 20.1754386 |
| 36324 | 26321 | 22.91153846 | 79.96923077 | 36352 | 26349 | 20.42241379 | 1.057471264 | 36380 | 26377 | 18.66313559 | 8.966101695 | 36408 | 26405 | 17.32467532 | 29.07359307 |
| 36325 | 26322 | 22.84666667 | 21.05777778 | 36353 | 26350 | 20.38636364 | 16.12987013 | 36381 | 26378 | 18.48214286 | 13.14285714 | 36409 | 26406 | 17.25 | 44.42735043 |
| 36326 | 26323 | 22.81451613 | 21.76344086 | 36354 | 26351 | 20.31666667 | 16.86666667 | 36382 | 26379 | 18.46052632 | 6.456140351 | 36410 | 26407 | 17.25 | 44.24761905 |
| 36327 | 26324 | 22.75 | 42.66666667 | 36355 | 26352 | 20.22191011 | 3.445692884 | 36383 | 26380 | 18.44207317 | 13.08943089 | 36411 | 26408 | 17.25 | 72.04819277 |
| 36328 | 26325 | 22.70258621 | 27.75862069 | 36356 | 26353 | 20.17924528 | 16.20125786 | 36384 | 26381 | 18.41949153 | 29.62711864 | 36412 | 26409 | 17.09868421 | 16.54385965 |
| 36329 | 26326 | 22.39473684 | 21.78947368 | 36357 | 26354 | 20.125 | 14.56666667 | 36385 | 26382 | 18.38915094 | 11.28301887 | 36413 | 26410 | 17 | 10.66666667 |
| 36330 | 26327 | 22.38392857 | 25.73809524 | 36358 | 26355 | 20.125 | 12.62745098 | 36386 | 26383 | 18.328125 | 21.5625 | 36414 | 26411 | 16.98863636 | 16.72727273 |
| 36331 | 26328 | 22.31343284 | 27.23383085 | 36359 | 26356 | 20.00684932 | 7.141552511 | 36387 | 26384 | 18.14444444 | 18.74074074 | 36415 | 26412 | 16.83928571 | 69.73015873 |
| 36332 | 26329 | 21.95454545 | 12.08080808 | 36360 | 26357 | 20.00265957 | 10.92907801 | 36388 | 26385 | 18.13461538 | 26.18461538 | 36416 | 26413 | 16.82926829 | 6.544715447 |
| 36333 | 26330 | 21.80519481 | 31.66233766 | 36361 | 26358 | 20.00265957 | 10.27659574 | 36389 | 26386 | 18.08467742 | 12.86021505 | 36417 | 26414 | 16.74561404 | 14.25730994 |
| 36334 | 26331 | 21.63978495 | 19.12544803 | 36362 | 26359 | 20 | 13.04761905 | 36390 | 26387 | 18.04521277 | 6.524822695 | 36418 | 26415 | 16.69097222 | 52.17592593 |
| 36335 | 26332 | 21.48684211 | 38.46783626 | 36363 | 26360 | 19.84677419 | 36.60215054 | 36391 | 26388 | 17.99675325 | 10.95238095 | 36419 | 26416 | 16.675 | 18.4 |
| 36336 | 26333 | 21.44411765 | 18.76078431 | 36364 | 26361 | 19.7345679 | 3.028806584 | 36392 | 26389 | 17.95769231 | 16.51282051 | 36420 | 26417 | 16.53865979 | 8.219931271 |
| 36337 | 26334 | 21.42688679 | 8.679245283 | 36365 | 26362 | 19.68644068 | 17.93220339 | 36393 | 26390 | 17.94172932 | 7.263157895 | 36421 | 26418 | 16.375 | 17 |
| 36338 | 26335 | 21.37264151 | 27.48427673 | 36366 | 26363 | 19.66129032 | 94.96774194 | 36394 | 26391 | 17.85526316 | 24.21052632 | 36422 | 26419 | 16.33522727 | 44.95454545 |
| 36339 | 26336 | 21.35714286 | 16.06349206 | 36367 | 26364 | 19.6130137 | 1.050228311 | 36395 | 26392 | 17.83474576 | 9.875706215 | 36423 | 26420 | 16.1971831 | 21.81220657 |
| 36340 | 26337 | 21.346875 | 17.05833333 | 36368 | 26365 | 19.5859375 | 16.53125 | 36396 | 26393 | 17.825 | 33.73333333 | 36424 | 26421 | 16.16509434 | 6.075471698 |

FIG. 5 (Cont.)

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36425 | 26422 | 16.06349206 | 15.57671958 | 36453 | 26450 | 14.95 | 9.966666667 | 36481 | 26478 | 13.63953488 | 15.68992248 | 36509 | 26506 | 12.81140351 | 15.60233918 |
| 36426 | 26423 | 16.04651163 | 46 | 36454 | 26451 | 14.91891892 | 27.76576577 | 36482 | 26479 | 13.60365854 | 18.69918699 | 36510 | 26507 | 12.74698795 | 15.33333333 |
| 36427 | 26424 | 16.01785714 | 1.533333333 | 36455 | 26452 | 14.88235294 | 7.215686275 | 36483 | 26480 | 13.56640625 | 20.125 | 36511 | 26508 | 12.68382353 | 22.32352941 |
| 36428 | 26425 | 15.97222222 | 51.11111111 | 36456 | 26453 | 14.84438776 | 25.03401361 | 36484 | 26481 | 13.56132075 | 13.59748428 | 36512 | 26509 | 12.67346939 | 38.48979592 |
| 36429 | 26426 | 15.96651786 | 11.08928571 | 36457 | 26454 | 14.82042254 | 18.57276995 | 36485 | 26482 | 13.55357143 | 18.25396825 | 36513 | 26510 | 12.65 | 8.554385965 |
| 36430 | 26427 | 15.96470588 | 25.25490196 | 36458 | 26455 | 14.75328947 | 9.684210526 | 36486 | 26483 | 13.54444444 | 20.44444444 | 36514 | 26511 | 12.62195122 | 3.085365854 |
| 36431 | 26428 | 15.93987342 | 13.39240506 | 36459 | 26456 | 14.68085106 | 17.29078014 | 36487 | 26484 | 13.37209302 | 18.18604651 | 36515 | 26512 | 12.59772727 | 7.806060606 |
| 36432 | 26429 | 15.91666667 | 17.55555556 | 36460 | 26457 | 14.67763158 | 20.98245614 | 36488 | 26485 | 13.35057471 | 13.04214559 | 36516 | 26513 | 12.434375 | 16.86666667 |
| 36433 | 26430 | 15.88815789 | 6.657894737 | 36461 | 26458 | 14.6625 | 10.73333333 | 36489 | 26486 | 13.34 | 9.813333333 | 36517 | 26514 | 12.42216981 | 4.48427673 |
| 36434 | 26431 | 15.86206897 | 6.344827586 | 36462 | 26459 | 14.625 | 17.33333333 | 36490 | 26487 | 13.25195313 | 5.03125 | 36518 | 26515 | 12.41755319 | 12.39716312 |
| 36435 | 26432 | 15.84756098 | 19.07317073 | 36463 | 26460 | 14.54411765 | 10.37254902 | 36491 | 26488 | 13.1875 | 2.333333333 | 36519 | 26516 | 12.38988095 | 6.571428571 |
| 36436 | 26433 | 15.72151899 | 13.97468354 | 36464 | 26461 | 14.51875 | 14.56666667 | 36492 | 26489 | 13.12735849 | 5.20754717 | 36520 | 26517 | 12.35185185 | 23.70987654 |
| 36437 | 26434 | 15.71666667 | 17.63333333 | 36465 | 26462 | 14.5104712 | 16.61780105 | 36493 | 26490 | 13.07843137 | 15.63398693 | 36521 | 26518 | 12.33467742 | 18.5483871 |
| 36438 | 26435 | 15.69594595 | 20.72072072 | 36466 | 26463 | 14.49479167 | 9.263888889 | 36494 | 26491 | 13.06818182 | 64.12121212 | 36522 | 26519 | 12.32142857 | 8.761904762 |
| 36439 | 26436 | 15.66666667 | 13.77777778 | 36467 | 26464 | 14.48148148 | 1.135802469 | 36495 | 26492 | 13.05532787 | 2.010928962 | 36523 | 26520 | 12.32142857 | 31.64021164 |
| 36440 | 26437 | 15.56707317 | 81.90243902 | 36468 | 26465 | 14.47992701 | 4.812652068 | 36496 | 26493 | 13.04807692 | 16.21794872 | 36524 | 26521 | 12.30701754 | 34.70175439 |
| 36441 | 26438 | 15.53723404 | 12.07092199 | 36469 | 26466 | 14.42727273 | 52.96969697 | 36497 | 26494 | 13.04569892 | 6.594982079 | 36525 | 26522 | 12.27403846 | 5.307692308 |
| 36442 | 26439 | 15.44879518 | 10.16064257 | 36470 | 26467 | 14.41233766 | 3.683982684 | 36498 | 26495 | 13.02797203 | 10.07925408 | 36526 | 26523 | 12.23015873 | 15.57671958 |
| 36443 | 26440 | 15.42548077 | 15.62820513 | 36471 | 26468 | 14.375 | 14.79844961 | 36499 | 26496 | 13.01315789 | 25.42105263 | 36527 | 26524 | 12.17647059 | 15.03267974 |
| 36444 | 26441 | 15.375 | 38.33333333 | 36472 | 26469 | 14.21226415 | 49.47169811 | 36500 | 26497 | 13.01315789 | 11.78245614 | 36528 | 26525 | 12.16346154 | 16.21794872 |
| 36445 | 26442 | 15.33333333 | 21.2962963 | 36473 | 26470 | 14.17897727 | 14.28787879 | 36501 | 26498 | 12.98387097 | 16.56989247 | 36529 | 26526 | 12.13888889 | 26.57777778 |
| 36446 | 26443 | 15.33333333 | 2.271604938 | 36474 | 26471 | 14.125 | 29.5 | 36502 | 26499 | 12.95895522 | 11.67164179 | 36530 | 26527 | 12.075 | 9.813333333 |
| 36447 | 26444 | 15.30844156 | 15.93073593 | 36475 | 26472 | 14.07758621 | 9.781609195 | 36503 | 26500 | 12.95666667 | 10.42666667 | 36531 | 26528 | 11.99568966 | 1.586206897 |
| 36448 | 26445 | 15.27857143 | 5.403174603 | 36476 | 26473 | 13.9939759 | 2.586345382 | 36504 | 26501 | 12.91975309 | 9.275720165 | 36532 | 26529 | 11.97131148 | 4.273224044 |
| 36449 | 26446 | 15.26234568 | 32.18106996 | 36477 | 26474 | 13.96428571 | 36.14285714 | 36505 | 26502 | 12.90406977 | 8.914728682 | 36533 | 26530 | 11.88701923 | 6.929487179 |
| 36450 | 26447 | 15.25961538 | 9.730769231 | 36478 | 26475 | 13.77604167 | 23.47916667 | 36506 | 26503 | 12.88 | 12.26666667 | 36534 | 26531 | 11.75 | 9 |
| 36451 | 26448 | 15.22972973 | 30.25225225 | 36479 | 26476 | 13.76329787 | 15.65957447 | 36507 | 26504 | 12.85294118 | 53.66666667 | 36535 | 26532 | 11.7254902 | 16.53594771 |
| 36452 | 26449 | 15.09375 | 24.53333333 | 36480 | 26477 | 13.68103448 | 17.09578544 | 36508 | 26505 | 12.82300885 | 27.81710914 | 36536 | 26533 | 11.69827586 | 7.270114943 |

FIG. 5 (Cont.)

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36537 | 26534 | 11.68157895 | 19.69122807 | 36565 | 26562 | 10.86111111 | 1.277777778 | 36593 | 26590 | 9.814655172 | 14.54022989 | 36621 | 26618 | 9.324324324 | 23.20720721 |
| 36538 | 26535 | 11.6796875 | 8.305555556 | 36566 | 26563 | 10.83653846 | 2.358974359 | 36594 | 26591 | 9.807459677 | 10.75806452 | 36622 | 26619 | 9.31712963 | 4.117283951 |
| 36539 | 26536 | 11.6402439 | 10.47154472 | 36567 | 26564 | 10.74131944 | 9.583333333 | 36595 | 26592 | 9.787234043 | 63.29078014 | 36623 | 26620 | 9.285185185 | 11.24444444 |
| 36540 | 26537 | 11.6 | 32.8 | 36568 | 26565 | 10.71590909 | 5.343434343 | 36596 | 26593 | 9.775 | 20.08666667 | 36624 | 26621 | 9.228395062 | 11.92592593 |
| 36541 | 26538 | 11.56686047 | 18.00775194 | 36569 | 26566 | 10.71078431 | 15.63398693 | 36597 | 26594 | 9.775 | 23.21904762 | 36625 | 26622 | 9.2 | 21.16 |
| 36542 | 26539 | 11.56534091 | 9.931818182 | 36570 | 26567 | 10.67857143 | 29.43452381 | 36598 | 26595 | 9.75 | 8.666666667 | 36626 | 26623 | 9.076785714 | 9.857142857 |
| 36543 | 26540 | 11.55582524 | 4.614886731 | 36571 | 26568 | 10.565625 | 10.54166667 | 36599 | 26596 | 9.741176471 | 10.82352941 | 36627 | 26624 | 9.067307692 | 23.29487179 |
| 36544 | 26541 | 11.5 | 27.83589744 | 36572 | 26569 | 10.56009615 | 1.695512821 | 36600 | 26597 | 9.725308642 | 6.057613169 | 36628 | 26625 | 9.04233871 | 7.419354839 |
| 36545 | 26542 | 11.5 | 23.13939394 | 36573 | 26570 | 10.54166667 | 29.60185185 | 36601 | 26598 | 9.715517241 | 12.68965517 | 36629 | 26626 | 9.031413613 | 12.36300175 |
| 36546 | 26543 | 11.5 | 10.62706271 | 36574 | 26571 | 10.5225 | 6.9 | 36602 | 26599 | 9.703125 | 11.30833333 | 36630 | 26627 | 9 | 12.44444444 |
| 36547 | 26544 | 11.44132653 | 25.34693878 | 36575 | 26572 | 10.46311475 | 23 | 36603 | 26600 | 9.699494949 | 17.96632997 | 36631 | 26628 | 8.997685185 | 7.240740741 |
| 36548 | 26545 | 11.43611111 | 7.496296296 | 36576 | 26573 | 10.41509434 | 7.522012579 | 36604 | 26601 | 9.679166667 | 2.044444444 | 36632 | 26629 | 8.992021277 | 3.09929078 |
| 36549 | 26546 | 11.41015625 | 5.989583333 | 36577 | 26574 | 10.39893617 | 38.82269504 | 36605 | 26602 | 9.655660377 | 21.40880503 | 36633 | 26630 | 8.975609756 | 32.53658537 |
| 36550 | 26547 | 11.40254237 | 6.237288136 | 36578 | 26575 | 10.35 | 26.57777778 | 36606 | 26603 | 9.651785714 | 6.43452381 | 36634 | 26631 | 8.927631579 | 22.4619883 |
| 36551 | 26548 | 11.375 | 1.5 | 36579 | 26576 | 10.33445946 | 8.702702703 | 36607 | 26604 | 9.614754098 | 15.58469945 | 36635 | 26632 | 8.909340659 | 7.245421245 |
| 36552 | 26549 | 11.32920792 | 2.732673267 | 36580 | 26577 | 10.22222222 | 8.518518519 | 36608 | 26605 | 9.611940299 | 4.119402985 | 36636 | 26633 | 8.879746835 | 6.308016878 |
| 36553 | 26550 | 11.30172414 | 27.49425287 | 36581 | 26578 | 10.22222222 | 17.52380952 | 36609 | 26606 | 9.61013986 | 19.08624709 | 36637 | 26634 | 8.851973684 | 34.5 |
| 36554 | 26551 | 11.2125 | 3.066666667 | 36582 | 26579 | 10.20343137 | 8.117647059 | 36610 | 26607 | 9.583333333 | 25.8245614 | 36638 | 26635 | 8.825581395 | 11.23255814 |
| 36555 | 26552 | 11.20762712 | 31.44632768 | 36583 | 26580 | 10.18859649 | 23.67251462 | 36611 | 26608 | 9.5234375 | 12.33854167 | 36639 | 26636 | 8.819548872 | 11.06766917 |
| 36556 | 26553 | 11.18055556 | 28.96296296 | 36584 | 26581 | 10.17307692 | 12.08974359 | 36612 | 26609 | 9.4875 | 13.03333333 | 36640 | 26637 | 8.811688312 | 29.87012987 |
| 36557 | 26554 | 11.155 | 39.86666667 | 36585 | 26582 | 10.12323944 | 15.11737089 | 36613 | 26610 | 9.459677419 | 9.562724014 | 36641 | 26638 | 8.8046875 | 19.40625 |
| 36558 | 26555 | 11.12295082 | 28.15300546 | 36586 | 26583 | 10.09593023 | 28.52713178 | 36614 | 26611 | 9.43359375 | 29.46875 | 36642 | 26639 | 8.725877193 | 48.69005848 |
| 36559 | 26556 | 11.12226277 | 28.54014599 | 36587 | 26584 | 10.08333333 | 24.22222222 | 36615 | 26612 | 9.421686747 | 23.8313253 | 36643 | 26640 | 8.71484375 | 17.48958333 |
| 36560 | 26557 | 11.05769231 | 28.6025641 | 36588 | 26585 | 10.02022059 | 7.328431373 | 36616 | 26613 | 9.384 | 12.144 | 36644 | 26641 | 8.688888889 | 24.7037037 |
| 36561 | 26558 | 11.03629032 | 15.08602151 | 36589 | 26586 | 9.974489796 | 20.65306122 | 36617 | 26614 | 9.381578947 | 11.06766917 | 36645 | 26642 | 8.662828947 | 4.842105263 |
| 36562 | 26559 | 11.02083333 | 18.84722222 | 36590 | 26587 | 9.966666667 | 18.4 | 36618 | 26615 | 9.364285714 | 35.7047619 | 36646 | 26643 | 8.579365079 | 24.58201058 |
| 36563 | 26560 | 10.93442623 | 8.295081967 | 36591 | 26588 | 9.926886792 | 13.3081761 | 36619 | 26616 | 9.34375 | 2.601190476 | 36647 | 26644 | 8.579365079 | 22.87830688 |
| 36564 | 26561 | 10.93309859 | 28.07511737 | 36592 | 26589 | 9.91875 | 27.98333333 | 36620 | 26617 | 9.330188679 | 7.522012579 | 36648 | 26645 | 8.577083333 | 35.39444444 |

FIG. 5 (Cont.)

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36649 | 26646 | 8.573660714 | 19.98809524 | 36677 | 26674 | 7.7625 | 11.11666667 | 36705 | 26702 | 7.102941176 | 2.88627451 | 36733 | 26730 | 6.388888889 | 19.42222222 |
| 36650 | 26647 | 8.554878049 | 28.98373984 | 36678 | 26675 | 7.747368421 | 16.6245614 | 36706 | 26703 | 7.085858586 | 9.912457912 | 36734 | 26731 | 6.376237624 | 17.15511551 |
| 36651 | 26648 | 8.551282051 | 22.41025641 | 36679 | 26676 | 7.7265625 | 42.00694444 | 36707 | 26704 | 7.036713287 | 4.289044289 | 36735 | 26732 | 6.370098039 | 11.87581699 |
| 36652 | 26649 | 8.51 | 4.293333333 | 36680 | 26677 | 7.705 | 33.42666667 | 36708 | 26705 | 7.0078125 | 13.89583333 | 36736 | 26733 | 6.335648148 | 1.845679012 |
| 36653 | 26650 | 8.5 | 6.666666667 | 36681 | 26678 | 7.695488722 | 12.10526316 | 36709 | 26706 | 6.994845361 | 9.484536082 | 36737 | 26734 | 6.297619048 | 8.46984127 |
| 36654 | 26651 | 8.473684211 | 23.67251462 | 36682 | 26679 | 7.666666667 | 19.0994152 | 36710 | 26707 | 6.967647059 | 43.65490196 | 36738 | 26735 | 6.23364486 | 15.61993769 |
| 36655 | 26652 | 8.4453125 | 10.30208333 | 36683 | 26680 | 7.62755102 | 1.56462585 | 36711 | 26708 | 6.966346154 | 23.88461538 | 36739 | 26736 | 6.229166667 | 12.01111111 |
| 36656 | 26653 | 8.419642857 | 6.571428571 | 36684 | 26681 | 7.603618421 | 10.79385965 | 36712 | 26709 | 6.945544554 | 3.03630363 | 36740 | 26737 | 6.21 | 3.986666667 |
| 36657 | 26654 | 8.389344262 | 11.56284153 | 36685 | 26682 | 7.588435374 | 1.77324263 | 36713 | 26710 | 6.933823529 | 30.89215686 | 36741 | 26738 | 6.207386364 | 9.583333333 |
| 36658 | 26655 | 8.363636364 | 1.393939394 | 36686 | 26683 | 7.542207792 | 1.593073593 | 36714 | 26711 | 6.919491525 | 37.16384181 | 36742 | 26739 | 6.1875 | 35 |
| 36659 | 26656 | 8.327586207 | 7.402298851 | 36687 | 26684 | 7.542207792 | 12.34632035 | 36715 | 26712 | 6.916666667 | 14 | 36743 | 26740 | 6.123376623 | 20.11255411 |
| 36660 | 26657 | 8.305555556 | 10.22222222 | 36688 | 26685 | 7.519230769 | 4.717948718 | 36716 | 26713 | 6.866504854 | 6.401294498 | 36744 | 26741 | 6.119266055 | 25.18042813 |
| 36661 | 26658 | 8.25 | 21.11111111 | 36689 | 26686 | 7.475 | 28.11111111 | 36717 | 26714 | 6.864795918 | 29.57142857 | 36745 | 26742 | 6.109375 | 22.52083333 |
| 36662 | 26659 | 8.246710526 | 9.48245614 | 36690 | 26687 | 7.461309524 | 6.023809524 | 36718 | 26715 | 6.860795455 | 41.29545455 | 36746 | 26743 | 6.095 | 17.63333333 |
| 36663 | 26660 | 8.203333333 | 25.96444444 | 36691 | 26688 | 7.446721311 | 18.85245902 | 36719 | 26716 | 6.858433735 | 6.65060241 | 36747 | 26744 | 6.052631579 | 11.45964912 |
| 36664 | 26661 | 8.154545455 | 18.95757576 | 36692 | 26689 | 7.421182266 | 24.62397373 | 36720 | 26717 | 6.795454545 | 5.111111111 | 36748 | 26745 | 6.05 | 7.066666667 |
| 36665 | 26662 | 8.13961039 | 54.76190476 | 36693 | 26690 | 7.373529412 | 14.61176471 | 36721 | 26718 | 6.795454545 | 13.59090909 | 36749 | 26746 | 6.044871795 | 18.47863248 |
| 36666 | 26663 | 8.123015873 | 35.77777778 | 36694 | 26691 | 7.350515464 | 6.323024055 | 36722 | 26719 | 6.789156627 | 11.45381526 | 36750 | 26747 | 5.932539683 | 20.44444444 |
| 36667 | 26664 | 8.008928571 | 13.69047619 | 36695 | 26692 | 7.318181818 | 12.74458874 | 36723 | 26720 | 6.779850746 | 30.20895522 | 36751 | 26748 | 5.829861111 | 27.47222222 |
| 36668 | 26665 | 7.995238095 | 5.403174603 | 36696 | 26693 | 7.266483516 | 10.44688645 | 36724 | 26721 | 6.708333333 | 15.33333333 | 36752 | 26749 | 5.828767123 | 3.465753425 |
| 36669 | 26666 | 7.94047619 | 10.46560847 | 36697 | 26694 | 7.215686275 | 52.61437908 | 36725 | 26722 | 6.664772727 | 3.310606061 | 36753 | 26750 | 5.809895833 | 7.826388889 |
| 36670 | 26667 | 7.937116564 | 10.44171779 | 36698 | 26695 | 7.211864407 | 13.7740113 | 36726 | 26723 | 6.653571429 | 23.21904762 | 36754 | 26751 | 5.75 | 12.96031746 |
| 36671 | 26668 | 7.873076923 | 19.57948718 | 36699 | 26696 | 7.202020202 | 1.239057239 | 36727 | 26724 | 6.639175258 | 11.5395189 | 36755 | 26752 | 5.686813187 | 8.424908425 |
| 36672 | 26669 | 7.858333333 | 1.788888889 | 36700 | 26697 | 7.1875 | 18.14444444 | 36728 | 26725 | 6.603515625 | 5.270833333 | 36756 | 26753 | 5.673333333 | 21.67111111 |
| 36673 | 26670 | 7.840909091 | 13.01010101 | 36701 | 26698 | 7.168831169 | 8.761904762 | 36729 | 26726 | 6.563131313 | 8.518518519 | 36757 | 26754 | 5.588028169 | 21.16431925 |
| 36674 | 26671 | 7.834375 | 4.791666667 | 36702 | 26699 | 7.136160714 | 12.86904762 | 36730 | 26727 | 6.534090909 | 30.2020202 | 36758 | 26755 | 5.583333333 | 4.222222222 |
| 36675 | 26672 | 7.829787234 | 7.014184397 | 36703 | 26700 | 7.111842105 | 23.60526316 | 36731 | 26728 | 6.518895349 | 1.782945736 | 36759 | 26756 | 5.5625 | 15.83333333 |
| 36676 | 26673 | 7.803571429 | 12.86904762 | 36704 | 26701 | 7.107638889 | 10.64814815 | 36732 | 26729 | 6.415289256 | 4.435261708 | 36760 | 26757 | 5.553418803 | 7.601139601 |

FIG. 5 (Cont.)

| DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment | DNA SEQ ID NO | AA SEQ ID NO | Intestine 1 Enrichment | Intestine 2 Enrichment |
|---|---|---|---|---|---|---|---|---|---|---|---|---|---|---|---|
| 36761 | 26758 | 5.543413174 | 2.387225549 | 36789 | 26786 | 4.778169014 | 14.03755869 | 36817 | 26814 | 4.177350427 | 5.373219373 | 36845 | 26842 | 3.242021277 | 1.631205674 |
| 36762 | 26759 | 5.485632184 | 7.049808429 | 36790 | 26787 | 4.768292683 | 9.723577236 | 36818 | 26815 | 4.12007874 | 11.71128609 | 36846 | 26843 | 3.114583333 | 3.274305556 |
| 36763 | 26760 | 5.48255814 | 24.42635659 | 36791 | 26788 | 4.701257862 | 17.7442348 | 36819 | 26816 | 4.107142857 | 16.56547619 | 36847 | 26844 | 2.970833333 | 30.15555556 |
| 36764 | 26761 | 5.447368421 | 25.01754386 | 36792 | 26789 | 4.657024793 | 13.93939394 | 36820 | 26817 | 4.074503311 | 15.13024283 | 36848 | 26845 | 2.946517413 | 5.873963516 |
| 36765 | 26762 | 5.436363636 | 11.29090909 | 36793 | 26790 | 4.64893617 | 11.09219858 | 36821 | 26818 | 4.03358209 | 15.33333333 | 36849 | 26846 | 2.78343949 | 14.94267516 |
| 36766 | 26763 | 5.41954023 | 21.50191571 | 36794 | 26791 | 4.638655462 | 15.33333333 | 36822 | 26819 | 4.02919708 | 10.52068127 | 36850 | 26847 | 2.762987013 | 11.54978355 |
| 36767 | 26764 | 5.39380531 | 15.19764012 | 36795 | 26792 | 4.6 | 2.146666667 | 36823 | 26820 | 4.007575758 | 13.47474747 | 36851 | 26848 | 2.728813559 | 3.118644068 |
| 36768 | 26765 | 5.360169492 | 15.33333333 | 36796 | 26793 | 4.6 | 20.15238095 | 36824 | 26821 | 3.86882716 | 13.81893004 | 36852 | 26849 | 2.662751678 | 12.14317673 |
| 36769 | 26766 | 5.340504451 | 2.09297725 | 36797 | 26794 | 4.566176471 | 4.058823529 | 36825 | 26822 | 3.859589041 | 9.662100457 | 36853 | 26850 | 2.613636364 | 14.4969697 |
| 36770 | 26767 | 5.339285714 | 10.95238095 | 36798 | 26795 | 4.560344828 | 3.172413793 | 36826 | 26823 | 3.822972973 | 11.43783784 | 36854 | 26851 | 2.603773585 | 17.06918239 |
| 36771 | 26768 | 5.31512605 | 3.736694678 | 36799 | 26796 | 4.550359712 | 6.067146283 | 36827 | 26824 | 3.820205479 | 11.13242009 | 36855 | 26852 | 2.5875 | 5.466666667 |
| 36772 | 26769 | 5.313291139 | 21.73839662 | 36800 | 26797 | 4.533653846 | 1.474358974 | 36828 | 26825 | 3.73540146 | 4.476885645 | 36856 | 26853 | 2.570588235 | 11.99607843 |
| 36773 | 26770 | 5.307692308 | 5.111111111 | 36801 | 26798 | 4.526595745 | 11.9893617 | 36829 | 26826 | 3.72972973 | 3.522522523 | 36857 | 26854 | 2.520547945 | 2.310502283 |
| 36774 | 26771 | 5.302777778 | 10.73333333 | 36802 | 26799 | 4.512658228 | 5.434599156 | 36830 | 26827 | 3.706325301 | 8.036144578 | 36858 | 26855 | 2.430059524 | 3.924603175 |
| 36775 | 26772 | 5.29 | 23.92 | 36803 | 26800 | 4.486742424 | 18.58585859 | 36831 | 26828 | 3.62037037 | 21.86419753 | 36859 | 26856 | 2.421052632 | 1.614035088 |
| 36776 | 26773 | 5.278688525 | 41.72677596 | 36804 | 26801 | 4.477099237 | 8.661577608 | 36832 | 26829 | 3.581140351 | 14.52631579 | 36860 | 26857 | 2.395833333 | 1.916666667 |
| 36777 | 26774 | 5.239919355 | 1.360215054 | 36805 | 26802 | 4.405844156 | 8.463203463 | 36833 | 26830 | 3.574324324 | 16.16216216 | 36861 | 26858 | 2.392 | 7.728 |
| 36778 | 26775 | 5.163265306 | 26.59863946 | 36806 | 26803 | 4.38559322 | 7.536723164 | 36834 | 26831 | 3.538461538 | 28.30769231 | 36862 | 26859 | 2.388461538 | 21.23076923 |
| 36779 | 26776 | 5.116525424 | 12.47457627 | 36807 | 26804 | 4.371900826 | 12.67217631 | 36835 | 26832 | 3.529100529 | 16.14462081 | 36863 | 26860 | 2.140277778 | 6.388888889 |
| 36780 | 26777 | 5.111111111 | 26.77248677 | 36808 | 26805 | 4.3125 | 6.426470588 | 36836 | 26833 | 3.528409091 | 45.12878788 | 36864 | 26861 | 2.12962963 | 10.22222222 |
| 36781 | 26778 | 5.106 | 8.096 | 36809 | 26806 | 4.300420168 | 6.056022409 | 36837 | 26834 | 3.508027523 | 6.119266055 | 36865 | 26862 | 2.101724138 | 6.133333333 |
| 36782 | 26779 | 5.100806452 | 26.70967742 | 36810 | 26807 | 4.291666667 | 11.33333333 | 36838 | 26835 | 3.47754491 | 12.11976048 | 36866 | 26863 | 2.100961538 | 1.081196581 |
| 36783 | 26780 | 5.090163934 | 30.66666667 | 36811 | 26808 | 4.264583333 | 12.65 | 36839 | 26836 | 3.473958333 | 4.791666667 | 36867 | 26864 | 2.096354167 | 3.833333333 |
| 36784 | 26781 | 4.983333333 | 39.86666667 | 36812 | 26809 | 4.259259259 | 9.512345679 | 36840 | 26837 | 3.45 | 12.44705882 | 36868 | 26865 | 1.651282051 | 6.526495726 |
| 36785 | 26782 | 4.956896552 | 43.09195402 | 36813 | 26810 | 4.241803279 | 13.95081967 | 36841 | 26838 | 3.45 | 30.66666667 | 36869 | 26866 | 1.515909091 | 6.83030303 |
| 36786 | 26783 | 4.938235294 | 11.00392157 | 36814 | 26811 | 4.224489796 | 21.59183673 | 36842 | 26839 | 3.375621891 | 7.781094527 | 36870 | 26867 | 1.419753086 | 12.49382716 |
| 36787 | 26784 | 4.810096154 | 7.224358974 | 36815 | 26812 | 4.216666667 | 12.13888889 | 36843 | 26840 | 3.354166667 | 26.83333333 | 36871 | 26868 | 1.384259259 | 40.60493827 |
| 36788 | 26785 | 4.799586777 | 8.743801653 | 36816 | 26813 | 4.2046875 | 7.1875 | 36844 | 26841 | 3.25 | 13.46666667 | 36872 | 26869 | 1.339805825 | 13.69579288 |

FIG. 5 (Cont.)

| 36873 | 26870 | 1.337209302 | 4.724806202 | 36874 | 26871 | 1.326923077 | 20.05128205 | 36875 | 26872 | 1.173469388 | 1.87755102 | 36876 | 26873 | 1.10106383 | 11.25531915 |

FIG. 6

| DNA SEQ ID NO | AA SEQ ID NO | Kidney 1 Enrichment |
|---|---|---|
| 36877 | 26874 | 376.1089744 |
| 36878 | 26875 | 335.3333333 |
| 36879 | 26876 | 312.1770833 |
| 36880 | 26877 | 63.52380952 |
| 36881 | 26878 | 50.66666667 |
| 36882 | 26879 | 42.77192982 |
| 36883 | 26880 | 40.88888889 |
| 36884 | 26881 | 38.33333333 |
| 36885 | 26882 | 36.24242424 |
| 36886 | 26883 | 35.77777778 |
| 36887 | 26884 | 30.66666667 |
| 36888 | 26885 | 30.66666667 |
| 36889 | 26886 | 30.66666667 |
| 36890 | 26887 | 30.66666667 |
| 36891 | 26888 | 29.76470588 |
| 36892 | 26889 | 28.75 |
| 36893 | 26890 | 25.875 |
| 36894 | 26891 | 25.19047619 |
| 36895 | 26892 | 23 |
| 36896 | 26893 | 20.44444444 |
| 36897 | 26894 | 19.93333333 |
| 36898 | 26895 | 19.71428571 |
| 36899 | 26896 | 18.4 |
| 36900 | 26897 | 18.28205128 |
| 36901 | 26898 | 17.25 |
| 36902 | 26899 | 16.61111111 |
| 36903 | 26900 | 16.51282051 |
| 36904 | 26901 | 16.29166667 |
| 36905 | 26902 | 15.63398693 |
| 36906 | 26903 | 15.33333333 |
| 36907 | 26904 | 15.33333333 |
| 36908 | 26905 | 15.33333333 |
| 36909 | 26906 | 15.33333333 |
| 36910 | 26907 | 15.33333333 |
| 36911 | 26908 | 15.33333333 |
| 36912 | 26909 | 15.33333333 |
| 36913 | 26910 | 14.91891892 |
| 36914 | 26911 | 14.88235294 |
| 36915 | 26912 | 14.48148148 |
| 36916 | 26913 | 13.74712644 |
| 36917 | 26914 | 13.62962963 |
| 36918 | 26915 | 13.14285714 |
| 36919 | 26916 | 13.14285714 |
| 36920 | 26917 | 13.14285714 |
| 36921 | 26918 | 12.77777778 |
| 36922 | 26919 | 12.77777778 |
| 36923 | 26920 | 12.54545455 |
| 36924 | 26921 | 12.54545455 |
| 36925 | 26922 | 12.20987654 |
| 36926 | 26923 | 12 |
| 36927 | 26924 | 11.92592593 |
| 36928 | 26925 | 11.81944444 |
| 36929 | 26926 | 11.5 |
| 36930 | 26927 | 11.2745098 |
| 36931 | 26928 | 11.2195122 |
| 36932 | 26929 | 11.15151515 |
| 36933 | 26930 | 10.95238095 |
| 36934 | 26931 | 10.95238095 |
| 36935 | 26932 | 10.69767442 |
| 36936 | 26933 | 10.36036036 |
| 36937 | 26934 | 10.22222222 |
| 36938 | 26935 | 10.22222222 |
| 36939 | 26936 | 10.22222222 |
| 36940 | 26937 | 10.22222222 |
| 36941 | 26938 | 10.22222222 |
| 36942 | 26939 | 10.22222222 |
| 36943 | 26940 | 10.22222222 |
| 36944 | 26941 | 10.22222222 |
| 36945 | 26942 | 10.22222222 |
| 36946 | 26943 | 10.09756098 |
| 36947 | 26944 | 10.07619048 |
| 36948 | 26945 | 10.0625 |
| 36949 | 26946 | 10.04597701 |
| 36950 | 26947 | 10.02564103 |
| 36951 | 26948 | 9.757575758 |
| 36952 | 26949 | 9.711111111 |
| 36953 | 26950 | 9.684210526 |
| 36954 | 26951 | 9.583333333 |
| 36955 | 26952 | 9.583333333 |
| 36956 | 26953 | 9.583333333 |
| 36957 | 26954 | 9.583333333 |
| 36958 | 26955 | 9.583333333 |
| 36959 | 26956 | 9.517241379 |
| 36960 | 26957 | 9.326460481 |
| 36961 | 26958 | 9.2 |
| 36962 | 26959 | 9.2 |
| 36963 | 26960 | 9.2 |
| 36964 | 26961 | 9.2 |
| 36965 | 26962 | 9.2 |
| 36966 | 26963 | 9.2 |
| 36967 | 26964 | 9.042735043 |
| 36968 | 26965 | 9.019607843 |
| 36969 | 26966 | 8.903225806 |
| 36970 | 26967 | 8.784722222 |
| 36971 | 26968 | 8.761904762 |
| 36972 | 26969 | 8.761904762 |
| 36973 | 26970 | 8.761904762 |
| 36974 | 26971 | 8.761904762 |
| 36975 | 26972 | 8.761904762 |
| 36976 | 26973 | 8.724137931 |
| 36977 | 26974 | 8.699763593 |
| 36978 | 26975 | 8.679245283 |
| 36979 | 26976 | 8.666666667 |
| 36980 | 26977 | 8.666666667 |
| 36981 | 26978 | 8.625 |
| 36982 | 26979 | 8.586666667 |
| 36983 | 26980 | 8.518518519 |
| 36984 | 26981 | 8.408602151 |
| 36985 | 26982 | 8.363636364 |
| 36986 | 26983 | 8.343137255 |
| 36987 | 26984 | 8.305555556 |
| 36988 | 26985 | 8.227642276 |
| 36989 | 26986 | 8.214285714 |
| 36990 | 26987 | 8.177777778 |
| 36991 | 26988 | 8.177777778 |
| 36992 | 26989 | 8.177777778 |
| 36993 | 26990 | 8.161290323 |
| 36994 | 26991 | 8.161290323 |
| 36995 | 26992 | 8.117647059 |
| 36996 | 26993 | 8.070175439 |
| 36997 | 26994 | 8.031746032 |
| 36998 | 26995 | 8.009950249 |
| 36999 | 26996 | 8 |
| 37000 | 26997 | 8 |
| 37001 | 26998 | 7.973333333 |
| 37002 | 26999 | 7.973333333 |
| 37003 | 27000 | 7.931034483 |
| 37004 | 27001 | 7.865247863 |
| 37005 | 27002 | 7.853658537 |
| 37006 | 27003 | 7.811320755 |
| 37007 | 27004 | 7.777777778 |
| 37008 | 27005 | 7.666666667 |
| 37009 | 27006 | 7.666666667 |
| 37010 | 27007 | 7.666666667 |
| 37011 | 27008 | 7.666666667 |

FIG. 6 (Cont.)

| DNA SEQ ID NO | AA SEQ ID NO | Kidney 1 Enrichment |
|---|---|---|
| 37012 | 27009 | 7.666666667 |
| 37013 | 27010 | 7.666666667 |
| 37014 | 27011 | 7.666666667 |
| 37015 | 27012 | 7.666666667 |
| 37016 | 27013 | 7.666666667 |
| 37017 | 27014 | 7.666666667 |
| 37018 | 27015 | 7.666666667 |
| 37019 | 27016 | 7.666666667 |
| 37020 | 27017 | 7.666666667 |
| 37021 | 27018 | 7.666666667 |
| 37022 | 27019 | 7.666666667 |
| 37023 | 27020 | 7.666666667 |
| 37024 | 27021 | 7.666666667 |
| 37025 | 27022 | 7.666666667 |
| 37026 | 27023 | 7.666666667 |
| 37027 | 27024 | 7.666666667 |
| 37028 | 27025 | 7.666666667 |
| 37029 | 27026 | 7.666666667 |
| 37030 | 27027 | 7.666666667 |
| 37031 | 27028 | 7.666666667 |
| 37032 | 27029 | 7.544973545 |
| 37033 | 27030 | 7.484126984 |
| 37034 | 27031 | 7.479674797 |
| 37035 | 27032 | 7.36 |
| 37036 | 27033 | 7.333333333 |
| 37037 | 27034 | 7.333333333 |
| 37038 | 27035 | 7.301587302 |
| 37039 | 27036 | 7.283333333 |
| 37040 | 27037 | 7.263157895 |
| 37041 | 27038 | 7.263157895 |
| 37042 | 27039 | 7.240740741 |
| 37043 | 27040 | 7.215686275 |
| 37044 | 27041 | 7.215686275 |
| 37045 | 27042 | 7.155555556 |
| 37046 | 27043 | 7.119047619 |
| 37047 | 27044 | 7.098765432 |
| 37048 | 27045 | 7.094527363 |
| 37049 | 27046 | 7.076923077 |
| 37050 | 27047 | 7.076923077 |
| 37051 | 27048 | 7.059628543 |
| 37052 | 27049 | 7.045045045 |
| 37053 | 27050 | 7.021806854 |
| 37054 | 27051 | 7.016949153 |
| 37055 | 27052 | 6.96969697 |
| 37056 | 27053 | 6.96969697 |
| 37057 | 27054 | 6.96969697 |
| 37058 | 27055 | 6.9 |
| 37059 | 27056 | 6.9 |
| 37060 | 27057 | 6.884353741 |
| 37061 | 27058 | 6.859649123 |
| 37062 | 27059 | 6.814814815 |
| 37063 | 27060 | 6.814814815 |
| 37064 | 27061 | 6.814814815 |
| 37065 | 27062 | 6.814814815 |
| 37066 | 27063 | 6.814814815 |
| 37067 | 27064 | 6.79047619 |
| 37068 | 27065 | 6.764705882 |
| 37069 | 27066 | 6.731707317 |
| 37070 | 27067 | 6.731707317 |
| 37071 | 27068 | 6.721461187 |
| 37072 | 27069 | 6.708333333 |
| 37073 | 27070 | 6.683760684 |
| 37074 | 27071 | 6.666666667 |
| 37075 | 27072 | 6.666666667 |
| 37076 | 27073 | 6.644444444 |
| 37077 | 27074 | 6.630630631 |
| 37078 | 27075 | 6.571428571 |
| 37079 | 27076 | 6.571428571 |
| 37080 | 27077 | 6.571428571 |
| 37081 | 27078 | 6.571428571 |
| 37082 | 27079 | 6.571428571 |
| 37083 | 27080 | 6.552706553 |
| 37084 | 27081 | 6.516666667 |
| 37085 | 27082 | 6.487179487 |
| 37086 | 27083 | 6.487179487 |
| 37087 | 27084 | 6.481099656 |
| 37088 | 27085 | 6.474074074 |
| 37089 | 27086 | 6.46875 |
| 37090 | 27087 | 6.456140351 |
| 37091 | 27088 | 6.456140351 |
| 37092 | 27089 | 6.456140351 |
| 37093 | 27090 | 6.44 |
| 37094 | 27091 | 6.418604651 |
| 37095 | 27092 | 6.374531835 |
| 37096 | 27093 | 6.372294372 |
| 37097 | 27094 | 6.357723577 |
| 37098 | 27095 | 6.344827586 |
| 37099 | 27096 | 6.31372549 |
| 37100 | 27097 | 6.31372549 |
| 37101 | 27098 | 6.290598291 |
| 37102 | 27099 | 6.290598291 |
| 37103 | 27100 | 6.284153005 |
| 37104 | 27101 | 6.278215223 |
| 37105 | 27102 | 6.272727273 |
| 37106 | 27103 | 6.272727273 |
| 37107 | 27104 | 6.272727273 |
| 37108 | 27105 | 6.24691358 |
| 37109 | 27106 | 6.24691358 |
| 37110 | 27107 | 6.24691358 |
| 37111 | 27108 | 6.24691358 |
| 37112 | 27109 | 6.24691358 |
| 37113 | 27110 | 6.229166667 |
| 37114 | 27111 | 6.229166667 |
| 37115 | 27112 | 6.19858156 |
| 37116 | 27113 | 6.19858156 |
| 37117 | 27114 | 6.187134503 |
| 37118 | 27115 | 6.133333333 |
| 37119 | 27116 | 6.133333333 |
| 37120 | 27117 | 6.133333333 |
| 37121 | 27118 | 6.133333333 |
| 37122 | 27119 | 6.133333333 |
| 37123 | 27120 | 6.133333333 |
| 37124 | 27121 | 6.133333333 |
| 37125 | 27122 | 6.133333333 |
| 37126 | 27123 | 6.133333333 |
| 37127 | 27124 | 6.133333333 |
| 37128 | 27125 | 6.084656085 |
| 37129 | 27126 | 6.075471698 |
| 37130 | 27127 | 6.052631579 |
| 37131 | 27128 | 6.052631579 |
| 37132 | 27129 | 6.04040404 |
| 37133 | 27130 | 6.04040404 |
| 37134 | 27131 | 6 |
| 37135 | 27132 | 6 |
| 37136 | 27133 | 5.983739837 |
| 37137 | 27134 | 5.97740113 |
| 37138 | 27135 | 5.97740113 |
| 37139 | 27136 | 5.97740113 |
| 37140 | 27137 | 5.97740113 |
| 37141 | 27138 | 5.97740113 |
| 37142 | 27139 | 5.962962963 |
| 37143 | 27140 | 5.962962963 |
| 37144 | 27141 | 5.945578231 |
| 37145 | 27142 | 5.935483871 |
| 37146 | 27143 | 5.935483871 |
| 37147 | 27144 | 5.914285714 |
| 37148 | 27145 | 5.897435897 |
| 37149 | 27146 | 5.841269841 |
| 37150 | 27147 | 5.841269841 |
| 37151 | 27148 | 5.841269841 |
| 37152 | 27149 | 5.841269841 |
| 37153 | 27150 | 5.801801802 |
| 37154 | 27151 | 5.786163522 |
| 37155 | 27152 | 5.75 |
| 37156 | 27153 | 5.75 |

FIG. 6 (Cont.)

| DNA SEQ ID NO | AA SEQ ID NO | Kidney 1 Enrichment |
|---|---|---|
| 37157 | 27154 | 5.75 |
| 37158 | 27155 | 5.75 |
| 37159 | 27156 | 5.75 |
| 37160 | 27157 | 5.75 |
| 37161 | 27158 | 5.75 |
| 37162 | 27159 | 5.75 |
| 37163 | 27160 | 5.75 |
| 37164 | 27161 | 5.75 |
| 37165 | 27162 | 5.717514124 |
| 37166 | 27163 | 5.705426357 |
| 37167 | 27164 | 5.695238095 |
| 37168 | 27165 | 5.695238095 |
| 37169 | 27166 | 5.679012346 |
| 37170 | 27167 | 5.679012346 |
| 37171 | 27168 | 5.679012346 |
| 37172 | 27169 | 5.679012346 |
| 37173 | 27170 | 5.649122807 |
| 37174 | 27171 | 5.649122807 |
| 37175 | 27172 | 5.649122807 |
| 37176 | 27173 | 5.637254902 |
| 37177 | 27174 | 5.632653061 |
| 37178 | 27175 | 5.632653061 |
| 37179 | 27176 | 5.622222222 |
| 37180 | 27177 | 5.622222222 |
| 37181 | 27178 | 5.622222222 |
| 37182 | 27179 | 5.609756098 |
| 37183 | 27180 | 5.609756098 |
| 37184 | 27181 | 5.609756098 |
| 37185 | 27182 | 5.609756098 |

| DNA SEQ ID NO | AA SEQ ID NO | Kidney 1 Enrichment |
|---|---|---|
| 37186 | 27183 | 5.597883598 |
| 37187 | 27184 | 5.586563307 |
| 37188 | 27185 | 5.575757576 |
| 37189 | 27186 | 5.575757576 |
| 37190 | 27187 | 5.575757576 |
| 37191 | 27188 | 5.575757576 |
| 37192 | 27189 | 5.575757576 |
| 37193 | 27190 | 5.575757576 |
| 37194 | 27191 | 5.575757576 |
| 37195 | 27192 | 5.56043956 |
| 37196 | 27193 | 5.555555556 |
| 37197 | 27194 | 5.551724138 |
| 37198 | 27195 | 5.551724138 |
| 37199 | 27196 | 5.551724138 |
| 37200 | 27197 | 5.542168675 |
| 37201 | 27198 | 5.537037037 |
| 37202 | 27199 | 5.537037037 |
| 37203 | 27200 | 5.537037037 |
| 37204 | 27201 | 5.530054645 |
| 37205 | 27202 | 5.530054645 |
| 37206 | 27203 | 5.510416667 |
| 37207 | 27204 | 5.504273504 |
| 37208 | 27205 | 5.492537313 |
| 37209 | 27206 | 5.476190476 |
| 37210 | 27207 | 5.476190476 |
| 37211 | 27208 | 5.476190476 |
| 37212 | 27209 | 5.476190476 |
| 37213 | 27210 | 5.476190476 |
| 37214 | 27211 | 5.476190476 |

| DNA SEQ ID NO | AA SEQ ID NO | Kidney 1 Enrichment |
|---|---|---|
| 37215 | 27212 | 5.457627119 |
| 37216 | 27213 | 5.455128205 |
| 37217 | 27214 | 5.447368421 |
| 37218 | 27215 | 5.440860215 |
| 37219 | 27216 | 5.430555556 |
| 37220 | 27217 | 5.430555556 |
| 37221 | 27218 | 5.425641026 |
| 37222 | 27219 | 5.411764706 |
| 37223 | 27220 | 5.411764706 |
| 37224 | 27221 | 5.411764706 |
| 37225 | 27222 | 5.411764706 |
| 37226 | 27223 | 5.395061728 |
| 37227 | 27224 | 5.390625 |
| 37228 | 27225 | 5.366666667 |
| 37229 | 27226 | 5.366666667 |
| 37230 | 27227 | 5.366666667 |
| 37231 | 27228 | 5.348837209 |
| 37232 | 27229 | 5.333333333 |
| 37233 | 27230 | 5.333333333 |
| 37234 | 27231 | 5.319727891 |
| 37235 | 27232 | 5.307692308 |
| 37236 | 27233 | 5.304504505 |
| 37237 | 27234 | 5.287356322 |
| 37238 | 27235 | 5.287356322 |
| 37239 | 27236 | 5.278688525 |
| 37240 | 27237 | 5.278688525 |
| 37241 | 27238 | 5.251141553 |
| 37242 | 27239 | 5.245614035 |
| 37243 | 27240 | 5.245614035 |

| DNA SEQ ID NO | AA SEQ ID NO | Kidney 1 Enrichment |
|---|---|---|
| 37244 | 27241 | 5.245614035 |
| 37245 | 27242 | 5.238888889 |
| 37246 | 27243 | 5.235772358 |
| 37247 | 27244 | 5.235772358 |
| 37248 | 27245 | 5.235772358 |
| 37249 | 27246 | 5.235772358 |
| 37250 | 27247 | 5.231372549 |
| 37251 | 27248 | 5.219858156 |
| 37252 | 27249 | 5.219858156 |
| 37253 | 27250 | 5.219858156 |
| 37254 | 27251 | 5.219858156 |
| 37255 | 27252 | 5.202380952 |
| 37256 | 27253 | 5.18627451 |
| 37257 | 27254 | 5.183098592 |
| 37258 | 27255 | 5.175 |
| 37259 | 27256 | 5.170542636 |
| 37260 | 27257 | 5.164912281 |
| 37261 | 27258 | 5.164912281 |
| 37262 | 27259 | 5.142276423 |
| 37263 | 27260 | 5.111111111 |
| 37264 | 27261 | 5.111111111 |
| 37265 | 27262 | 5.111111111 |
| 37266 | 27263 | 5.111111111 |
| 37267 | 27264 | 5.111111111 |
| 37268 | 27265 | 5.111111111 |
| 37269 | 27266 | 5.111111111 |
| 37270 | 27267 | 5.111111111 |
| 37271 | 27268 | 5.111111111 |
| 37272 | 27269 | 5.111111111 |

| DNA SEQ ID NO | AA SEQ ID NO | Kidney 1 Enrichment |
|---|---|---|
| 37273 | 27270 | 5.111111111 |
| 37274 | 27271 | 5.111111111 |
| 37275 | 27272 | 5.111111111 |
| 37276 | 27273 | 5.111111111 |
| 37277 | 27274 | 5.111111111 |
| 37278 | 27275 | 5.111111111 |
| 37279 | 27276 | 5.111111111 |
| 37280 | 27277 | 5.111111111 |
| 37281 | 27278 | 5.111111111 |
| 37282 | 27279 | 5.111111111 |
| 37283 | 27280 | 5.111111111 |
| 37284 | 27281 | 5.111111111 |
| 37285 | 27282 | 5.111111111 |
| 37286 | 27283 | 5.111111111 |
| 37287 | 27284 | 5.111111111 |
| 37288 | 27285 | 5.111111111 |
| 37289 | 27286 | 5.111111111 |
| 37290 | 27287 | 5.111111111 |
| 37291 | 27288 | 5.111111111 |
| 37292 | 27289 | 5.111111111 |
| 37293 | 27290 | 5.048780488 |
| 37294 | 27291 | 5.038095238 |
| 37295 | 27292 | 5.027322404 |
| 37296 | 27293 | 5.022988506 |
| 37297 | 27294 | 5.022988506 |
| 37298 | 27295 | 5.022988506 |
| 37299 | 27296 | 5.018181818 |
| 37300 | 27297 | 5.012820513 |
| 37301 | 27298 | 5.00990099 |

FIG. 6 (Cont.)

| DNA SEQ ID NO | AA SEQ ID NO | Kidney 1 Enrichment |
|---|---|---|
| 37302 | 27299 | 5.006802721 |
| 37303 | 27300 | 5 |
| 37304 | 27301 | 5 |
| 37305 | 27302 | 4.992248062 |
| 37306 | 27303 | 4.992248062 |
| 37307 | 27304 | 4.987951807 |
| 37308 | 27305 | 4.983333333 |
| 37309 | 27306 | 4.983333333 |
| 37310 | 27307 | 4.983333333 |
| 37311 | 27308 | 4.972972973 |
| 37312 | 27309 | 4.972972973 |
| 37313 | 27310 | 4.972972973 |
| 37314 | 27311 | 4.972972973 |
| 37315 | 27312 | 4.972972973 |
| 37316 | 27313 | 4.96713615 |
| 37317 | 27314 | 4.960784314 |
| 37318 | 27315 | 4.960784314 |
| 37319 | 27316 | 4.956228956 |
| 37320 | 27317 | 4.953846154 |
| 37321 | 27318 | 4.946236559 |
| 37322 | 27319 | 4.940740741 |
| 37323 | 27320 | 4.928571429 |
| 37324 | 27321 | 4.918238994 |
| 37325 | 27322 | 4.906666667 |
| 37326 | 27323 | 4.906666667 |
| 37327 | 27324 | 4.906666667 |
| 37328 | 27325 | 4.906666667 |
| 37329 | 27326 | 4.906666667 |
| 37330 | 27327 | 4.900343643 |

| DNA SEQ ID NO | AA SEQ ID NO | Kidney 1 Enrichment |
|---|---|---|
| 37331 | 27328 | 4.893617021 |
| 37332 | 27329 | 4.878787879 |
| 37333 | 27330 | 4.878787879 |
| 37334 | 27331 | 4.878787879 |
| 37335 | 27332 | 4.878787879 |
| 37336 | 27333 | 4.878787879 |
| 37337 | 27334 | 4.878787879 |
| 37338 | 27335 | 4.869369369 |
| 37339 | 27336 | 4.861788618 |
| 37340 | 27337 | 4.861788618 |
| 37341 | 27338 | 4.855555556 |
| 37342 | 27339 | 4.842105263 |
| 37343 | 27340 | 4.842105263 |
| 37344 | 27341 | 4.842105263 |
| 37345 | 27342 | 4.842105263 |
| 37346 | 27343 | 4.827160494 |
| 37347 | 27344 | 4.827160494 |
| 37348 | 27345 | 4.827160494 |
| 37349 | 27346 | 4.827160494 |
| 37350 | 27347 | 4.823970037 |
| 37351 | 27348 | 4.819047619 |
| 37352 | 27349 | 4.810457516 |
| 37353 | 27350 | 4.810457516 |
| 37354 | 27351 | 4.810457516 |
| 37355 | 27352 | 4.791666667 |
| 37356 | 27353 | 4.791666667 |
| 37357 | 27354 | 4.791666667 |
| 37358 | 27355 | 4.791666667 |
| 37359 | 27356 | 4.791666667 |

| DNA SEQ ID NO | AA SEQ ID NO | Kidney 1 Enrichment |
|---|---|---|
| 37360 | 27357 | 4.791666667 |
| 37361 | 27358 | 4.791666667 |
| 37362 | 27359 | 4.791666667 |
| 37363 | 27360 | 4.791666667 |
| 37364 | 27361 | 4.791666667 |
| 37365 | 27362 | 4.791666667 |
| 37366 | 27363 | 4.781362007 |
| 37367 | 27364 | 4.775956284 |
| 37368 | 27365 | 4.77037037 |
| 37369 | 27366 | 4.77037037 |
| 37370 | 27367 | 4.77037037 |
| 37371 | 27368 | 4.75862069 |
| 37372 | 27369 | 4.75862069 |
| 37373 | 27370 | 4.75862069 |
| 37374 | 27371 | 4.751173709 |
| 37375 | 27372 | 4.751173709 |
| 37376 | 27373 | 4.746031746 |
| 37377 | 27374 | 4.739393939 |
| 37378 | 27375 | 4.717948718 |
| 37379 | 27376 | 4.717948718 |
| 37380 | 27377 | 4.717948718 |
| 37381 | 27378 | 4.717948718 |
| 37382 | 27379 | 4.717948718 |
| 37383 | 27380 | 4.717948718 |
| 37384 | 27381 | 4.717948718 |
| 37385 | 27382 | 4.702222222 |
| 37386 | 27383 | 4.693877551 |
| 37387 | 27384 | 4.693877551 |
| 37388 | 27385 | 4.693877551 |

| DNA SEQ ID NO | AA SEQ ID NO | Kidney 1 Enrichment |
|---|---|---|
| 37389 | 27386 | 4.685185185 |
| 37390 | 27387 | 4.685185185 |
| 37391 | 27388 | 4.680701754 |
| 37392 | 27389 | 4.677966102 |
| 37393 | 27390 | 4.677966102 |
| 37394 | 27391 | 4.666666667 |
| 37395 | 27392 | 4.666666667 |
| 37396 | 27393 | 4.654761905 |
| 37397 | 27394 | 4.646464646 |
| 37398 | 27395 | 4.635658915 |
| 37399 | 27396 | 4.635658915 |
| 37400 | 27397 | 4.628930818 |
| 37401 | 27398 | 4.624338624 |
| 37402 | 27399 | 4.624338624 |
| 37403 | 27400 | 4.621004566 |
| 37404 | 27401 | 4.6 |
| 37405 | 27402 | 4.6 |
| 37406 | 27403 | 4.6 |
| 37407 | 27404 | 4.6 |
| 37408 | 27405 | 4.6 |
| 37409 | 27406 | 4.6 |
| 37410 | 27407 | 4.6 |
| 37411 | 27408 | 4.6 |
| 37412 | 27409 | 4.6 |
| 37413 | 27410 | 4.6 |
| 37414 | 27411 | 4.6 |
| 37415 | 27412 | 4.6 |
| 37416 | 27413 | 4.6 |
| 37417 | 27414 | 4.6 |

| DNA SEQ ID NO | AA SEQ ID NO | Kidney 1 Enrichment |
|---|---|---|
| 37418 | 27415 | 4.6 |
| 37419 | 27416 | 4.6 |
| 37420 | 27417 | 4.58008658 |
| 37421 | 27418 | 4.58008658 |
| 37422 | 27419 | 4.577114428 |
| 37423 | 27420 | 4.567375887 |
| 37424 | 27421 | 4.567375887 |
| 37425 | 27422 | 4.567375887 |
| 37426 | 27423 | 4.567375887 |
| 37427 | 27424 | 4.558558559 |
| 37428 | 27425 | 4.549450549 |
| 37429 | 27426 | 4.543209877 |
| 37430 | 27427 | 4.543209877 |
| 37431 | 27428 | 4.543209877 |
| 37432 | 27429 | 4.535211268 |
| 37433 | 27430 | 4.53030303 |
| 37434 | 27431 | 4.524590164 |
| 37435 | 27432 | 4.524590164 |
| 37436 | 27433 | 4.519298246 |
| 37437 | 27434 | 4.509803922 |
| 37438 | 27435 | 4.509803922 |
| 37439 | 27436 | 4.509803922 |
| 37440 | 27437 | 4.509803922 |
| 37441 | 27438 | 4.509803922 |
| 37442 | 27439 | 4.509803922 |
| 37443 | 27440 | 4.509803922 |
| 37444 | 27441 | 4.494252874 |
| 37445 | 27442 | 4.487804878 |
| 37446 | 27443 | 4.487804878 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 37447 | 27444 | 4.487804878 | 37476 | 27473 | 4.380952381 | 37505 | 27502 | 4.293333333 | 37534 | 27531 | 4.209150327 | 37563 | 27560 | 4.121863799 |
| 37448 | 27445 | 4.482051282 | 37477 | 27474 | 4.380952381 | 37506 | 27503 | 4.293333333 | 37535 | 27532 | 4.206489676 | 37564 | 27561 | 4.119402985 |
| 37449 | 27446 | 4.479400749 | 37478 | 27475 | 4.380952381 | 37507 | 27504 | 4.293333333 | 37536 | 27533 | 4.204301075 | 37565 | 27562 | 4.113821138 |
| 37450 | 27447 | 4.479400749 | 37479 | 27476 | 4.380952381 | 37508 | 27505 | 4.293333333 | 37537 | 27534 | 4.204301075 | 37566 | 27563 | 4.113821138 |
| 37451 | 27448 | 4.472222222 | 37480 | 27477 | 4.380952381 | 37509 | 27506 | 4.293333333 | 37538 | 27535 | 4.204301075 | 37567 | 27564 | 4.113821138 |
| 37452 | 27449 | 4.472222222 | 37481 | 27478 | 4.380952381 | 37510 | 27507 | 4.282282282 | 37539 | 27536 | 4.204301075 | 37568 | 27565 | 4.088888889 |
| 37453 | 27450 | 4.472222222 | 37482 | 27479 | 4.380952381 | 37511 | 27508 | 4.279069767 | 37540 | 27537 | 4.204301075 | 37569 | 27566 | 4.088888889 |
| 37454 | 27451 | 4.472222222 | 37483 | 27480 | 4.380952381 | 37512 | 27509 | 4.279069767 | 37541 | 27538 | 4.198412698 | 37570 | 27567 | 4.088888889 |
| 37455 | 27452 | 4.460606061 | 37484 | 27481 | 4.380952381 | 37513 | 27510 | 4.279069767 | 37542 | 27539 | 4.193732194 | 37571 | 27568 | 4.088888889 |
| 37456 | 27453 | 4.457364341 | 37485 | 27482 | 4.380952381 | 37514 | 27511 | 4.279069767 | 37543 | 27540 | 4.192708333 | 37572 | 27569 | 4.088888889 |
| 37457 | 27454 | 4.451612903 | 37486 | 27483 | 4.380952381 | 37515 | 27512 | 4.279069767 | 37544 | 27541 | 4.181818182 | 37573 | 27570 | 4.088888889 |
| 37458 | 27455 | 4.451612903 | 37487 | 27484 | 4.380952381 | 37516 | 27513 | 4.279069767 | 37545 | 27542 | 4.181818182 | 37574 | 27571 | 4.088888889 |
| 37459 | 27456 | 4.451612903 | 37488 | 27485 | 4.380952381 | 37517 | 27514 | 4.279069767 | 37546 | 27543 | 4.181818182 | 37575 | 27572 | 4.088888889 |
| 37460 | 27457 | 4.451612903 | 37489 | 27486 | 4.348258706 | 37518 | 27515 | 4.273224044 | 37547 | 27544 | 4.171568627 | 37576 | 27573 | 4.088888889 |
| 37461 | 27458 | 4.438596491 | 37490 | 27487 | 4.348258706 | 37519 | 27516 | 4.273224044 | 37548 | 27545 | 4.164609053 | 37577 | 27574 | 4.088888889 |
| 37462 | 27459 | 4.438596491 | 37491 | 27488 | 4.344444444 | 37520 | 27517 | 4.266666667 | 37549 | 27546 | 4.164609053 | 37578 | 27575 | 4.088888889 |
| 37463 | 27460 | 4.438596491 | 37492 | 27489 | 4.344444444 | 37521 | 27518 | 4.259259259 | 37550 | 27547 | 4.161904762 | 37579 | 27576 | 4.088888889 |
| 37464 | 27461 | 4.42962963 | 37493 | 27490 | 4.344444444 | 37522 | 27519 | 4.259259259 | 37551 | 27548 | 4.15819209 | 37580 | 27577 | 4.072916667 |
| 37465 | 27462 | 4.42962963 | 37494 | 27491 | 4.339622642 | 37523 | 27520 | 4.259259259 | 37552 | 27549 | 4.152777778 | 37581 | 27578 | 4.072916667 |
| 37466 | 27463 | 4.423076923 | 37495 | 27492 | 4.339622642 | 37524 | 27521 | 4.259259259 | 37553 | 27550 | 4.152777778 | 37582 | 27579 | 4.072916667 |
| 37467 | 27464 | 4.414141414 | 37496 | 27493 | 4.333333333 | 37525 | 27522 | 4.246153846 | 37554 | 27551 | 4.152777778 | 37583 | 27580 | 4.072916667 |
| 37468 | 27465 | 4.414141414 | 37497 | 27494 | 4.333333333 | 37526 | 27523 | 4.236842105 | 37555 | 27552 | 4.152777778 | 37584 | 27581 | 4.072916667 |
| 37469 | 27466 | 4.410958904 | 37498 | 27495 | 4.319248826 | 37527 | 27524 | 4.229885057 | 37556 | 27553 | 4.152777778 | 37585 | 27582 | 4.068027211 |
| 37470 | 27467 | 4.408333333 | 37499 | 27496 | 4.3125 | 37528 | 27525 | 4.229885057 | 37557 | 27554 | 4.152777778 | 37586 | 27583 | 4.064257028 |
| 37471 | 27468 | 4.406130268 | 37500 | 27497 | 4.304093567 | 37529 | 27526 | 4.229885057 | 37558 | 27555 | 4.15037594 | 37587 | 27584 | 4.058823529 |
| 37472 | 27469 | 4.406130268 | 37501 | 27498 | 4.304093567 | 37530 | 27527 | 4.224489796 | 37559 | 27556 | 4.144144144 | 37588 | 27585 | 4.058823529 |
| 37473 | 27470 | 4.380952381 | 37502 | 27499 | 4.300813008 | 37531 | 27528 | 4.216666667 | 37560 | 27557 | 4.128205128 | 37589 | 27586 | 4.058823529 |
| 37474 | 27471 | 4.380952381 | 37503 | 27500 | 4.300813008 | 37532 | 27529 | 4.212454212 | 37561 | 27558 | 4.128205128 | 37590 | 27587 | 4.050314465 |
| 37475 | 27472 | 4.380952381 | 37504 | 27501 | 4.293333333 | 37533 | 27530 | 4.211267606 | 37562 | 27559 | 4.121863799 | 37591 | 27588 | 4.046296296 |

FIG. 6 (Cont.)

| DNA SEQ ID NO | AA SEQ ID NO | Kidney 1 Enrichment |
|---|---|---|
| 37592 | 27589 | 4.044989775 |
| 37593 | 27590 | 4.035087719 |
| 37594 | 27591 | 4.035087719 |
| 37595 | 27592 | 4.035087719 |
| 37596 | 27593 | 4.035087719 |
| 37597 | 27594 | 4.035087719 |
| 37598 | 27595 | 4.035087719 |
| 37599 | 27596 | 4.035087719 |
| 37600 | 27597 | 4.021857923 |
| 37601 | 27598 | 4.019417476 |
| 37602 | 27599 | 4.015873016 |
| 37603 | 27600 | 4.015873016 |
| 37604 | 27601 | 4.015873016 |
| 37605 | 27602 | 4.01025641 |
| 37606 | 27603 | 4.01025641 |
| 37607 | 27604 | 4.01025641 |
| 37608 | 27605 | 4 |
| 37609 | 27606 | 4 |
| 37610 | 27607 | 4 |
| 37611 | 27608 | 4 |
| 37612 | 27609 | 4 |
| 37613 | 27610 | 4 |
| 37614 | 27611 | 4 |
| 37615 | 27612 | 4 |
| 37616 | 27613 | 4 |
| 37617 | 27614 | 4 |
| 37618 | 27615 | 4 |
| 37619 | 27616 | 4 |
| 37620 | 27617 | 3.986666667 |

| DNA SEQ ID NO | AA SEQ ID NO | Kidney 1 Enrichment |
|---|---|---|
| 37621 | 27618 | 3.986666667 |
| 37622 | 27619 | 3.984251969 |
| 37623 | 27620 | 3.982683983 |
| 37624 | 27621 | 3.975308642 |
| 37625 | 27622 | 3.975308642 |
| 37626 | 27623 | 3.975308642 |
| 37627 | 27624 | 3.975308642 |
| 37628 | 27625 | 3.975308642 |
| 37629 | 27626 | 3.975308642 |
| 37630 | 27627 | 3.965517241 |
| 37631 | 27628 | 3.965517241 |
| 37632 | 27629 | 3.961111111 |
| 37633 | 27630 | 3.956989247 |
| 37634 | 27631 | 3.956989247 |
| 37635 | 27632 | 3.956989247 |
| 37636 | 27633 | 3.949494949 |
| 37637 | 27634 | 3.947194719 |
| 37638 | 27635 | 3.942857143 |
| 37639 | 27636 | 3.942857143 |
| 37640 | 27637 | 3.942857143 |
| 37641 | 27638 | 3.936936937 |
| 37642 | 27639 | 3.931623932 |
| 37643 | 27640 | 3.931623932 |
| 37644 | 27641 | 3.926829268 |
| 37645 | 27642 | 3.92248062 |
| 37646 | 27643 | 3.92248062 |
| 37647 | 27644 | 3.92248062 |
| 37648 | 27645 | 3.92248062 |
| 37649 | 27646 | 3.919799499 |

| DNA SEQ ID NO | AA SEQ ID NO | Kidney 1 Enrichment |
|---|---|---|
| 37650 | 27647 | 3.914893617 |
| 37651 | 27648 | 3.914893617 |
| 37652 | 27649 | 3.908496732 |
| 37653 | 27650 | 3.908496732 |
| 37654 | 27651 | 3.908496732 |
| 37655 | 27652 | 3.905660377 |
| 37656 | 27653 | 3.905660377 |
| 37657 | 27654 | 3.903030303 |
| 37658 | 27655 | 3.903030303 |
| 37659 | 27656 | 3.898305085 |
| 37660 | 27657 | 3.898305085 |
| 37661 | 27658 | 3.898305085 |
| 37662 | 27659 | 3.898305085 |
| 37663 | 27660 | 3.898305085 |
| 37664 | 27661 | 3.898305085 |
| 37665 | 27662 | 3.888888889 |
| 37666 | 27663 | 3.887323944 |
| 37667 | 27664 | 3.884444444 |
| 37668 | 27665 | 3.878431373 |
| 37669 | 27666 | 3.877394636 |
| 37670 | 27667 | 3.877394636 |
| 37671 | 27668 | 3.875457875 |
| 37672 | 27669 | 3.873684211 |
| 37673 | 27670 | 3.870550162 |
| 37674 | 27671 | 3.861728395 |
| 37675 | 27672 | 3.833333333 |
| 37676 | 27673 | 3.833333333 |
| 37677 | 27674 | 3.833333333 |
| 37678 | 27675 | 3.833333333 |

| DNA SEQ ID NO | AA SEQ ID NO | Kidney 1 Enrichment |
|---|---|---|
| 37679 | 27676 | 3.833333333 |
| 37680 | 27677 | 3.833333333 |
| 37681 | 27678 | 3.833333333 |
| 37682 | 27679 | 3.833333333 |
| 37683 | 27680 | 3.833333333 |
| 37684 | 27681 | 3.833333333 |
| 37685 | 27682 | 3.833333333 |
| 37686 | 27683 | 3.833333333 |
| 37687 | 27684 | 3.833333333 |
| 37688 | 27685 | 3.833333333 |
| 37689 | 27686 | 3.833333333 |
| 37690 | 27687 | 3.833333333 |
| 37691 | 27688 | 3.833333333 |
| 37692 | 27689 | 3.833333333 |
| 37693 | 27690 | 3.833333333 |
| 37694 | 27691 | 3.833333333 |
| 37695 | 27692 | 3.833333333 |
| 37696 | 27693 | 3.833333333 |
| 37697 | 27694 | 3.833333333 |
| 37698 | 27695 | 3.833333333 |
| 37699 | 27696 | 3.833333333 |
| 37700 | 27697 | 3.833333333 |
| 37701 | 27698 | 3.833333333 |
| 37702 | 27699 | 3.833333333 |
| 37703 | 27700 | 3.833333333 |
| 37704 | 27701 | 3.833333333 |
| 37705 | 27702 | 3.833333333 |
| 37706 | 27703 | 3.833333333 |
| 37707 | 27704 | 3.833333333 |

| DNA SEQ ID NO | AA SEQ ID NO | Kidney 1 Enrichment |
|---|---|---|
| 37708 | 27705 | 3.833333333 |
| 37709 | 27706 | 3.833333333 |
| 37710 | 27707 | 3.833333333 |
| 37711 | 27708 | 3.833333333 |
| 37712 | 27709 | 3.833333333 |
| 37713 | 27710 | 3.833333333 |
| 37714 | 27711 | 3.833333333 |
| 37715 | 27712 | 3.833333333 |
| 37716 | 27713 | 3.833333333 |
| 37717 | 27714 | 3.833333333 |
| 37718 | 27715 | 3.833333333 |
| 37719 | 27716 | 3.833333333 |
| 37720 | 27717 | 3.833333333 |
| 37721 | 27718 | 3.833333333 |
| 37722 | 27719 | 3.833333333 |
| 37723 | 27720 | 3.833333333 |
| 37724 | 27721 | 3.833333333 |
| 37725 | 27722 | 3.833333333 |
| 37726 | 27723 | 3.833333333 |
| 37727 | 27724 | 3.833333333 |
| 37728 | 27725 | 3.804511278 |
| 37729 | 27726 | 3.798165138 |
| 37730 | 27727 | 3.793814433 |
| 37731 | 27728 | 3.792114695 |
| 37732 | 27729 | 3.790262172 |
| 37733 | 27730 | 3.788235294 |
| 37734 | 27731 | 3.78600823 |
| 37735 | 27732 | 3.783549784 |
| 37736 | 27733 | 3.783549784 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 37737 | 27734 | 3.780821918 | 37766 | 27763 | 3.717171717 | 37795 | 27792 | 3.647849462 | 37824 | 27821 | 3.577777778 | 37853 | 27850 | 3.538461538 |
| 37738 | 27735 | 3.770491803 | 37767 | 27764 | 3.712280702 | 37796 | 27793 | 3.635738832 | 37825 | 27822 | 3.577777778 | 37854 | 27851 | 3.538461538 |
| 37739 | 27736 | 3.770491803 | 37768 | 27765 | 3.709677419 | 37797 | 27794 | 3.631578947 | 37826 | 27823 | 3.577777778 | 37855 | 27852 | 3.538461538 |
| 37740 | 27737 | 3.766081871 | 37769 | 27766 | 3.701149425 | 37798 | 27795 | 3.631578947 | 37827 | 27824 | 3.577777778 | 37856 | 27853 | 3.538461538 |
| 37741 | 27738 | 3.766081871 | 37770 | 27767 | 3.701149425 | 37799 | 27796 | 3.624242424 | 37828 | 27825 | 3.577777778 | 37857 | 27854 | 3.538461538 |
| 37742 | 27739 | 3.766081871 | 37771 | 27768 | 3.701149425 | 37800 | 27797 | 3.624242424 | 37829 | 27826 | 3.577777778 | 37858 | 27855 | 3.526666667 |
| 37743 | 27740 | 3.761006289 | 37772 | 27769 | 3.694779116 | 37801 | 27798 | 3.624242424 | 37830 | 27827 | 3.577777778 | 37859 | 27856 | 3.524904215 |
| 37744 | 27741 | 3.761006289 | 37773 | 27770 | 3.694779116 | 37802 | 27799 | 3.622047244 | 37831 | 27828 | 3.570776256 | 37860 | 27857 | 3.522522523 |
| 37745 | 27742 | 3.761006289 | 37774 | 27771 | 3.691358025 | 37803 | 27800 | 3.62037037 | 37832 | 27829 | 3.565891473 | 37861 | 27858 | 3.520987654 |
| 37746 | 27743 | 3.761006289 | 37775 | 27772 | 3.691358025 | 37804 | 27801 | 3.62037037 | 37833 | 27830 | 3.55952381 | 37862 | 27859 | 3.519125683 |
| 37747 | 27744 | 3.755102041 | 37776 | 27773 | 3.691358025 | 37805 | 27802 | 3.617977528 | 37834 | 27831 | 3.55952381 | 37863 | 27860 | 3.513888889 |
| 37748 | 27745 | 3.75177305 | 37777 | 27774 | 3.691358025 | 37806 | 27803 | 3.617977528 | 37835 | 27832 | 3.55952381 | 37864 | 27861 | 3.513888889 |
| 37749 | 27746 | 3.748148148 | 37778 | 27775 | 3.68 | 37807 | 27804 | 3.616352201 | 37836 | 27833 | 3.555555556 | 37865 | 27862 | 3.510040161 |
| 37750 | 27747 | 3.748148148 | 37779 | 27776 | 3.68 | 37808 | 27805 | 3.607843137 | 37837 | 27834 | 3.555555556 | 37866 | 27863 | 3.504761905 |
| 37751 | 27748 | 3.748148148 | 37780 | 27777 | 3.68 | 37809 | 27806 | 3.607843137 | 37838 | 27835 | 3.555555556 | 37867 | 27864 | 3.504761905 |
| 37752 | 27749 | 3.744186047 | 37781 | 27778 | 3.68 | 37810 | 27807 | 3.607843137 | 37839 | 27836 | 3.550877193 | 37868 | 27865 | 3.504761905 |
| 37753 | 27750 | 3.739837398 | 37782 | 27779 | 3.68 | 37811 | 27808 | 3.607843137 | 37840 | 27837 | 3.549382716 | 37869 | 27866 | 3.504761905 |
| 37754 | 27751 | 3.735042735 | 37783 | 27780 | 3.68 | 37812 | 27809 | 3.607843137 | 37841 | 27838 | 3.538461538 | 37870 | 27867 | 3.504761905 |
| 37755 | 27752 | 3.72972973 | 37784 | 27781 | 3.68 | 37813 | 27810 | 3.607843137 | 37842 | 27839 | 3.538461538 | 37871 | 27868 | 3.504761905 |
| 37756 | 27753 | 3.72972973 | 37785 | 27782 | 3.671361502 | 37814 | 27811 | 3.607843137 | 37843 | 27840 | 3.538461538 | 37872 | 27869 | 3.5 |
| 37757 | 27754 | 3.72972973 | 37786 | 27783 | 3.666666667 | 37815 | 27812 | 3.607843137 | 37844 | 27841 | 3.538461538 | 37873 | 27870 | 3.497076023 |
| 37758 | 27755 | 3.72972973 | 37787 | 27784 | 3.661691542 | 37816 | 27813 | 3.607843137 | 37845 | 27842 | 3.538461538 | 37874 | 27871 | 3.497076023 |
| 37759 | 27756 | 3.723809524 | 37788 | 27785 | 3.659090909 | 37817 | 27814 | 3.601010101 | 37846 | 27843 | 3.538461538 | 37875 | 27872 | 3.495098039 |
| 37760 | 27757 | 3.721682848 | 37789 | 27786 | 3.650793651 | 37818 | 27815 | 3.596707819 | 37847 | 27844 | 3.538461538 | 37876 | 27873 | 3.491749175 |
| 37761 | 27758 | 3.717171717 | 37790 | 27787 | 3.650793651 | 37819 | 27816 | 3.588652482 | 37848 | 27845 | 3.538461538 | 37877 | 27874 | 3.490514905 |
| 37762 | 27759 | 3.717171717 | 37791 | 27788 | 3.650793651 | 37820 | 27817 | 3.588652482 | 37849 | 27846 | 3.538461538 | 37878 | 27875 | 3.487581699 |
| 37763 | 27760 | 3.717171717 | 37792 | 27789 | 3.650793651 | 37821 | 27818 | 3.588652482 | 37850 | 27847 | 3.538461538 | 37879 | 27876 | 3.484848485 |
| 37764 | 27761 | 3.717171717 | 37793 | 27790 | 3.650793651 | 37822 | 27819 | 3.584415584 | 37851 | 27848 | 3.538461538 | 37880 | 27877 | 3.484848485 |
| 37765 | 27762 | 3.717171717 | 37794 | 27791 | 3.650793651 | 37823 | 27820 | 3.582554517 | 37852 | 27849 | 3.538461538 | 37881 | 27878 | 3.484848485 |

FIG. 6 (Cont.)

| DNA SEQ ID NO | AA SEQ ID NO | Kidney 1 Enrichment |
|---|---|---|
| 37882 | 27879 | 3.484848485 |
| 37883 | 27880 | 3.484848485 |
| 37884 | 27881 | 3.484848485 |
| 37885 | 27882 | 3.484848485 |
| 37886 | 27883 | 3.471698113 |
| 37887 | 27884 | 3.471698113 |
| 37888 | 27885 | 3.471698113 |
| 37889 | 27886 | 3.462365591 |
| 37890 | 27887 | 3.462365591 |
| 37891 | 27888 | 3.462365591 |
| 37892 | 27889 | 3.462365591 |
| 37893 | 27890 | 3.462365591 |
| 37894 | 27891 | 3.462365591 |
| 37895 | 27892 | 3.462365591 |
| 37896 | 27893 | 3.462365591 |
| 37897 | 27894 | 3.462365591 |
| 37898 | 27895 | 3.455399061 |
| 37899 | 27896 | 3.453453453 |
| 37900 | 27897 | 3.45 |
| 37901 | 27898 | 3.45 |
| 37902 | 27899 | 3.45 |
| 37903 | 27900 | 3.45 |
| 37904 | 27901 | 3.45 |
| 37905 | 27902 | 3.45 |
| 37906 | 27903 | 3.445692884 |
| 37907 | 27904 | 3.445692884 |
| 37908 | 27905 | 3.444444444 |
| 37909 | 27906 | 3.436781609 |
| 37910 | 27907 | 3.436781609 |

| DNA SEQ ID NO | AA SEQ ID NO | Kidney 1 Enrichment |
|---|---|---|
| 37911 | 27908 | 3.436781609 |
| 37912 | 27909 | 3.434666667 |
| 37913 | 27910 | 3.432835821 |
| 37914 | 27911 | 3.429824561 |
| 37915 | 27912 | 3.429824561 |
| 37916 | 27913 | 3.42745098 |
| 37917 | 27914 | 3.425531915 |
| 37918 | 27915 | 3.407407407 |
| 37919 | 27916 | 3.407407407 |
| 37920 | 27917 | 3.407407407 |
| 37921 | 27918 | 3.407407407 |
| 37922 | 27919 | 3.407407407 |
| 37923 | 27920 | 3.407407407 |
| 37924 | 27921 | 3.407407407 |
| 37925 | 27922 | 3.407407407 |
| 37926 | 27923 | 3.407407407 |
| 37927 | 27924 | 3.407407407 |
| 37928 | 27925 | 3.407407407 |
| 37929 | 27926 | 3.407407407 |
| 37930 | 27927 | 3.407407407 |
| 37931 | 27928 | 3.407407407 |
| 37932 | 27929 | 3.407407407 |
| 37933 | 27930 | 3.407407407 |
| 37934 | 27931 | 3.407407407 |
| 37935 | 27932 | 3.407407407 |
| 37936 | 27933 | 3.407407407 |
| 37937 | 27934 | 3.407407407 |
| 37938 | 27935 | 3.407407407 |
| 37939 | 27936 | 3.407407407 |

| DNA SEQ ID NO | AA SEQ ID NO | Kidney 1 Enrichment |
|---|---|---|
| 37940 | 27937 | 3.407407407 |
| 37941 | 27938 | 3.407407407 |
| 37942 | 27939 | 3.407407407 |
| 37943 | 27940 | 3.407407407 |
| 37944 | 27941 | 3.407407407 |
| 37945 | 27942 | 3.407407407 |
| 37946 | 27943 | 3.389473684 |
| 37947 | 27944 | 3.382352941 |
| 37948 | 27945 | 3.378531073 |
| 37949 | 27946 | 3.378531073 |
| 37950 | 27947 | 3.373333333 |
| 37951 | 27948 | 3.373333333 |
| 37952 | 27949 | 3.373333333 |
| 37953 | 27950 | 3.36996337 |
| 37954 | 27951 | 3.365853659 |
| 37955 | 27952 | 3.365853659 |
| 37956 | 27953 | 3.365853659 |
| 37957 | 27954 | 3.360730594 |
| 37958 | 27955 | 3.360730594 |
| 37959 | 27956 | 3.354166667 |
| 37960 | 27957 | 3.354166667 |
| 37961 | 27958 | 3.354166667 |
| 37962 | 27959 | 3.354166667 |
| 37963 | 27960 | 3.354166667 |
| 37964 | 27961 | 3.354166667 |
| 37965 | 27962 | 3.354166667 |
| 37966 | 27963 | 3.354166667 |
| 37967 | 27964 | 3.354166667 |
| 37968 | 27965 | 3.354166667 |

| DNA SEQ ID NO | AA SEQ ID NO | Kidney 1 Enrichment |
|---|---|---|
| 37969 | 27966 | 3.350140056 |
| 37970 | 27967 | 3.348659004 |
| 37971 | 27968 | 3.345454545 |
| 37972 | 27969 | 3.345454545 |
| 37973 | 27970 | 3.345454545 |
| 37974 | 27971 | 3.341880342 |
| 37975 | 27972 | 3.341880342 |
| 37976 | 27973 | 3.341880342 |
| 37977 | 27974 | 3.333333333 |
| 37978 | 27975 | 3.333333333 |
| 37979 | 27976 | 3.333333333 |
| 37980 | 27977 | 3.333333333 |
| 37981 | 27978 | 3.333333333 |
| 37982 | 27979 | 3.333333333 |
| 37983 | 27980 | 3.333333333 |
| 37984 | 27981 | 3.333333333 |
| 37985 | 27982 | 3.328947368 |
| 37986 | 27983 | 3.325301205 |
| 37987 | 27984 | 3.322222222 |
| 37988 | 27985 | 3.322222222 |
| 37989 | 27986 | 3.319587629 |
| 37990 | 27987 | 3.319587629 |
| 37991 | 27988 | 3.315315315 |
| 37992 | 27989 | 3.315315315 |
| 37993 | 27990 | 3.315315315 |
| 37994 | 27991 | 3.315315315 |
| 37995 | 27992 | 3.310606061 |
| 37996 | 27993 | 3.307189542 |
| 37997 | 27994 | 3.307189542 |

| DNA SEQ ID NO | AA SEQ ID NO | Kidney 1 Enrichment |
|---|---|---|
| 37998 | 27995 | 3.307189542 |
| 37999 | 27996 | 3.307189542 |
| 38000 | 27997 | 3.307189542 |
| 38001 | 27998 | 3.302564103 |
| 38002 | 27999 | 3.302564103 |
| 38003 | 28000 | 3.300925926 |
| 38004 | 28001 | 3.297491039 |
| 38005 | 28002 | 3.285714286 |
| 38006 | 28003 | 3.285714286 |
| 38007 | 28004 | 3.285714286 |
| 38008 | 28005 | 3.285714286 |
| 38009 | 28006 | 3.285714286 |
| 38010 | 28007 | 3.285714286 |
| 38011 | 28008 | 3.285714286 |
| 38012 | 28009 | 3.285714286 |
| 38013 | 28010 | 3.285714286 |
| 38014 | 28011 | 3.285714286 |
| 38015 | 28012 | 3.285714286 |
| 38016 | 28013 | 3.285714286 |
| 38017 | 28014 | 3.285714286 |
| 38018 | 28015 | 3.285714286 |
| 38019 | 28016 | 3.285714286 |
| 38020 | 28017 | 3.285714286 |
| 38021 | 28018 | 3.285714286 |
| 38022 | 28019 | 3.275080906 |
| 38023 | 28020 | 3.27340824 |
| 38024 | 28021 | 3.27340824 |
| 38025 | 28022 | 3.267759563 |
| 38026 | 28023 | 3.262411348 |

FIG. 6 (Cont.)

| DNA SEQ ID NO | AA SEQ ID NO | Kidney 1 Enrichment |
|---|---|---|
| 38027 | 28024 | 3.262411348 |
| 38028 | 28025 | 3.262411348 |
| 38029 | 28026 | 3.262411348 |
| 38030 | 28027 | 3.262411348 |
| 38031 | 28028 | 3.262411348 |
| 38032 | 28029 | 3.25984252 |
| 38033 | 28030 | 3.258333333 |
| 38034 | 28031 | 3.258333333 |
| 38035 | 28032 | 3.258333333 |
| 38036 | 28033 | 3.258333333 |
| 38037 | 28034 | 3.256637168 |
| 38038 | 28035 | 3.252525253 |
| 38039 | 28036 | 3.247058824 |
| 38040 | 28037 | 3.243589744 |
| 38041 | 28038 | 3.23943662 |
| 38042 | 28039 | 3.23943662 |
| 38043 | 28040 | 3.237037037 |
| 38044 | 28041 | 3.234375 |
| 38045 | 28042 | 3.234375 |
| 38046 | 28043 | 3.228070175 |
| 38047 | 28044 | 3.228070175 |
| 38048 | 28045 | 3.228070175 |
| 38049 | 28046 | 3.228070175 |
| 38050 | 28047 | 3.228070175 |
| 38051 | 28048 | 3.228070175 |
| 38052 | 28049 | 3.228070175 |
| 38053 | 28050 | 3.228070175 |
| 38054 | 28051 | 3.228070175 |
| 38055 | 28052 | 3.228070175 |

| DNA SEQ ID NO | AA SEQ ID NO | Kidney 1 Enrichment |
|---|---|---|
| 38056 | 28053 | 3.228070175 |
| 38057 | 28054 | 3.228070175 |
| 38058 | 28055 | 3.228070175 |
| 38059 | 28056 | 3.228070175 |
| 38060 | 28057 | 3.221288515 |
| 38061 | 28058 | 3.218106996 |
| 38062 | 28059 | 3.218106996 |
| 38063 | 28060 | 3.218106996 |
| 38064 | 28061 | 3.215053763 |
| 38065 | 28062 | 3.209302326 |
| 38066 | 28063 | 3.209302326 |
| 38067 | 28064 | 3.2039801 |
| 38068 | 28065 | 3.2039801 |
| 38069 | 28066 | 3.201465201 |
| 38070 | 28067 | 3.194444444 |
| 38071 | 28068 | 3.194444444 |
| 38072 | 28069 | 3.194444444 |
| 38073 | 28070 | 3.194444444 |
| 38074 | 28071 | 3.194444444 |
| 38075 | 28072 | 3.194444444 |
| 38076 | 28073 | 3.188118812 |
| 38077 | 28074 | 3.186147186 |
| 38078 | 28075 | 3.186147186 |
| 38079 | 28076 | 3.186147186 |
| 38080 | 28077 | 3.184615385 |
| 38081 | 28078 | 3.182389937 |
| 38082 | 28079 | 3.182389937 |
| 38083 | 28080 | 3.182389937 |
| 38084 | 28081 | 3.178861789 |

| DNA SEQ ID NO | AA SEQ ID NO | Kidney 1 Enrichment |
|---|---|---|
| 38085 | 28082 | 3.178861789 |
| 38086 | 28083 | 3.176190476 |
| 38087 | 28084 | 3.172413793 |
| 38088 | 28085 | 3.172413793 |
| 38089 | 28086 | 3.172413793 |
| 38090 | 28087 | 3.172413793 |
| 38091 | 28088 | 3.172413793 |
| 38092 | 28089 | 3.166666667 |
| 38093 | 28090 | 3.164021164 |
| 38094 | 28091 | 3.164021164 |
| 38095 | 28092 | 3.164021164 |
| 38096 | 28093 | 3.161512027 |
| 38097 | 28094 | 3.156862745 |
| 38098 | 28095 | 3.156862745 |
| 38099 | 28096 | 3.156862745 |
| 38100 | 28097 | 3.156862745 |
| 38101 | 28098 | 3.156862745 |
| 38102 | 28099 | 3.156862745 |
| 38103 | 28100 | 3.152647975 |
| 38104 | 28101 | 3.150684932 |
| 38105 | 28102 | 3.145299145 |
| 38106 | 28103 | 3.145299145 |
| 38107 | 28104 | 3.145299145 |
| 38108 | 28105 | 3.145299145 |
| 38109 | 28106 | 3.145299145 |
| 38110 | 28107 | 3.140562249 |
| 38111 | 28108 | 3.139107612 |
| 38112 | 28109 | 3.136363636 |
| 38113 | 28110 | 3.136363636 |

| DNA SEQ ID NO | AA SEQ ID NO | Kidney 1 Enrichment |
|---|---|---|
| 38114 | 28111 | 3.129251701 |
| 38115 | 28112 | 3.129251701 |
| 38116 | 28113 | 3.129251701 |
| 38117 | 28114 | 3.129251701 |
| 38118 | 28115 | 3.12345679 |
| 38119 | 28116 | 3.12345679 |
| 38120 | 28117 | 3.12345679 |
| 38121 | 28118 | 3.118644068 |
| 38122 | 28119 | 3.118644068 |
| 38123 | 28120 | 3.114583333 |
| 38124 | 28121 | 3.111111111 |
| 38125 | 28122 | 3.108108108 |
| 38126 | 28123 | 3.108108108 |
| 38127 | 28124 | 3.105485232 |
| 38128 | 28125 | 3.105485232 |
| 38129 | 28126 | 3.103174603 |
| 38130 | 28127 | 3.103174603 |
| 38131 | 28128 | 3.101123596 |
| 38132 | 28129 | 3.09929078 |
| 38133 | 28130 | 3.09929078 |
| 38134 | 28131 | 3.097643098 |
| 38135 | 28132 | 3.090439276 |
| 38136 | 28133 | 3.089552239 |
| 38137 | 28134 | 3.066666667 |
| 38138 | 28135 | 3.066666667 |
| 38139 | 28136 | 3.066666667 |
| 38140 | 28137 | 3.066666667 |
| 38141 | 28138 | 3.066666667 |
| 38142 | 28139 | 3.066666667 |

| DNA SEQ ID NO | AA SEQ ID NO | Kidney 1 Enrichment |
|---|---|---|
| 38143 | 28140 | 3.066666667 |
| 38144 | 28141 | 3.066666667 |
| 38145 | 28142 | 3.066666667 |
| 38146 | 28143 | 3.066666667 |
| 38147 | 28144 | 3.066666667 |
| 38148 | 28145 | 3.066666667 |
| 38149 | 28146 | 3.066666667 |
| 38150 | 28147 | 3.066666667 |
| 38151 | 28148 | 3.066666667 |
| 38152 | 28149 | 3.066666667 |
| 38153 | 28150 | 3.066666667 |
| 38154 | 28151 | 3.066666667 |
| 38155 | 28152 | 3.066666667 |
| 38156 | 28153 | 3.066666667 |
| 38157 | 28154 | 3.066666667 |
| 38158 | 28155 | 3.066666667 |
| 38159 | 28156 | 3.066666667 |
| 38160 | 28157 | 3.066666667 |
| 38161 | 28158 | 3.066666667 |
| 38162 | 28159 | 3.066666667 |
| 38163 | 28160 | 3.066666667 |
| 38164 | 28161 | 3.066666667 |
| 38165 | 28162 | 3.066666667 |
| 38166 | 28163 | 3.066666667 |
| 38167 | 28164 | 3.066666667 |
| 38168 | 28165 | 3.066666667 |
| 38169 | 28166 | 3.066666667 |
| 38170 | 28167 | 3.066666667 |
| 38171 | 28168 | 3.066666667 |

FIG. 6 (Cont.)

| DNA SEQ ID NO | AA SEQ ID NO | Kidney 1 Enrichment |
|---|---|---|
| 38172 | 28169 | 3.066666667 |
| 38173 | 28170 | 3.066666667 |
| 38174 | 28171 | 3.066666667 |
| 38175 | 28172 | 3.066666667 |
| 38176 | 28173 | 3.066666667 |
| 38177 | 28174 | 3.066666667 |
| 38178 | 28175 | 3.066666667 |
| 38179 | 28176 | 3.066666667 |
| 38180 | 28177 | 3.066666667 |
| 38181 | 28178 | 3.066666667 |
| 38182 | 28179 | 3.066666667 |
| 38183 | 28180 | 3.066666667 |
| 38184 | 28181 | 3.066666667 |
| 38185 | 28182 | 3.066666667 |
| 38186 | 28183 | 3.066666667 |
| 38187 | 28184 | 3.066666667 |
| 38188 | 28185 | 3.066666667 |
| 38189 | 28186 | 3.031007752 |
| 38190 | 28187 | 3.031007752 |
| 38191 | 28188 | 3.028806584 |
| 38192 | 28189 | 3.028806584 |
| 38193 | 28190 | 3.026315789 |
| 38194 | 28191 | 3.026315789 |
| 38195 | 28192 | 3.026315789 |
| 38196 | 28193 | 3.023474178 |
| 38197 | 28194 | 3.023474178 |
| 38198 | 28195 | 3.02020202 |
| 38199 | 28196 | 3.016393443 |
| 38200 | 28197 | 3.011904762 |

| DNA SEQ ID NO | AA SEQ ID NO | Kidney 1 Enrichment |
|---|---|---|
| 38201 | 28198 | 3.011904762 |
| 38202 | 28199 | 3.011904762 |
| 38203 | 28200 | 3.011904762 |
| 38204 | 28201 | 3.011904762 |
| 38205 | 28202 | 3.006535948 |
| 38206 | 28203 | 3.006535948 |
| 38207 | 28204 | 3.006535948 |
| 38208 | 28205 | 3.006535948 |
| 38209 | 28206 | 3 |
| 38210 | 28207 | 3 |
| 38211 | 28208 | 3 |
| 38212 | 28209 | 3 |
| 38213 | 28210 | 3 |
| 38214 | 28211 | 3 |
| 38215 | 28212 | 3 |
| 38216 | 28213 | 3 |
| 38217 | 28214 | 3 |
| 38218 | 28215 | 2.996168582 |
| 38219 | 28216 | 2.991869919 |
| 38220 | 28217 | 2.991869919 |
| 38221 | 28218 | 2.991869919 |
| 38222 | 28219 | 2.991869919 |
| 38223 | 28220 | 2.991869919 |
| 38224 | 28221 | 2.991869919 |
| 38225 | 28222 | 2.991869919 |
| 38226 | 28223 | 2.991869919 |
| 38227 | 28224 | 2.991869919 |
| 38228 | 28225 | 2.988700565 |
| 38229 | 28226 | 2.987012987 |

| DNA SEQ ID NO | AA SEQ ID NO | Kidney 1 Enrichment |
|---|---|---|
| 38230 | 28227 | 2.987012987 |
| 38231 | 28228 | 2.981481481 |
| 38232 | 28229 | 2.981481481 |
| 38233 | 28230 | 2.981481481 |
| 38234 | 28231 | 2.981481481 |
| 38235 | 28232 | 2.981481481 |
| 38236 | 28233 | 2.975124378 |
| 38237 | 28234 | 2.972789116 |
| 38238 | 28235 | 2.971576227 |
| 38239 | 28236 | 2.971576227 |
| 38240 | 28237 | 2.967741935 |
| 38241 | 28238 | 2.967741935 |
| 38242 | 28239 | 2.967741935 |
| 38243 | 28240 | 2.967741935 |
| 38244 | 28241 | 2.967741935 |
| 38245 | 28242 | 2.967741935 |
| 38246 | 28243 | 2.967741935 |
| 38247 | 28244 | 2.967741935 |
| 38248 | 28245 | 2.967741935 |
| 38249 | 28246 | 2.962121212 |
| 38250 | 28247 | 2.959064327 |
| 38251 | 28248 | 2.955823293 |
| 38252 | 28249 | 2.955823293 |
| 38253 | 28250 | 2.955823293 |
| 38254 | 28251 | 2.955823293 |
| 38255 | 28252 | 2.95412844 |
| 38256 | 28253 | 2.948717949 |
| 38257 | 28254 | 2.948717949 |
| 38258 | 28255 | 2.948717949 |

| DNA SEQ ID NO | AA SEQ ID NO | Kidney 1 Enrichment |
|---|---|---|
| 38259 | 28256 | 2.948717949 |
| 38260 | 28257 | 2.948717949 |
| 38261 | 28258 | 2.948717949 |
| 38262 | 28259 | 2.948717949 |
| 38263 | 28260 | 2.948717949 |
| 38264 | 28261 | 2.948717949 |
| 38265 | 28262 | 2.948717949 |
| 38266 | 28263 | 2.948717949 |
| 38267 | 28264 | 2.948717949 |
| 38268 | 28265 | 2.944 |
| 38269 | 28266 | 2.942760943 |
| 38270 | 28267 | 2.942760943 |
| 38271 | 28268 | 2.940639269 |
| 38272 | 28269 | 2.940639269 |
| 38273 | 28270 | 2.938888889 |
| 38274 | 28271 | 2.936170213 |
| 38275 | 28272 | 2.936170213 |
| 38276 | 28273 | 2.936170213 |
| 38277 | 28274 | 2.936170213 |
| 38278 | 28275 | 2.936170213 |
| 38279 | 28276 | 2.936170213 |
| 38280 | 28277 | 2.931372549 |
| 38281 | 28278 | 2.927272727 |
| 38282 | 28279 | 2.920634921 |
| 38283 | 28280 | 2.920634921 |
| 38284 | 28281 | 2.920634921 |
| 38285 | 28282 | 2.920634921 |
| 38286 | 28283 | 2.920634921 |
| 38287 | 28284 | 2.920634921 |

| DNA SEQ ID NO | AA SEQ ID NO | Kidney 1 Enrichment |
|---|---|---|
| 38288 | 28285 | 2.920634921 |
| 38289 | 28286 | 2.920634921 |
| 38290 | 28287 | 2.920634921 |
| 38291 | 28288 | 2.920634921 |
| 38292 | 28289 | 2.920634921 |
| 38293 | 28290 | 2.920634921 |
| 38294 | 28291 | 2.920634921 |
| 38295 | 28292 | 2.920634921 |
| 38296 | 28293 | 2.920634921 |
| 38297 | 28294 | 2.920634921 |
| 38298 | 28295 | 2.920634921 |
| 38299 | 28296 | 2.920634921 |
| 38300 | 28297 | 2.920634921 |
| 38301 | 28298 | 2.920634921 |
| 38302 | 28299 | 2.920634921 |
| 38303 | 28300 | 2.913333333 |
| 38304 | 28301 | 2.911392405 |
| 38305 | 28302 | 2.911392405 |
| 38306 | 28303 | 2.911392405 |
| 38307 | 28304 | 2.905263158 |
| 38308 | 28305 | 2.905263158 |
| 38309 | 28306 | 2.900900901 |
| 38310 | 28307 | 2.900900901 |
| 38311 | 28308 | 2.900900901 |
| 38312 | 28309 | 2.900900901 |
| 38313 | 28310 | 2.896296296 |
| 38314 | 28311 | 2.896296296 |
| 38315 | 28312 | 2.893081761 |
| 38316 | 28313 | 2.893081761 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 38317 | 28314 | 2.893081761 | 38346 | 28343 | 2.875 | 38375 | 28372 | 2.839506173 | 38404 | 28401 | 2.807511737 | 38433 | 28430 | 2.787878788 |
| 38318 | 28315 | 2.893081761 | 38347 | 28344 | 2.864468864 | 38376 | 28373 | 2.834733894 | 38405 | 28402 | 2.807511737 | 38434 | 28431 | 2.787878788 |
| 38319 | 28316 | 2.893081761 | 38348 | 28345 | 2.862222222 | 38377 | 28374 | 2.830769231 | 38406 | 28403 | 2.807511737 | 38435 | 28432 | 2.787878788 |
| 38320 | 28317 | 2.893081761 | 38349 | 28346 | 2.862222222 | 38378 | 28375 | 2.830769231 | 38407 | 28404 | 2.807511737 | 38436 | 28433 | 2.787878788 |
| 38321 | 28318 | 2.888888889 | 38350 | 28347 | 2.862222222 | 38379 | 28376 | 2.830769231 | 38408 | 28405 | 2.807511737 | 38437 | 28434 | 2.787878788 |
| 38322 | 28319 | 2.888888889 | 38351 | 28348 | 2.862222222 | 38380 | 28377 | 2.830769231 | 38409 | 28406 | 2.802867384 | 38438 | 28435 | 2.787878788 |
| 38323 | 28320 | 2.888888889 | 38352 | 28349 | 2.858757062 | 38381 | 28378 | 2.830769231 | 38410 | 28407 | 2.801282051 | 38439 | 28436 | 2.787878788 |
| 38324 | 28321 | 2.884488449 | 38353 | 28350 | 2.858757062 | 38382 | 28379 | 2.824561404 | 38411 | 28408 | 2.8 | 38440 | 28437 | 2.787878788 |
| 38325 | 28322 | 2.875 | 38354 | 28351 | 2.858757062 | 38383 | 28380 | 2.824561404 | 38412 | 28409 | 2.792668958 | 38441 | 28438 | 2.787878788 |
| 38326 | 28323 | 2.875 | 38355 | 28352 | 2.858757062 | 38384 | 28381 | 2.824561404 | 38413 | 28410 | 2.787878788 | 38442 | 28439 | 2.787878788 |
| 38327 | 28324 | 2.875 | 38356 | 28353 | 2.858757062 | 38385 | 28382 | 2.824561404 | 38414 | 28411 | 2.787878788 | 38443 | 28440 | 2.787878788 |
| 38328 | 28325 | 2.875 | 38357 | 28354 | 2.858757062 | 38386 | 28383 | 2.824561404 | 38415 | 28412 | 2.787878788 | 38444 | 28441 | 2.77212806 |
| 38329 | 28326 | 2.875 | 38358 | 28355 | 2.858757062 | 38387 | 28384 | 2.824561404 | 38416 | 28413 | 2.787878788 | 38445 | 28442 | 2.768518519 |
| 38330 | 28327 | 2.875 | 38359 | 28356 | 2.852713178 | 38388 | 28385 | 2.821333333 | 38417 | 28414 | 2.787878788 | 38446 | 28443 | 2.765027322 |
| 38331 | 28328 | 2.875 | 38360 | 28357 | 2.852713178 | 38389 | 28386 | 2.819923372 | 38418 | 28415 | 2.787878788 | 38447 | 28444 | 2.765027322 |
| 38332 | 28329 | 2.875 | 38361 | 28358 | 2.852713178 | 38390 | 28387 | 2.819923372 | 38419 | 28416 | 2.787878788 | 38448 | 28445 | 2.76 |
| 38333 | 28330 | 2.875 | 38362 | 28359 | 2.852713178 | 38391 | 28388 | 2.816326531 | 38420 | 28417 | 2.787878788 | 38449 | 28446 | 2.76 |
| 38334 | 28331 | 2.875 | 38363 | 28360 | 2.852713178 | 38392 | 28389 | 2.816326531 | 38421 | 28418 | 2.787878788 | 38450 | 28447 | 2.76 |
| 38335 | 28332 | 2.875 | 38364 | 28361 | 2.847619048 | 38393 | 28390 | 2.816326531 | 38422 | 28419 | 2.787878788 | 38451 | 28448 | 2.76 |
| 38336 | 28333 | 2.875 | 38365 | 28362 | 2.847619048 | 38394 | 28391 | 2.816326531 | 38423 | 28420 | 2.787878788 | 38452 | 28449 | 2.76 |
| 38337 | 28334 | 2.875 | 38366 | 28363 | 2.847619048 | 38395 | 28392 | 2.816326531 | 38424 | 28421 | 2.787878788 | 38453 | 28450 | 2.76 |
| 38338 | 28335 | 2.875 | 38367 | 28364 | 2.845360825 | 38396 | 28393 | 2.816326531 | 38425 | 28422 | 2.787878788 | 38454 | 28451 | 2.76 |
| 38339 | 28336 | 2.875 | 38368 | 28365 | 2.839506173 | 38397 | 28394 | 2.816326531 | 38426 | 28423 | 2.787878788 | 38455 | 28452 | 2.76 |
| 38340 | 28337 | 2.875 | 38369 | 28366 | 2.839506173 | 38398 | 28395 | 2.811111111 | 38427 | 28424 | 2.787878788 | 38456 | 28453 | 2.757793765 |
| 38341 | 28338 | 2.875 | 38370 | 28367 | 2.839506173 | 38399 | 28396 | 2.811111111 | 38428 | 28425 | 2.787878788 | 38457 | 28454 | 2.756554307 |
| 38342 | 28339 | 2.875 | 38371 | 28368 | 2.839506173 | 38400 | 28397 | 2.811111111 | 38429 | 28426 | 2.787878788 | 38458 | 28455 | 2.752136752 |
| 38343 | 28340 | 2.875 | 38372 | 28369 | 2.839506173 | 38401 | 28398 | 2.811111111 | 38430 | 28427 | 2.787878788 | 38459 | 28456 | 2.752136752 |
| 38344 | 28341 | 2.875 | 38373 | 28370 | 2.839506173 | 38402 | 28399 | 2.807511737 | 38431 | 28428 | 2.787878788 | 38460 | 28457 | 2.752136752 |
| 38345 | 28342 | 2.875 | 38374 | 28371 | 2.839506173 | 38403 | 28400 | 2.807511737 | 38432 | 28429 | 2.787878788 | 38461 | 28458 | 2.752136752 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 38462 | 28459 | 2.752136752 | 38491 | 28488 | 2.705882353 | 38520 | 28517 | 2.683333333 | 38549 | 28546 | 2.653846154 | 38578 | 28575 | 2.628571429 |
| 38463 | 28460 | 2.752136752 | 38492 | 28489 | 2.705882353 | 38521 | 28518 | 2.683333333 | 38550 | 28547 | 2.653846154 | 38579 | 28576 | 2.628571429 |
| 38464 | 28461 | 2.752136752 | 38493 | 28490 | 2.705882353 | 38522 | 28519 | 2.683333333 | 38551 | 28548 | 2.653846154 | 38580 | 28577 | 2.628571429 |
| 38465 | 28462 | 2.752136752 | 38494 | 28491 | 2.705882353 | 38523 | 28520 | 2.683333333 | 38552 | 28549 | 2.653846154 | 38581 | 28578 | 2.628571429 |
| 38466 | 28463 | 2.746268657 | 38495 | 28492 | 2.705882353 | 38524 | 28521 | 2.677248677 | 38553 | 28550 | 2.653846154 | 38582 | 28579 | 2.628571429 |
| 38467 | 28464 | 2.746268657 | 38496 | 28493 | 2.705882353 | 38525 | 28522 | 2.677248677 | 38554 | 28551 | 2.653846154 | 38583 | 28580 | 2.628571429 |
| 38468 | 28465 | 2.743859649 | 38497 | 28494 | 2.705882353 | 38526 | 28523 | 2.674418605 | 38555 | 28552 | 2.653846154 | 38584 | 28581 | 2.628571429 |
| 38469 | 28466 | 2.742547425 | 38498 | 28495 | 2.705882353 | 38527 | 28524 | 2.666666667 | 38556 | 28553 | 2.653846154 | 38585 | 28582 | 2.628571429 |
| 38470 | 28467 | 2.741154562 | 38499 | 28496 | 2.705882353 | 38528 | 28525 | 2.666666667 | 38557 | 28554 | 2.652252252 | 38586 | 28583 | 2.628571429 |
| 38471 | 28468 | 2.738095238 | 38500 | 28497 | 2.705882353 | 38529 | 28526 | 2.666666667 | 38558 | 28555 | 2.651629073 | 38587 | 28584 | 2.628571429 |
| 38472 | 28469 | 2.738095238 | 38501 | 28498 | 2.705882353 | 38530 | 28527 | 2.666666667 | 38559 | 28556 | 2.650205761 | 38588 | 28585 | 2.628571429 |
| 38473 | 28470 | 2.738095238 | 38502 | 28499 | 2.705882353 | 38531 | 28528 | 2.666666667 | 38560 | 28557 | 2.650205761 | 38589 | 28586 | 2.626151013 |
| 38474 | 28471 | 2.732673267 | 38503 | 28500 | 2.705882353 | 38532 | 28529 | 2.666666667 | 38561 | 28558 | 2.650205761 | 38590 | 28587 | 2.624624625 |
| 38475 | 28472 | 2.730593607 | 38504 | 28501 | 2.705882353 | 38533 | 28530 | 2.666666667 | 38562 | 28559 | 2.650205761 | 38591 | 28588 | 2.617886179 |
| 38476 | 28473 | 2.730593607 | 38505 | 28502 | 2.705882353 | 38534 | 28531 | 2.666666667 | 38563 | 28560 | 2.643678161 | 38592 | 28589 | 2.617886179 |
| 38477 | 28474 | 2.730593607 | 38506 | 28503 | 2.699530516 | 38535 | 28532 | 2.666666667 | 38564 | 28561 | 2.643678161 | 38593 | 28590 | 2.617886179 |
| 38478 | 28475 | 2.730593607 | 38507 | 28504 | 2.697530864 | 38536 | 28533 | 2.666666667 | 38565 | 28562 | 2.643678161 | 38594 | 28591 | 2.617886179 |
| 38479 | 28476 | 2.725925926 | 38508 | 28505 | 2.695970696 | 38537 | 28534 | 2.666666667 | 38566 | 28563 | 2.643678161 | 38595 | 28592 | 2.617886179 |
| 38480 | 28477 | 2.725925926 | 38509 | 28506 | 2.693693694 | 38538 | 28535 | 2.666666667 | 38567 | 28564 | 2.643678161 | 38596 | 28593 | 2.613636364 |
| 38481 | 28478 | 2.720430108 | 38510 | 28507 | 2.69005848 | 38539 | 28536 | 2.666666667 | 38568 | 28565 | 2.643678161 | 38597 | 28594 | 2.609929078 |
| 38482 | 28479 | 2.720430108 | 38511 | 28508 | 2.69005848 | 38540 | 28537 | 2.666666667 | 38569 | 28566 | 2.643678161 | 38598 | 28595 | 2.609929078 |
| 38483 | 28480 | 2.705882353 | 38512 | 28509 | 2.69005848 | 38541 | 28538 | 2.666666667 | 38570 | 28567 | 2.643678161 | 38599 | 28596 | 2.609929078 |
| 38484 | 28481 | 2.705882353 | 38513 | 28510 | 2.69005848 | 38542 | 28539 | 2.666666667 | 38571 | 28568 | 2.637992832 | 38600 | 28597 | 2.609929078 |
| 38485 | 28482 | 2.705882353 | 38514 | 28511 | 2.69005848 | 38543 | 28540 | 2.666666667 | 38572 | 28569 | 2.635416667 | 38601 | 28598 | 2.609929078 |
| 38486 | 28483 | 2.705882353 | 38515 | 28512 | 2.69005848 | 38544 | 28541 | 2.657777778 | 38573 | 28570 | 2.635416667 | 38602 | 28599 | 2.606666667 |
| 38487 | 28484 | 2.705882353 | 38516 | 28513 | 2.69005848 | 38545 | 28542 | 2.657777778 | 38574 | 28571 | 2.635416667 | 38603 | 28600 | 2.603773585 |
| 38488 | 28485 | 2.705882353 | 38517 | 28514 | 2.69005848 | 38546 | 28543 | 2.653846154 | 38575 | 28572 | 2.628571429 | 38604 | 28601 | 2.603773585 |
| 38489 | 28486 | 2.705882353 | 38518 | 28515 | 2.69005848 | 38547 | 28544 | 2.653846154 | 38576 | 28573 | 2.628571429 | 38605 | 28602 | 2.603773585 |
| 38490 | 28487 | 2.705882353 | 38519 | 28516 | 2.687285223 | 38548 | 28545 | 2.653846154 | 38577 | 28574 | 2.628571429 | 38606 | 28603 | 2.598870056 |

FIG. 6 (Cont.)

| DNA SEQ ID NO | AA SEQ ID NO | Kidney 1 Enrichment |
|---|---|---|
| 38607 | 28604 | 2.597449909 |
| 38608 | 28605 | 2.594871795 |
| 38609 | 28606 | 2.594871795 |
| 38610 | 28607 | 2.594871795 |
| 38611 | 28608 | 2.591549296 |
| 38612 | 28609 | 2.591549296 |
| 38613 | 28610 | 2.591549296 |
| 38614 | 28611 | 2.588744589 |
| 38615 | 28612 | 2.586345382 |
| 38616 | 28613 | 2.586345382 |
| 38617 | 28614 | 2.58245614 |
| 38618 | 28615 | 2.58245614 |
| 38619 | 28616 | 2.580858086 |
| 38620 | 28617 | 2.580858086 |
| 38621 | 28618 | 2.579439252 |
| 38622 | 28619 | 2.579439252 |
| 38623 | 28620 | 2.577030812 |
| 38624 | 28621 | 2.575063613 |
| 38625 | 28622 | 2.575063613 |
| 38626 | 28623 | 2.573426573 |
| 38627 | 28624 | 2.555555556 |
| 38628 | 28625 | 2.555555556 |
| 38629 | 28626 | 2.555555556 |
| 38630 | 28627 | 2.555555556 |
| 38631 | 28628 | 2.555555556 |
| 38632 | 28629 | 2.555555556 |
| 38633 | 28630 | 2.555555556 |
| 38634 | 28631 | 2.555555556 |
| 38635 | 28632 | 2.555555556 |

| DNA SEQ ID NO | AA SEQ ID NO | Kidney 1 Enrichment |
|---|---|---|
| 38636 | 28633 | 2.555555556 |
| 38637 | 28634 | 2.555555556 |
| 38638 | 28635 | 2.555555556 |
| 38639 | 28636 | 2.555555556 |
| 38640 | 28637 | 2.555555556 |
| 38641 | 28638 | 2.555555556 |
| 38642 | 28639 | 2.555555556 |
| 38643 | 28640 | 2.555555556 |
| 38644 | 28641 | 2.555555556 |
| 38645 | 28642 | 2.555555556 |
| 38646 | 28643 | 2.555555556 |
| 38647 | 28644 | 2.555555556 |
| 38648 | 28645 | 2.555555556 |
| 38649 | 28646 | 2.555555556 |
| 38650 | 28647 | 2.555555556 |
| 38651 | 28648 | 2.555555556 |
| 38652 | 28649 | 2.555555556 |
| 38653 | 28650 | 2.555555556 |
| 38654 | 28651 | 2.555555556 |
| 38655 | 28652 | 2.555555556 |
| 38656 | 28653 | 2.555555556 |
| 38657 | 28654 | 2.555555556 |
| 38658 | 28655 | 2.555555556 |
| 38659 | 28656 | 2.555555556 |
| 38660 | 28657 | 2.555555556 |
| 38661 | 28658 | 2.555555556 |
| 38662 | 28659 | 2.555555556 |
| 38663 | 28660 | 2.555555556 |
| 38664 | 28661 | 2.555555556 |

| DNA SEQ ID NO | AA SEQ ID NO | Kidney 1 Enrichment |
|---|---|---|
| 38665 | 28662 | 2.555555556 |
| 38666 | 28663 | 2.555555556 |
| 38667 | 28664 | 2.555555556 |
| 38668 | 28665 | 2.555555556 |
| 38669 | 28666 | 2.555555556 |
| 38670 | 28667 | 2.555555556 |
| 38671 | 28668 | 2.555555556 |
| 38672 | 28669 | 2.555555556 |
| 38673 | 28670 | 2.555555556 |
| 38674 | 28671 | 2.555555556 |
| 38675 | 28672 | 2.555555556 |
| 38676 | 28673 | 2.555555556 |
| 38677 | 28674 | 2.555555556 |
| 38678 | 28675 | 2.555555556 |
| 38679 | 28676 | 2.555555556 |
| 38680 | 28677 | 2.555555556 |
| 38681 | 28678 | 2.555555556 |
| 38682 | 28679 | 2.555555556 |
| 38683 | 28680 | 2.555555556 |
| 38684 | 28681 | 2.555555556 |
| 38685 | 28682 | 2.555555556 |
| 38686 | 28683 | 2.539278132 |
| 38687 | 28684 | 2.536340852 |
| 38688 | 28685 | 2.530744337 |
| 38689 | 28686 | 2.530744337 |
| 38690 | 28687 | 2.529209622 |
| 38691 | 28688 | 2.529209622 |
| 38692 | 28689 | 2.527472527 |
| 38693 | 28690 | 2.525490196 |

| DNA SEQ ID NO | AA SEQ ID NO | Kidney 1 Enrichment |
|---|---|---|
| 38694 | 28691 | 2.525490196 |
| 38695 | 28692 | 2.523206751 |
| 38696 | 28693 | 2.523206751 |
| 38697 | 28694 | 2.520547945 |
| 38698 | 28695 | 2.520547945 |
| 38699 | 28696 | 2.520547945 |
| 38700 | 28697 | 2.520547945 |
| 38701 | 28698 | 2.520547945 |
| 38702 | 28699 | 2.517412935 |
| 38703 | 28700 | 2.517412935 |
| 38704 | 28701 | 2.517412935 |
| 38705 | 28702 | 2.515625 |
| 38706 | 28703 | 2.513661202 |
| 38707 | 28704 | 2.513661202 |
| 38708 | 28705 | 2.513661202 |
| 38709 | 28706 | 2.509090909 |
| 38710 | 28707 | 2.509090909 |
| 38711 | 28708 | 2.509090909 |
| 38712 | 28709 | 2.509090909 |
| 38713 | 28710 | 2.509090909 |
| 38714 | 28711 | 2.506410256 |
| 38715 | 28712 | 2.496124031 |
| 38716 | 28713 | 2.496124031 |
| 38717 | 28714 | 2.496124031 |
| 38718 | 28715 | 2.496124031 |
| 38719 | 28716 | 2.496124031 |
| 38720 | 28717 | 2.496124031 |
| 38721 | 28718 | 2.496124031 |
| 38722 | 28719 | 2.496124031 |

| DNA SEQ ID NO | AA SEQ ID NO | Kidney 1 Enrichment |
|---|---|---|
| 38723 | 28720 | 2.496124031 |
| 38724 | 28721 | 2.493975904 |
| 38725 | 28722 | 2.491666667 |
| 38726 | 28723 | 2.491666667 |
| 38727 | 28724 | 2.491666667 |
| 38728 | 28725 | 2.486486486 |
| 38729 | 28726 | 2.486486486 |
| 38730 | 28727 | 2.486486486 |
| 38731 | 28728 | 2.486486486 |
| 38732 | 28729 | 2.486486486 |
| 38733 | 28730 | 2.486486486 |
| 38734 | 28731 | 2.486486486 |
| 38735 | 28732 | 2.486486486 |
| 38736 | 28733 | 2.480392157 |
| 38737 | 28734 | 2.480392157 |
| 38738 | 28735 | 2.480392157 |
| 38739 | 28736 | 2.478114478 |
| 38740 | 28737 | 2.478114478 |
| 38741 | 28738 | 2.478114478 |
| 38742 | 28739 | 2.478114478 |
| 38743 | 28740 | 2.476190476 |
| 38744 | 28741 | 2.47311828 |
| 38745 | 28742 | 2.46743295 |
| 38746 | 28743 | 2.46743295 |
| 38747 | 28744 | 2.464285714 |
| 38748 | 28745 | 2.464285714 |
| 38749 | 28746 | 2.464285714 |
| 38750 | 28747 | 2.464285714 |
| 38751 | 28748 | 2.464285714 |

FIG. 6 (Cont.)

| DNA SEQ ID NO | AA SEQ ID NO | Kidney 1 Enrichment |
|---|---|---|
| 38752 | 28749 | 2.464285714 |
| 38753 | 28750 | 2.463186078 |
| 38754 | 28751 | 2.46090535 |
| 38755 | 28752 | 2.46090535 |
| 38756 | 28753 | 2.46090535 |
| 38757 | 28754 | 2.46090535 |
| 38758 | 28755 | 2.453333333 |
| 38759 | 28756 | 2.453333333 |
| 38760 | 28757 | 2.453333333 |
| 38761 | 28758 | 2.453333333 |
| 38762 | 28759 | 2.453333333 |
| 38763 | 28760 | 2.453333333 |
| 38764 | 28761 | 2.453333333 |
| 38765 | 28762 | 2.453333333 |
| 38766 | 28763 | 2.453333333 |
| 38767 | 28764 | 2.453333333 |
| 38768 | 28765 | 2.453333333 |
| 38769 | 28766 | 2.453333333 |
| 38770 | 28767 | 2.453333333 |
| 38771 | 28768 | 2.449704142 |
| 38772 | 28769 | 2.449074074 |
| 38773 | 28770 | 2.449074074 |
| 38774 | 28771 | 2.446808511 |
| 38775 | 28772 | 2.444444444 |
| 38776 | 28773 | 2.444444444 |
| 38777 | 28774 | 2.444444444 |
| 38778 | 28775 | 2.444444444 |
| 38779 | 28776 | 2.439393939 |
| 38780 | 28777 | 2.439393939 |
| 38781 | 28778 | 2.439393939 |
| 38782 | 28779 | 2.439393939 |
| 38783 | 28780 | 2.439393939 |
| 38784 | 28781 | 2.433862434 |
| 38785 | 28782 | 2.433862434 |
| 38786 | 28783 | 2.433862434 |
| 38787 | 28784 | 2.430894309 |
| 38788 | 28785 | 2.430894309 |
| 38789 | 28786 | 2.430894309 |
| 38790 | 28787 | 2.430894309 |
| 38791 | 28788 | 2.429042904 |
| 38792 | 28789 | 2.427777778 |
| 38793 | 28790 | 2.426160338 |
| 38794 | 28791 | 2.421052632 |
| 38795 | 28792 | 2.421052632 |
| 38796 | 28793 | 2.421052632 |
| 38797 | 28794 | 2.421052632 |
| 38798 | 28795 | 2.421052632 |
| 38799 | 28796 | 2.421052632 |
| 38800 | 28797 | 2.421052632 |
| 38801 | 28798 | 2.421052632 |
| 38802 | 28799 | 2.421052632 |
| 38803 | 28800 | 2.40952381 |
| 38804 | 28801 | 2.405228758 |
| 38805 | 28802 | 2.405228758 |
| 38806 | 28803 | 2.405228758 |
| 38807 | 28804 | 2.405228758 |
| 38808 | 28805 | 2.405228758 |
| 38809 | 28806 | 2.401606426 |
| 38810 | 28807 | 2.401606426 |
| 38811 | 28808 | 2.4 |
| 38812 | 28809 | 2.395833333 |
| 38813 | 28810 | 2.395833333 |
| 38814 | 28811 | 2.395833333 |
| 38815 | 28812 | 2.395833333 |
| 38816 | 28813 | 2.395833333 |
| 38817 | 28814 | 2.395833333 |
| 38818 | 28815 | 2.395833333 |
| 38819 | 28816 | 2.391437309 |
| 38820 | 28817 | 2.38961039 |
| 38821 | 28818 | 2.38961039 |
| 38822 | 28819 | 2.38961039 |
| 38823 | 28820 | 2.387978142 |
| 38824 | 28821 | 2.387978142 |
| 38825 | 28822 | 2.385185185 |
| 38826 | 28823 | 2.385185185 |
| 38827 | 28824 | 2.385185185 |
| 38828 | 28825 | 2.385185185 |
| 38829 | 28826 | 2.385185185 |
| 38830 | 28827 | 2.385185185 |
| 38831 | 28828 | 2.385185185 |
| 38832 | 28829 | 2.381877023 |
| 38833 | 28830 | 2.379310345 |
| 38834 | 28831 | 2.379310345 |
| 38835 | 28832 | 2.379310345 |
| 38836 | 28833 | 2.379310345 |
| 38837 | 28834 | 2.379310345 |
| 38838 | 28835 | 2.379310345 |
| 38839 | 28836 | 2.379310345 |
| 38840 | 28837 | 2.379310345 |
| 38841 | 28838 | 2.379310345 |
| 38842 | 28839 | 2.375586854 |
| 38843 | 28840 | 2.375586854 |
| 38844 | 28841 | 2.373015873 |
| 38845 | 28842 | 2.373015873 |
| 38846 | 28843 | 2.36969697 |
| 38847 | 28844 | 2.368563686 |
| 38848 | 28845 | 2.368563686 |
| 38849 | 28846 | 2.358974359 |
| 38850 | 28847 | 2.358974359 |
| 38851 | 28848 | 2.358974359 |
| 38852 | 28849 | 2.358974359 |
| 38853 | 28850 | 2.358974359 |
| 38854 | 28851 | 2.358974359 |
| 38855 | 28852 | 2.358974359 |
| 38856 | 28853 | 2.358974359 |
| 38857 | 28854 | 2.358974359 |
| 38858 | 28855 | 2.358974359 |
| 38859 | 28856 | 2.358974359 |
| 38860 | 28857 | 2.358974359 |
| 38861 | 28858 | 2.358974359 |
| 38862 | 28859 | 2.358974359 |
| 38863 | 28860 | 2.358974359 |
| 38864 | 28861 | 2.358974359 |
| 38865 | 28862 | 2.358974359 |
| 38866 | 28863 | 2.358974359 |
| 38867 | 28864 | 2.358974359 |
| 38868 | 28865 | 2.358974359 |
| 38869 | 28866 | 2.358974359 |
| 38870 | 28867 | 2.358974359 |
| 38871 | 28868 | 2.358974359 |
| 38872 | 28869 | 2.358974359 |
| 38873 | 28870 | 2.358974359 |
| 38874 | 28871 | 2.358974359 |
| 38875 | 28872 | 2.358974359 |
| 38876 | 28873 | 2.358974359 |
| 38877 | 28874 | 2.358974359 |
| 38878 | 28875 | 2.358974359 |
| 38879 | 28876 | 2.358974359 |
| 38880 | 28877 | 2.358974359 |
| 38881 | 28878 | 2.358974359 |
| 38882 | 28879 | 2.358974359 |
| 38883 | 28880 | 2.350364964 |
| 38884 | 28881 | 2.348348348 |
| 38885 | 28882 | 2.346938776 |
| 38886 | 28883 | 2.345098039 |
| 38887 | 28884 | 2.342592593 |
| 38888 | 28885 | 2.342592593 |
| 38889 | 28886 | 2.342592593 |
| 38890 | 28887 | 2.340350877 |
| 38891 | 28888 | 2.338983051 |
| 38892 | 28889 | 2.338983051 |
| 38893 | 28890 | 2.338983051 |
| 38894 | 28891 | 2.338983051 |
| 38895 | 28892 | 2.338983051 |
| 38896 | 28893 | 2.338983051 |

FIG. 6 (Cont.)

| DNA SEQ ID NO | AA SEQ ID NO | Kidney 1 Enrichment |
|---|---|---|
| 38897 | 28894 | 2.336507937 |
| 38898 | 28895 | 2.333333333 |
| 38899 | 28896 | 2.333333333 |
| 38900 | 28897 | 2.333333333 |
| 38901 | 28898 | 2.333333333 |
| 38902 | 28899 | 2.333333333 |
| 38903 | 28900 | 2.333333333 |
| 38904 | 28901 | 2.333333333 |
| 38905 | 28902 | 2.333333333 |
| 38906 | 28903 | 2.329113924 |
| 38907 | 28904 | 2.327380952 |
| 38908 | 28905 | 2.327380952 |
| 38909 | 28906 | 2.326436782 |
| 38910 | 28907 | 2.323232323 |
| 38911 | 28908 | 2.323232323 |
| 38912 | 28909 | 2.323232323 |
| 38913 | 28910 | 2.323232323 |
| 38914 | 28911 | 2.323232323 |
| 38915 | 28912 | 2.323232323 |
| 38916 | 28913 | 2.323232323 |
| 38917 | 28914 | 2.323232323 |
| 38918 | 28915 | 2.323232323 |
| 38919 | 28916 | 2.320175439 |
| 38920 | 28917 | 2.317829457 |
| 38921 | 28918 | 2.317829457 |
| 38922 | 28919 | 2.317829457 |
| 38923 | 28920 | 2.315972222 |
| 38924 | 28921 | 2.314465409 |
| 38925 | 28922 | 2.314465409 |
| 38926 | 28923 | 2.314465409 |
| 38927 | 28924 | 2.310502283 |
| 38928 | 28925 | 2.310502283 |
| 38929 | 28926 | 2.310502283 |
| 38930 | 28927 | 2.310502283 |
| 38931 | 28928 | 2.308243728 |
| 38932 | 28929 | 2.308243728 |
| 38933 | 28930 | 2.306784661 |
| 38934 | 28931 | 2.306784661 |
| 38935 | 28932 | 2.306784661 |
| 38936 | 28933 | 2.305010893 |
| 38937 | 28934 | 2.3 |
| 38938 | 28935 | 2.3 |
| 38939 | 28936 | 2.3 |
| 38940 | 28937 | 2.3 |
| 38941 | 28938 | 2.3 |
| 38942 | 28939 | 2.3 |
| 38943 | 28940 | 2.3 |
| 38944 | 28941 | 2.3 |
| 38945 | 28942 | 2.3 |
| 38946 | 28943 | 2.3 |
| 38947 | 28944 | 2.3 |
| 38948 | 28945 | 2.3 |
| 38949 | 28946 | 2.3 |
| 38950 | 28947 | 2.3 |
| 38951 | 28948 | 2.3 |
| 38952 | 28949 | 2.3 |
| 38953 | 28950 | 2.3 |
| 38954 | 28951 | 2.3 |
| 38955 | 28952 | 2.3 |
| 38956 | 28953 | 2.3 |
| 38957 | 28954 | 2.292834891 |
| 38958 | 28955 | 2.291187739 |
| 38959 | 28956 | 2.291187739 |
| 38960 | 28957 | 2.291187739 |
| 38961 | 28958 | 2.291187739 |
| 38962 | 28959 | 2.29004329 |
| 38963 | 28960 | 2.288557214 |
| 38964 | 28961 | 2.288557214 |
| 38965 | 28962 | 2.288557214 |
| 38966 | 28963 | 2.288557214 |
| 38967 | 28964 | 2.286549708 |
| 38968 | 28965 | 2.283687943 |
| 38969 | 28966 | 2.283687943 |
| 38970 | 28967 | 2.283687943 |
| 38971 | 28968 | 2.283687943 |
| 38972 | 28969 | 2.279279279 |
| 38973 | 28970 | 2.279279279 |
| 38974 | 28971 | 2.277227723 |
| 38975 | 28972 | 2.277227723 |
| 38976 | 28973 | 2.271604938 |
| 38977 | 28974 | 2.271604938 |
| 38978 | 28975 | 2.271604938 |
| 38979 | 28976 | 2.271604938 |
| 38980 | 28977 | 2.271604938 |
| 38981 | 28978 | 2.271604938 |
| 38982 | 28979 | 2.271604938 |
| 38983 | 28980 | 2.271604938 |
| 38984 | 28981 | 2.271604938 |
| 38985 | 28982 | 2.271604938 |
| 38986 | 28983 | 2.271604938 |
| 38987 | 28984 | 2.271604938 |
| 38988 | 28985 | 2.271604938 |
| 38989 | 28986 | 2.267605634 |
| 38990 | 28987 | 2.266666667 |
| 38991 | 28988 | 2.266009852 |
| 38992 | 28989 | 2.265151515 |
| 38993 | 28990 | 2.263982103 |
| 38994 | 28991 | 2.263982103 |
| 38995 | 28992 | 2.262295082 |
| 38996 | 28993 | 2.259649123 |
| 38997 | 28994 | 2.258397933 |
| 38998 | 28995 | 2.254901961 |
| 38999 | 28996 | 2.254901961 |
| 39000 | 28997 | 2.254901961 |
| 39001 | 28998 | 2.254901961 |
| 39002 | 28999 | 2.254901961 |
| 39003 | 29000 | 2.254901961 |
| 39004 | 29001 | 2.254901961 |
| 39005 | 29002 | 2.254901961 |
| 39006 | 29003 | 2.254901961 |
| 39007 | 29004 | 2.254901961 |
| 39008 | 29005 | 2.248888889 |
| 39009 | 29006 | 2.248888889 |
| 39010 | 29007 | 2.248888889 |
| 39011 | 29008 | 2.247126437 |
| 39012 | 29009 | 2.247126437 |
| 39013 | 29010 | 2.243902439 |
| 39014 | 29011 | 2.243902439 |
| 39015 | 29012 | 2.243902439 |
| 39016 | 29013 | 2.243902439 |
| 39017 | 29014 | 2.243902439 |
| 39018 | 29015 | 2.243902439 |
| 39019 | 29016 | 2.239700375 |
| 39020 | 29017 | 2.236111111 |
| 39021 | 29018 | 2.236111111 |
| 39022 | 29019 | 2.236111111 |
| 39023 | 29020 | 2.236111111 |
| 39024 | 29021 | 2.236111111 |
| 39025 | 29022 | 2.236111111 |
| 39026 | 29023 | 2.236111111 |
| 39027 | 29024 | 2.236111111 |
| 39028 | 29025 | 2.236111111 |
| 39029 | 29026 | 2.23030303 |
| 39030 | 29027 | 2.23030303 |
| 39031 | 29028 | 2.23030303 |
| 39032 | 29029 | 2.23030303 |
| 39033 | 29030 | 2.225806452 |
| 39034 | 29031 | 2.225806452 |
| 39035 | 29032 | 2.222222222 |
| 39036 | 29033 | 2.222222222 |
| 39037 | 29034 | 2.222222222 |
| 39038 | 29035 | 2.222222222 |
| 39039 | 29036 | 2.222222222 |
| 39040 | 29037 | 2.222222222 |
| 39041 | 29038 | 2.222222222 |

FIG. 6 (Cont.)

| DNA SEQ ID NO | AA SEQ ID NO | Kidney 1 Enrichment |
|---|---|---|
| 39042 | 29039 | 2.220689655 |
| 39043 | 29040 | 2.219298246 |
| 39044 | 29041 | 2.219298246 |
| 39045 | 29042 | 2.21686747 |
| 39046 | 29043 | 2.21686747 |
| 39047 | 29044 | 2.21686747 |
| 39048 | 29045 | 2.21686747 |
| 39049 | 29046 | 2.214814815 |
| 39050 | 29047 | 2.214814815 |
| 39051 | 29048 | 2.211538462 |
| 39052 | 29049 | 2.21021021 |
| 39053 | 29050 | 2.21021021 |
| 39054 | 29051 | 2.209039548 |
| 39055 | 29052 | 2.19047619 |
| 39056 | 29053 | 2.19047619 |
| 39057 | 29054 | 2.19047619 |
| 39058 | 29055 | 2.19047619 |
| 39059 | 29056 | 2.19047619 |
| 39060 | 29057 | 2.19047619 |
| 39061 | 29058 | 2.19047619 |
| 39062 | 29059 | 2.19047619 |
| 39063 | 29060 | 2.19047619 |
| 39064 | 29061 | 2.19047619 |
| 39065 | 29062 | 2.19047619 |
| 39066 | 29063 | 2.19047619 |
| 39067 | 29064 | 2.19047619 |
| 39068 | 29065 | 2.19047619 |
| 39069 | 29066 | 2.19047619 |
| 39070 | 29067 | 2.19047619 |

| DNA SEQ ID NO | AA SEQ ID NO | Kidney 1 Enrichment |
|---|---|---|
| 39071 | 29068 | 2.19047619 |
| 39072 | 29069 | 2.19047619 |
| 39073 | 29070 | 2.19047619 |
| 39074 | 29071 | 2.19047619 |
| 39075 | 29072 | 2.19047619 |
| 39076 | 29073 | 2.19047619 |
| 39077 | 29074 | 2.19047619 |
| 39078 | 29075 | 2.19047619 |
| 39079 | 29076 | 2.19047619 |
| 39080 | 29077 | 2.19047619 |
| 39081 | 29078 | 2.19047619 |
| 39082 | 29079 | 2.19047619 |
| 39083 | 29080 | 2.19047619 |
| 39084 | 29081 | 2.19047619 |
| 39085 | 29082 | 2.19047619 |
| 39086 | 29083 | 2.19047619 |
| 39087 | 29084 | 2.19047619 |
| 39088 | 29085 | 2.19047619 |
| 39089 | 29086 | 2.19047619 |
| 39090 | 29087 | 2.19047619 |
| 39091 | 29088 | 2.19047619 |
| 39092 | 29089 | 2.19047619 |
| 39093 | 29090 | 2.19047619 |
| 39094 | 29091 | 2.19047619 |
| 39095 | 29092 | 2.19047619 |
| 39096 | 29093 | 2.19047619 |
| 39097 | 29094 | 2.19047619 |
| 39098 | 29095 | 2.19047619 |
| 39099 | 29096 | 2.19047619 |

| DNA SEQ ID NO | AA SEQ ID NO | Kidney 1 Enrichment |
|---|---|---|
| 39100 | 29097 | 2.19047619 |
| 39101 | 29098 | 2.19047619 |
| 39102 | 29099 | 2.19047619 |
| 39103 | 29100 | 2.19047619 |
| 39104 | 29101 | 2.19047619 |
| 39105 | 29102 | 2.19047619 |
| 39106 | 29103 | 2.19047619 |
| 39107 | 29104 | 2.19047619 |
| 39108 | 29105 | 2.19047619 |
| 39109 | 29106 | 2.19047619 |
| 39110 | 29107 | 2.19047619 |
| 39111 | 29108 | 2.174940898 |
| 39112 | 29109 | 2.174940898 |
| 39113 | 29110 | 2.171091445 |
| 39114 | 29111 | 2.171091445 |
| 39115 | 29112 | 2.169811321 |
| 39116 | 29113 | 2.168350168 |
| 39117 | 29114 | 2.166666667 |
| 39118 | 29115 | 2.166666667 |
| 39119 | 29116 | 2.164705882 |
| 39120 | 29117 | 2.164705882 |
| 39121 | 29118 | 2.159624413 |
| 39122 | 29119 | 2.159624413 |
| 39123 | 29120 | 2.159624413 |
| 39124 | 29121 | 2.15625 |
| 39125 | 29122 | 2.152046784 |
| 39126 | 29123 | 2.152046784 |
| 39127 | 29124 | 2.152046784 |
| 39128 | 29125 | 2.152046784 |

| DNA SEQ ID NO | AA SEQ ID NO | Kidney 1 Enrichment |
|---|---|---|
| 39129 | 29126 | 2.146666667 |
| 39130 | 29127 | 2.146666667 |
| 39131 | 29128 | 2.146666667 |
| 39132 | 29129 | 2.146666667 |
| 39133 | 29130 | 2.146666667 |
| 39134 | 29131 | 2.146666667 |
| 39135 | 29132 | 2.146666667 |
| 39136 | 29133 | 2.144522145 |
| 39137 | 29134 | 2.143369176 |
| 39138 | 29135 | 2.139534884 |
| 39139 | 29136 | 2.139534884 |
| 39140 | 29137 | 2.139534884 |
| 39141 | 29138 | 2.139534884 |
| 39142 | 29139 | 2.139534884 |
| 39143 | 29140 | 2.139534884 |
| 39144 | 29141 | 2.139534884 |
| 39145 | 29142 | 2.139534884 |
| 39146 | 29143 | 2.139534884 |
| 39147 | 29144 | 2.139534884 |
| 39148 | 29145 | 2.137373737 |
| 39149 | 29146 | 2.135021097 |
| 39150 | 29147 | 2.135021097 |
| 39151 | 29148 | 2.132450331 |
| 39152 | 29149 | 2.12962963 |
| 39153 | 29150 | 2.12962963 |
| 39154 | 29151 | 2.12962963 |
| 39155 | 29152 | 2.12962963 |
| 39156 | 29153 | 2.12962963 |
| 39157 | 29154 | 2.12962963 |

| DNA SEQ ID NO | AA SEQ ID NO | Kidney 1 Enrichment |
|---|---|---|
| 39158 | 29155 | 2.12962963 |
| 39159 | 29156 | 2.12962963 |
| 39160 | 29157 | 2.12962963 |
| 39161 | 29158 | 2.12962963 |
| 39162 | 29159 | 2.12962963 |
| 39163 | 29160 | 2.125412541 |
| 39164 | 29161 | 2.123076923 |
| 39165 | 29162 | 2.123076923 |
| 39166 | 29163 | 2.123076923 |
| 39167 | 29164 | 2.123076923 |
| 39168 | 29165 | 2.120567376 |
| 39169 | 29166 | 2.120567376 |
| 39170 | 29167 | 2.120567376 |
| 39171 | 29168 | 2.119241192 |
| 39172 | 29169 | 2.114942529 |
| 39173 | 29170 | 2.114942529 |
| 39174 | 29171 | 2.114942529 |
| 39175 | 29172 | 2.114942529 |
| 39176 | 29173 | 2.114942529 |
| 39177 | 29174 | 2.114942529 |
| 39178 | 29175 | 2.114942529 |
| 39179 | 29176 | 2.114942529 |
| 39180 | 29177 | 2.114942529 |
| 39181 | 29178 | 2.114942529 |
| 39182 | 29179 | 2.114942529 |
| 39183 | 29180 | 2.114942529 |
| 39184 | 29181 | 2.114942529 |
| 39185 | 29182 | 2.114942529 |
| 39186 | 29183 | 2.114942529 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 39187 | 29184 | 2.114942529 | 39216 | 29213 | 2.090909091 | 39245 | 29242 | 2.072072072 | 39274 | 29271 | 2.044444444 | 39303 | 29300 | 2.01754386 |
| 39188 | 29185 | 2.108333333 | 39217 | 29214 | 2.090909091 | 39246 | 29243 | 2.072072072 | 39275 | 29272 | 2.044444444 | 39304 | 29301 | 2.01754386 |
| 39189 | 29186 | 2.108333333 | 39218 | 29215 | 2.090909091 | 39247 | 29244 | 2.068783069 | 39276 | 29273 | 2.044444444 | 39305 | 29302 | 2.01754386 |
| 39190 | 29187 | 2.104575163 | 39219 | 29216 | 2.090909091 | 39248 | 29245 | 2.06741573 | 39277 | 29274 | 2.044444444 | 39306 | 29303 | 2.01754386 |
| 39191 | 29188 | 2.104575163 | 39220 | 29217 | 2.090909091 | 39249 | 29246 | 2.06741573 | 39278 | 29275 | 2.044444444 | 39307 | 29304 | 2.01754386 |
| 39192 | 29189 | 2.104575163 | 39221 | 29218 | 2.090909091 | 39250 | 29247 | 2.064102564 | 39279 | 29276 | 2.044444444 | 39308 | 29305 | 2.01754386 |
| 39193 | 29190 | 2.104575163 | 39222 | 29219 | 2.090909091 | 39251 | 29248 | 2.064102564 | 39280 | 29277 | 2.044444444 | 39309 | 29306 | 2.01754386 |
| 39194 | 29191 | 2.102150538 | 39223 | 29220 | 2.090909091 | 39252 | 29249 | 2.064102564 | 39281 | 29278 | 2.044444444 | 39310 | 29307 | 2.01754386 |
| 39195 | 29192 | 2.100456621 | 39224 | 29221 | 2.090909091 | 39253 | 29250 | 2.064102564 | 39282 | 29279 | 2.044444444 | 39311 | 29308 | 2.01459854 |
| 39196 | 29193 | 2.098245614 | 39225 | 29222 | 2.085333333 | 39254 | 29251 | 2.064102564 | 39283 | 29280 | 2.044444444 | 39312 | 29309 | 2.013468013 |
| 39197 | 29194 | 2.096866097 | 39226 | 29223 | 2.084142395 | 39255 | 29252 | 2.064102564 | 39284 | 29281 | 2.044444444 | 39313 | 29310 | 2.013468013 |
| 39198 | 29195 | 2.096866097 | 39227 | 29224 | 2.084142395 | 39256 | 29253 | 2.064102564 | 39285 | 29282 | 2.044444444 | 39314 | 29311 | 2.013468013 |
| 39199 | 29196 | 2.096866097 | 39228 | 29225 | 2.082304527 | 39257 | 29254 | 2.064102564 | 39286 | 29283 | 2.044444444 | 39315 | 29312 | 2.010928962 |
| 39200 | 29197 | 2.090909091 | 39229 | 29226 | 2.079096045 | 39258 | 29255 | 2.064102564 | 39287 | 29284 | 2.044444444 | 39316 | 29313 | 2.010928962 |
| 39201 | 29198 | 2.090909091 | 39230 | 29227 | 2.079096045 | 39259 | 29256 | 2.064102564 | 39288 | 29285 | 2.044444444 | 39317 | 29314 | 2.010928962 |
| 39202 | 29199 | 2.090909091 | 39231 | 29228 | 2.079096045 | 39260 | 29257 | 2.064102564 | 39289 | 29286 | 2.044444444 | 39318 | 29315 | 2.010928962 |
| 39203 | 29200 | 2.090909091 | 39232 | 29229 | 2.079096045 | 39261 | 29258 | 2.059701493 | 39290 | 29287 | 2.044444444 | 39319 | 29316 | 2.010928962 |
| 39204 | 29201 | 2.090909091 | 39233 | 29230 | 2.079096045 | 39262 | 29259 | 2.059701493 | 39291 | 29288 | 2.044444444 | 39320 | 29317 | 2.010928962 |
| 39205 | 29202 | 2.090909091 | 39234 | 29231 | 2.079096045 | 39263 | 29260 | 2.059701493 | 39292 | 29289 | 2.038535645 | 39321 | 29318 | 2.010928962 |
| 39206 | 29203 | 2.090909091 | 39235 | 29232 | 2.079096045 | 39264 | 29261 | 2.059701493 | 39293 | 29290 | 2.036458333 | 39322 | 29319 | 2.007936508 |
| 39207 | 29204 | 2.090909091 | 39236 | 29233 | 2.079096045 | 39265 | 29262 | 2.056910569 | 39294 | 29291 | 2.033149171 | 39323 | 29320 | 2.00623053 |
| 39208 | 29205 | 2.090909091 | 39237 | 29234 | 2.079096045 | 39266 | 29263 | 2.054982818 | 39295 | 29292 | 2.032128514 | 39324 | 29321 | 2.005128205 |
| 39209 | 29206 | 2.090909091 | 39238 | 29235 | 2.076388889 | 39267 | 29264 | 2.052493438 | 39296 | 29293 | 2.029411765 | 39325 | 29322 | 2.005128205 |
| 39210 | 29207 | 2.090909091 | 39239 | 29236 | 2.07518797 | 39268 | 29265 | 2.050387597 | 39297 | 29294 | 2.029411765 | 39326 | 29323 | 2.003003003 |
| 39211 | 29208 | 2.090909091 | 39240 | 29237 | 2.072072072 | 39269 | 29266 | 2.047477745 | 39298 | 29295 | 2.027548209 | 39327 | 29324 | 2 |
| 39212 | 29209 | 2.090909091 | 39241 | 29238 | 2.072072072 | 39270 | 29267 | 2.044444444 | 39299 | 29296 | 2.025157233 | 39328 | 29325 | 2 |
| 39213 | 29210 | 2.090909091 | 39242 | 29239 | 2.072072072 | 39271 | 29268 | 2.044444444 | 39300 | 29297 | 2.025157233 | 39329 | 29326 | 2 |
| 39214 | 29211 | 2.090909091 | 39243 | 29240 | 2.072072072 | 39272 | 29269 | 2.044444444 | 39301 | 29298 | 2.025157233 | 39330 | 29327 | 2 |
| 39215 | 29212 | 2.090909091 | 39244 | 29241 | 2.072072072 | 39273 | 29270 | 2.044444444 | 39302 | 29299 | 2.021978022 | 39331 | 29328 | 2 |

FIG. 6 (Cont.)

| DNA SEQ ID NO | AA SEQ ID NO | Kidney 1 Enrichment |
|---|---|---|
| 39332 | 29329 | 2 |
| 39333 | 29330 | 2 |
| 39334 | 29331 | 2 |
| 39335 | 29332 | 2 |
| 39336 | 29333 | 2 |
| 39337 | 29334 | 2 |
| 39338 | 29335 | 2 |
| 39339 | 29336 | 1.994579946 |
| 39340 | 29337 | 1.994579946 |
| 39341 | 29338 | 1.993333333 |
| 39342 | 29339 | 1.991341991 |
| 39343 | 29340 | 1.991341991 |
| 39344 | 29341 | 1.991341991 |
| 39345 | 29342 | 1.991341991 |
| 39346 | 29343 | 1.991341991 |
| 39347 | 29344 | 1.987654321 |
| 39348 | 29345 | 1.987654321 |
| 39349 | 29346 | 1.987654321 |
| 39350 | 29347 | 1.987654321 |
| 39351 | 29348 | 1.987654321 |
| 39352 | 29349 | 1.987654321 |
| 39353 | 29350 | 1.987654321 |
| 39354 | 29351 | 1.987654321 |
| 39355 | 29352 | 1.987654321 |
| 39356 | 29353 | 1.987654321 |
| 39357 | 29354 | 1.984313725 |
| 39358 | 29355 | 1.978494624 |
| 39359 | 29356 | 1.978494624 |
| 39360 | 29357 | 1.978494624 |
| 39361 | 29358 | 1.978494624 |
| 39362 | 29359 | 1.978494624 |
| 39363 | 29360 | 1.971428571 |
| 39364 | 29361 | 1.971428571 |
| 39365 | 29362 | 1.971428571 |
| 39366 | 29363 | 1.96941896 |
| 39367 | 29364 | 1.968468468 |
| 39368 | 29365 | 1.965811966 |
| 39369 | 29366 | 1.965811966 |
| 39370 | 29367 | 1.965811966 |
| 39371 | 29368 | 1.965811966 |
| 39372 | 29369 | 1.965811966 |
| 39373 | 29370 | 1.965811966 |
| 39374 | 29371 | 1.965811966 |
| 39375 | 29372 | 1.965811966 |
| 39376 | 29373 | 1.965811966 |
| 39377 | 29374 | 1.965811966 |
| 39378 | 29375 | 1.96124031 |
| 39379 | 29376 | 1.959899749 |
| 39380 | 29377 | 1.957446809 |
| 39381 | 29378 | 1.957446809 |
| 39382 | 29379 | 1.957446809 |
| 39383 | 29380 | 1.957446809 |
| 39384 | 29381 | 1.954248366 |
| 39385 | 29382 | 1.954248366 |
| 39386 | 29383 | 1.95329087 |
| 39387 | 29384 | 1.951515152 |
| 39388 | 29385 | 1.951515152 |
| 39389 | 29386 | 1.951515152 |
| 39390 | 29387 | 1.947089947 |
| 39391 | 29388 | 1.943661972 |
| 39392 | 29389 | 1.943661972 |
| 39393 | 29390 | 1.943661972 |
| 39394 | 29391 | 1.943661972 |
| 39395 | 29392 | 1.94092827 |
| 39396 | 29393 | 1.94092827 |
| 39397 | 29394 | 1.94092827 |
| 39398 | 29395 | 1.938697318 |
| 39399 | 29396 | 1.938697318 |
| 39400 | 29397 | 1.936842105 |
| 39401 | 29398 | 1.935275081 |
| 39402 | 29399 | 1.933933934 |
| 39403 | 29400 | 1.932773109 |
| 39404 | 29401 | 1.930864198 |
| 39405 | 29402 | 1.93006993 |
| 39406 | 29403 | 1.916666667 |
| 39407 | 29404 | 1.916666667 |
| 39408 | 29405 | 1.916666667 |
| 39409 | 29406 | 1.916666667 |
| 39410 | 29407 | 1.916666667 |
| 39411 | 29408 | 1.916666667 |
| 39412 | 29409 | 1.916666667 |
| 39413 | 29410 | 1.916666667 |
| 39414 | 29411 | 1.916666667 |
| 39415 | 29412 | 1.916666667 |
| 39416 | 29413 | 1.916666667 |
| 39417 | 29414 | 1.916666667 |
| 39418 | 29415 | 1.916666667 |
| 39419 | 29416 | 1.916666667 |
| 39420 | 29417 | 1.916666667 |
| 39421 | 29418 | 1.916666667 |
| 39422 | 29419 | 1.916666667 |
| 39423 | 29420 | 1.916666667 |
| 39424 | 29421 | 1.916666667 |
| 39425 | 29422 | 1.916666667 |
| 39426 | 29423 | 1.916666667 |
| 39427 | 29424 | 1.916666667 |
| 39428 | 29425 | 1.916666667 |
| 39429 | 29426 | 1.916666667 |
| 39430 | 29427 | 1.916666667 |
| 39431 | 29428 | 1.916666667 |
| 39432 | 29429 | 1.916666667 |
| 39433 | 29430 | 1.916666667 |
| 39434 | 29431 | 1.916666667 |
| 39435 | 29432 | 1.916666667 |
| 39436 | 29433 | 1.916666667 |
| 39437 | 29434 | 1.916666667 |
| 39438 | 29435 | 1.916666667 |
| 39439 | 29436 | 1.916666667 |
| 39440 | 29437 | 1.916666667 |
| 39441 | 29438 | 1.916666667 |
| 39442 | 29439 | 1.916666667 |
| 39443 | 29440 | 1.916666667 |
| 39444 | 29441 | 1.916666667 |
| 39445 | 29442 | 1.916666667 |
| 39446 | 29443 | 1.916666667 |
| 39447 | 29444 | 1.916666667 |
| 39448 | 29445 | 1.916666667 |
| 39449 | 29446 | 1.916666667 |
| 39450 | 29447 | 1.916666667 |
| 39451 | 29448 | 1.916666667 |
| 39452 | 29449 | 1.916666667 |
| 39453 | 29450 | 1.900826446 |
| 39454 | 29451 | 1.899705015 |
| 39455 | 29452 | 1.899705015 |
| 39456 | 29453 | 1.898412698 |
| 39457 | 29454 | 1.896907216 |
| 39458 | 29455 | 1.895131086 |
| 39459 | 29456 | 1.894117647 |
| 39460 | 29457 | 1.893004115 |
| 39461 | 29458 | 1.893004115 |
| 39462 | 29459 | 1.893004115 |
| 39463 | 29460 | 1.887179487 |
| 39464 | 29461 | 1.887179487 |
| 39465 | 29462 | 1.887179487 |
| 39466 | 29463 | 1.887179487 |
| 39467 | 29464 | 1.887179487 |
| 39468 | 29465 | 1.887179487 |
| 39469 | 29466 | 1.887179487 |
| 39470 | 29467 | 1.885245902 |
| 39471 | 29468 | 1.885245902 |
| 39472 | 29469 | 1.883040936 |
| 39473 | 29470 | 1.883040936 |
| 39474 | 29471 | 1.883040936 |
| 39475 | 29472 | 1.87755102 |
| 39476 | 29473 | 1.87755102 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 39477 | 29474 | 1.87755102 | 39506 | 29503 | 1.858585859 | 39535 | 29532 | 1.833333333 | 39564 | 29561 | 1.803921569 | 39593 | 29590 | 1.782945736 |
| 39478 | 29475 | 1.874074074 | 39507 | 29504 | 1.850574713 | 39536 | 29533 | 1.830845771 | 39565 | 29562 | 1.803921569 | 39594 | 29591 | 1.782945736 |
| 39479 | 29476 | 1.874074074 | 39508 | 29505 | 1.850574713 | 39537 | 29534 | 1.828746177 | 39566 | 29563 | 1.803921569 | 39595 | 29592 | 1.782945736 |
| 39480 | 29477 | 1.874074074 | 39509 | 29506 | 1.850574713 | 39538 | 29535 | 1.825396825 | 39567 | 29564 | 1.803921569 | 39596 | 29593 | 1.782945736 |
| 39481 | 29478 | 1.869918699 | 39510 | 29507 | 1.848699764 | 39539 | 29536 | 1.825396825 | 39568 | 29565 | 1.803921569 | 39597 | 29594 | 1.782945736 |
| 39482 | 29479 | 1.869918699 | 39511 | 29508 | 1.847389558 | 39540 | 29537 | 1.825396825 | 39569 | 29566 | 1.803921569 | 39598 | 29595 | 1.782945736 |
| 39483 | 29480 | 1.869918699 | 39512 | 29509 | 1.847389558 | 39541 | 29538 | 1.825396825 | 39570 | 29567 | 1.803921569 | 39599 | 29596 | 1.782945736 |
| 39484 | 29481 | 1.869918699 | 39513 | 29510 | 1.847389558 | 39542 | 29539 | 1.825396825 | 39571 | 29568 | 1.803921569 | 39600 | 29597 | 1.782945736 |
| 39485 | 29482 | 1.869918699 | 39514 | 29511 | 1.847389558 | 39543 | 29540 | 1.825396825 | 39572 | 29569 | 1.803921569 | 39601 | 29598 | 1.782945736 |
| 39486 | 29483 | 1.869918699 | 39515 | 29512 | 1.845679012 | 39544 | 29541 | 1.825396825 | 39573 | 29570 | 1.803921569 | 39602 | 29599 | 1.782945736 |
| 39487 | 29484 | 1.869918699 | 39516 | 29513 | 1.844611529 | 39545 | 29542 | 1.825396825 | 39574 | 29571 | 1.803921569 | 39603 | 29600 | 1.782945736 |
| 39488 | 29485 | 1.869918699 | 39517 | 29514 | 1.84 | 39546 | 29543 | 1.821782178 | 39575 | 29572 | 1.803921569 | 39604 | 29601 | 1.782945736 |
| 39489 | 29486 | 1.869918699 | 39518 | 29515 | 1.84 | 39547 | 29544 | 1.821782178 | 39576 | 29573 | 1.803921569 | 39605 | 29602 | 1.777777778 |
| 39490 | 29487 | 1.864864865 | 39519 | 29516 | 1.84 | 39548 | 29545 | 1.81920904 | 39577 | 29574 | 1.803921569 | 39606 | 29603 | 1.777777778 |
| 39491 | 29488 | 1.864864865 | 39520 | 29517 | 1.84 | 39549 | 29546 | 1.81920904 | 39578 | 29575 | 1.803921569 | 39607 | 29604 | 1.777777778 |
| 39492 | 29489 | 1.864864865 | 39521 | 29518 | 1.84 | 39550 | 29547 | 1.81920904 | 39579 | 29576 | 1.803921569 | 39608 | 29605 | 1.777777778 |
| 39493 | 29490 | 1.861904762 | 39522 | 29519 | 1.84 | 39551 | 29548 | 1.81920904 | 39580 | 29577 | 1.792207792 | 39609 | 29606 | 1.775438596 |
| 39494 | 29491 | 1.858585859 | 39523 | 29520 | 1.84 | 39552 | 29549 | 1.81920904 | 39581 | 29578 | 1.792207792 | 39610 | 29607 | 1.774104683 |
| 39495 | 29492 | 1.858585859 | 39524 | 29521 | 1.84 | 39553 | 29550 | 1.813620072 | 39582 | 29579 | 1.792207792 | 39611 | 29608 | 1.774104683 |
| 39496 | 29493 | 1.858585859 | 39525 | 29522 | 1.84 | 39554 | 29551 | 1.811023622 | 39583 | 29580 | 1.790754258 | 39612 | 29609 | 1.774104683 |
| 39497 | 29494 | 1.858585859 | 39526 | 29523 | 1.84 | 39555 | 29552 | 1.803921569 | 39584 | 29581 | 1.788888889 | 39613 | 29610 | 1.774104683 |
| 39498 | 29495 | 1.858585859 | 39527 | 29524 | 1.84 | 39556 | 29553 | 1.803921569 | 39585 | 29582 | 1.788888889 | 39614 | 29611 | 1.769230769 |
| 39499 | 29496 | 1.858585859 | 39528 | 29525 | 1.84 | 39557 | 29554 | 1.803921569 | 39586 | 29583 | 1.788888889 | 39615 | 29612 | 1.769230769 |
| 39500 | 29497 | 1.858585859 | 39529 | 29526 | 1.84 | 39558 | 29555 | 1.803921569 | 39587 | 29584 | 1.788888889 | 39616 | 29613 | 1.769230769 |
| 39501 | 29498 | 1.858585859 | 39530 | 29527 | 1.84 | 39559 | 29556 | 1.803921569 | 39588 | 29585 | 1.788888889 | 39617 | 29614 | 1.769230769 |
| 39502 | 29499 | 1.858585859 | 39531 | 29528 | 1.84 | 39560 | 29557 | 1.803921569 | 39589 | 29586 | 1.787321063 | 39618 | 29615 | 1.769230769 |
| 39503 | 29500 | 1.858585859 | 39532 | 29529 | 1.834757835 | 39561 | 29558 | 1.803921569 | 39590 | 29587 | 1.782945736 | 39619 | 29616 | 1.769230769 |
| 39504 | 29501 | 1.858585859 | 39533 | 29530 | 1.834757835 | 39562 | 29559 | 1.803921569 | 39591 | 29588 | 1.782945736 | 39620 | 29617 | 1.769230769 |
| 39505 | 29502 | 1.858585859 | 39534 | 29531 | 1.833333333 | 39563 | 29560 | 1.803921569 | 39592 | 29589 | 1.782945736 | 39621 | 29618 | 1.769230769 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 39622 | 29619 | 1.769230769 | 39651 | 29648 | 1.752380952 | 39680 | 29677 | 1.735849057 | 39709 | 29706 | 1.703703704 | 39738 | 29735 | 1.703703704 |
| 39623 | 29620 | 1.769230769 | 39652 | 29649 | 1.752380952 | 39681 | 29678 | 1.735849057 | 39710 | 29707 | 1.703703704 | 39739 | 29736 | 1.703703704 |
| 39624 | 29621 | 1.769230769 | 39653 | 29650 | 1.752380952 | 39682 | 29679 | 1.735849057 | 39711 | 29708 | 1.703703704 | 39740 | 29737 | 1.703703704 |
| 39625 | 29622 | 1.769230769 | 39654 | 29651 | 1.752380952 | 39683 | 29680 | 1.735849057 | 39712 | 29709 | 1.703703704 | 39741 | 29738 | 1.703703704 |
| 39626 | 29623 | 1.769230769 | 39655 | 29652 | 1.752380952 | 39684 | 29681 | 1.731182796 | 39713 | 29710 | 1.703703704 | 39742 | 29739 | 1.703703704 |
| 39627 | 29624 | 1.769230769 | 39656 | 29653 | 1.752380952 | 39685 | 29682 | 1.731182796 | 39714 | 29711 | 1.703703704 | 39743 | 29740 | 1.703703704 |
| 39628 | 29625 | 1.769230769 | 39657 | 29654 | 1.752380952 | 39686 | 29683 | 1.731182796 | 39715 | 29712 | 1.703703704 | 39744 | 29741 | 1.703703704 |
| 39629 | 29626 | 1.769230769 | 39658 | 29655 | 1.752380952 | 39687 | 29684 | 1.731182796 | 39716 | 29713 | 1.703703704 | 39745 | 29742 | 1.703703704 |
| 39630 | 29627 | 1.769230769 | 39659 | 29656 | 1.752380952 | 39688 | 29685 | 1.731182796 | 39717 | 29714 | 1.703703704 | 39746 | 29743 | 1.703703704 |
| 39631 | 29628 | 1.769230769 | 39660 | 29657 | 1.752380952 | 39689 | 29686 | 1.731182796 | 39718 | 29715 | 1.703703704 | 39747 | 29744 | 1.703703704 |
| 39632 | 29629 | 1.76498801 | 39661 | 29658 | 1.752380952 | 39690 | 29687 | 1.731182796 | 39719 | 29716 | 1.703703704 | 39748 | 29745 | 1.703703704 |
| 39633 | 29630 | 1.764011799 | 39662 | 29659 | 1.748538012 | 39691 | 29688 | 1.731182796 | 39720 | 29717 | 1.703703704 | 39749 | 29746 | 1.703703704 |
| 39634 | 29631 | 1.764011799 | 39663 | 29660 | 1.746835443 | 39692 | 29689 | 1.731182796 | 39721 | 29718 | 1.703703704 | 39750 | 29747 | 1.703703704 |
| 39635 | 29632 | 1.764011799 | 39664 | 29661 | 1.745257453 | 39693 | 29690 | 1.727699531 | 39722 | 29719 | 1.703703704 | 39751 | 29748 | 1.703703704 |
| 39636 | 29633 | 1.762452107 | 39665 | 29662 | 1.742424242 | 39694 | 29691 | 1.727699531 | 39723 | 29720 | 1.703703704 | 39752 | 29749 | 1.703703704 |
| 39637 | 29634 | 1.762452107 | 39666 | 29663 | 1.742424242 | 39695 | 29692 | 1.727699531 | 39724 | 29721 | 1.703703704 | 39753 | 29750 | 1.703703704 |
| 39638 | 29635 | 1.762452107 | 39667 | 29664 | 1.742424242 | 39696 | 29693 | 1.727699531 | 39725 | 29722 | 1.703703704 | 39754 | 29751 | 1.703703704 |
| 39639 | 29636 | 1.759562842 | 39668 | 29665 | 1.742424242 | 39697 | 29694 | 1.725 | 39726 | 29723 | 1.703703704 | 39755 | 29752 | 1.691954023 |
| 39640 | 29637 | 1.759562842 | 39669 | 29666 | 1.742424242 | 39698 | 29695 | 1.725 | 39727 | 29724 | 1.703703704 | 39756 | 29753 | 1.689265537 |
| 39641 | 29638 | 1.759562842 | 39670 | 29667 | 1.742424242 | 39699 | 29696 | 1.725 | 39728 | 29725 | 1.703703704 | 39757 | 29754 | 1.688073394 |
| 39642 | 29639 | 1.759562842 | 39671 | 29668 | 1.738831615 | 39700 | 29697 | 1.725 | 39729 | 29726 | 1.703703704 | 39758 | 29755 | 1.688073394 |
| 39643 | 29640 | 1.759562842 | 39672 | 29669 | 1.738831615 | 39701 | 29698 | 1.721088435 | 39730 | 29727 | 1.703703704 | 39759 | 29756 | 1.688073394 |
| 39644 | 29641 | 1.759562842 | 39673 | 29670 | 1.738831615 | 39702 | 29699 | 1.721088435 | 39731 | 29728 | 1.703703704 | 39760 | 29757 | 1.686666667 |
| 39645 | 29642 | 1.752380952 | 39674 | 29671 | 1.735849057 | 39703 | 29700 | 1.719626168 | 39732 | 29729 | 1.703703704 | 39761 | 29758 | 1.686666667 |
| 39646 | 29643 | 1.752380952 | 39675 | 29672 | 1.735849057 | 39704 | 29701 | 1.719626168 | 39733 | 29730 | 1.703703704 | 39762 | 29759 | 1.684981685 |
| 39647 | 29644 | 1.752380952 | 39676 | 29673 | 1.735849057 | 39705 | 29702 | 1.717333333 | 39734 | 29731 | 1.703703704 | 39763 | 29760 | 1.684981685 |
| 39648 | 29645 | 1.752380952 | 39677 | 29674 | 1.735849057 | 39706 | 29703 | 1.71641791 | 39735 | 29732 | 1.703703704 | 39764 | 29761 | 1.682926829 |
| 39649 | 29646 | 1.752380952 | 39678 | 29675 | 1.735849057 | 39707 | 29704 | 1.703703704 | 39736 | 29733 | 1.703703704 | 39765 | 29762 | 1.682926829 |
| 39650 | 29647 | 1.752380952 | 39679 | 29676 | 1.735849057 | 39708 | 29705 | 1.703703704 | 39737 | 29734 | 1.703703704 | 39766 | 29763 | 1.680365297 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 39767 | 29764 | 1.680365297 | 39796 | 29793 | 1.666666667 | 39825 | 29822 | 1.638676845 | 39854 | 29851 | 1.614035088 | 39883 | 29880 | 1.604651163 |
| 39768 | 29765 | 1.680365297 | 39797 | 29794 | 1.662650602 | 39826 | 29823 | 1.637540453 | 39855 | 29852 | 1.614035088 | 39884 | 29881 | 1.604651163 |
| 39769 | 29766 | 1.677083333 | 39798 | 29795 | 1.662650602 | 39827 | 29824 | 1.635555556 | 39856 | 29853 | 1.614035088 | 39885 | 29882 | 1.604651163 |
| 39770 | 29767 | 1.674329502 | 39799 | 29796 | 1.661740558 | 39828 | 29825 | 1.635555556 | 39857 | 29854 | 1.614035088 | 39886 | 29883 | 1.60199005 |
| 39771 | 29768 | 1.672727273 | 39800 | 29797 | 1.657657658 | 39829 | 29826 | 1.633879781 | 39858 | 29855 | 1.614035088 | 39887 | 29884 | 1.60199005 |
| 39772 | 29769 | 1.672727273 | 39801 | 29798 | 1.657657658 | 39830 | 29827 | 1.631205674 | 39859 | 29856 | 1.614035088 | 39888 | 29885 | 1.60199005 |
| 39773 | 29770 | 1.672727273 | 39802 | 29799 | 1.657657658 | 39831 | 29828 | 1.631205674 | 39860 | 29857 | 1.614035088 | 39889 | 29886 | 1.60199005 |
| 39774 | 29771 | 1.672727273 | 39803 | 29800 | 1.657657658 | 39832 | 29829 | 1.631205674 | 39861 | 29858 | 1.614035088 | 39890 | 29887 | 1.6 |
| 39775 | 29772 | 1.672727273 | 39804 | 29801 | 1.657657658 | 39833 | 29830 | 1.631205674 | 39862 | 29859 | 1.614035088 | 39891 | 29888 | 1.597222222 |
| 39776 | 29773 | 1.672727273 | 39805 | 29802 | 1.657657658 | 39834 | 29831 | 1.631205674 | 39863 | 29860 | 1.614035088 | 39892 | 29889 | 1.597222222 |
| 39777 | 29774 | 1.672727273 | 39806 | 29803 | 1.657657658 | 39835 | 29832 | 1.631205674 | 39864 | 29861 | 1.614035088 | 39893 | 29890 | 1.597222222 |
| 39778 | 29775 | 1.672727273 | 39807 | 29804 | 1.657657658 | 39836 | 29833 | 1.628318584 | 39865 | 29862 | 1.614035088 | 39894 | 29891 | 1.597222222 |
| 39779 | 29776 | 1.672727273 | 39808 | 29805 | 1.657657658 | 39837 | 29834 | 1.628318584 | 39866 | 29863 | 1.614035088 | 39895 | 29892 | 1.597222222 |
| 39780 | 29777 | 1.672727273 | 39809 | 29806 | 1.653594771 | 39838 | 29835 | 1.626262626 | 39867 | 29864 | 1.614035088 | 39896 | 29893 | 1.597222222 |
| 39781 | 29778 | 1.672727273 | 39810 | 29807 | 1.653594771 | 39839 | 29836 | 1.626262626 | 39868 | 29865 | 1.614035088 | 39897 | 29894 | 1.597222222 |
| 39782 | 29779 | 1.672727273 | 39811 | 29808 | 1.651282051 | 39840 | 29837 | 1.626262626 | 39869 | 29866 | 1.614035088 | 39898 | 29895 | 1.594666667 |
| 39783 | 29780 | 1.669966997 | 39812 | 29809 | 1.651282051 | 39841 | 29838 | 1.626262626 | 39870 | 29867 | 1.614035088 | 39899 | 29896 | 1.593073593 |
| 39784 | 29781 | 1.669966997 | 39813 | 29810 | 1.64874552 | 39842 | 29839 | 1.626262626 | 39871 | 29868 | 1.614035088 | 39900 | 29897 | 1.593073593 |
| 39785 | 29782 | 1.666666667 | 39814 | 29811 | 1.642857143 | 39843 | 29840 | 1.626262626 | 39872 | 29869 | 1.614035088 | 39901 | 29898 | 1.590123457 |
| 39786 | 29783 | 1.666666667 | 39815 | 29812 | 1.642857143 | 39844 | 29841 | 1.626262626 | 39873 | 29870 | 1.614035088 | 39902 | 29899 | 1.586206897 |
| 39787 | 29784 | 1.666666667 | 39816 | 29813 | 1.642857143 | 39845 | 29842 | 1.626262626 | 39874 | 29871 | 1.614035088 | 39903 | 29900 | 1.586206897 |
| 39788 | 29785 | 1.666666667 | 39817 | 29814 | 1.642857143 | 39846 | 29843 | 1.626262626 | 39875 | 29872 | 1.614035088 | 39904 | 29901 | 1.586206897 |
| 39789 | 29786 | 1.666666667 | 39818 | 29815 | 1.642857143 | 39847 | 29844 | 1.626262626 | 39876 | 29873 | 1.614035088 | 39905 | 29902 | 1.586206897 |
| 39790 | 29787 | 1.666666667 | 39819 | 29816 | 1.642857143 | 39848 | 29845 | 1.623529412 | 39877 | 29874 | 1.614035088 | 39906 | 29903 | 1.586206897 |
| 39791 | 29788 | 1.666666667 | 39820 | 29817 | 1.642857143 | 39849 | 29846 | 1.623529412 | 39878 | 29875 | 1.614035088 | 39907 | 29904 | 1.586206897 |
| 39792 | 29789 | 1.666666667 | 39821 | 29818 | 1.642857143 | 39850 | 29847 | 1.621794872 | 39879 | 29876 | 1.614035088 | 39908 | 29905 | 1.586206897 |
| 39793 | 29790 | 1.666666667 | 39822 | 29819 | 1.642857143 | 39851 | 29848 | 1.621794872 | 39880 | 29877 | 1.614035088 | 39909 | 29906 | 1.586206897 |
| 39794 | 29791 | 1.666666667 | 39823 | 29820 | 1.642857143 | 39852 | 29849 | 1.620596206 | 39881 | 29878 | 1.614035088 | 39910 | 29907 | 1.586206897 |
| 39795 | 29792 | 1.666666667 | 39824 | 29821 | 1.638676845 | 39853 | 29850 | 1.614035088 | 39882 | 29879 | 1.614035088 | 39911 | 29908 | 1.586206897 |

FIG. 6 (Cont.)

| DNA SEQ ID NO | AA SEQ ID NO | Kidney 1 Enrichment |
|---|---|---|
| 39912 | 29909 | 1.586206897 |
| 39913 | 29910 | 1.586206897 |
| 39914 | 29911 | 1.586206897 |
| 39915 | 29912 | 1.582010582 |
| 39916 | 29913 | 1.582010582 |
| 39917 | 29914 | 1.582010582 |
| 39918 | 29915 | 1.578431373 |
| 39919 | 29916 | 1.578431373 |
| 39920 | 29917 | 1.578431373 |
| 39921 | 29918 | 1.578431373 |
| 39922 | 29919 | 1.576323988 |
| 39923 | 29920 | 1.576323988 |
| 39924 | 29921 | 1.576323988 |
| 39925 | 29922 | 1.575342466 |
| 39926 | 29923 | 1.572649573 |
| 39927 | 29924 | 1.572649573 |
| 39928 | 29925 | 1.572649573 |
| 39929 | 29926 | 1.572649573 |
| 39930 | 29927 | 1.572649573 |
| 39931 | 29928 | 1.572649573 |
| 39932 | 29929 | 1.572649573 |
| 39933 | 29930 | 1.572649573 |
| 39934 | 29931 | 1.572649573 |
| 39935 | 29932 | 1.572649573 |
| 39936 | 29933 | 1.572649573 |
| 39937 | 29934 | 1.572649573 |
| 39938 | 29935 | 1.566909976 |
| 39939 | 29936 | 1.56462585 |
| 39940 | 29937 | 1.56462585 |

| DNA SEQ ID NO | AA SEQ ID NO | Kidney 1 Enrichment |
|---|---|---|
| 39941 | 29938 | 1.56462585 |
| 39942 | 29939 | 1.56462585 |
| 39943 | 29940 | 1.56462585 |
| 39944 | 29941 | 1.561728395 |
| 39945 | 29942 | 1.561728395 |
| 39946 | 29943 | 1.561728395 |
| 39947 | 29944 | 1.559322034 |
| 39948 | 29945 | 1.559322034 |
| 39949 | 29946 | 1.559322034 |
| 39950 | 29947 | 1.559322034 |
| 39951 | 29948 | 1.559322034 |
| 39952 | 29949 | 1.555555556 |
| 39953 | 29950 | 1.555555556 |
| 39954 | 29951 | 1.555555556 |
| 39955 | 29952 | 1.552742616 |
| 39956 | 29953 | 1.550561798 |
| 39957 | 29954 | 1.550561798 |
| 39958 | 29955 | 1.550561798 |
| 39959 | 29956 | 1.550561798 |
| 39960 | 29957 | 1.548821549 |
| 39961 | 29958 | 1.548821549 |
| 39962 | 29959 | 1.548821549 |
| 39963 | 29960 | 1.546218487 |
| 39964 | 29961 | 1.546218487 |
| 39965 | 29962 | 1.546218487 |
| 39966 | 29963 | 1.544364508 |
| 39967 | 29964 | 1.533333333 |
| 39968 | 29965 | 1.533333333 |
| 39969 | 29966 | 1.533333333 |

| DNA SEQ ID NO | AA SEQ ID NO | Kidney 1 Enrichment |
|---|---|---|
| 39970 | 29967 | 1.533333333 |
| 39971 | 29968 | 1.533333333 |
| 39972 | 29969 | 1.533333333 |
| 39973 | 29970 | 1.533333333 |
| 39974 | 29971 | 1.533333333 |
| 39975 | 29972 | 1.533333333 |
| 39976 | 29973 | 1.533333333 |
| 39977 | 29974 | 1.533333333 |
| 39978 | 29975 | 1.533333333 |
| 39979 | 29976 | 1.533333333 |
| 39980 | 29977 | 1.533333333 |
| 39981 | 29978 | 1.533333333 |
| 39982 | 29979 | 1.533333333 |
| 39983 | 29980 | 1.533333333 |
| 39984 | 29981 | 1.533333333 |
| 39985 | 29982 | 1.533333333 |
| 39986 | 29983 | 1.533333333 |
| 39987 | 29984 | 1.533333333 |
| 39988 | 29985 | 1.533333333 |
| 39989 | 29986 | 1.533333333 |
| 39990 | 29987 | 1.533333333 |
| 39991 | 29988 | 1.533333333 |
| 39992 | 29989 | 1.533333333 |
| 39993 | 29990 | 1.533333333 |
| 39994 | 29991 | 1.533333333 |
| 39995 | 29992 | 1.533333333 |
| 39996 | 29993 | 1.533333333 |
| 39997 | 29994 | 1.533333333 |
| 39998 | 29995 | 1.533333333 |

| DNA SEQ ID NO | AA SEQ ID NO | Kidney 1 Enrichment |
|---|---|---|
| 39999 | 29996 | 1.533333333 |
| 40000 | 29997 | 1.533333333 |
| 40001 | 29998 | 1.533333333 |
| 40002 | 29999 | 1.533333333 |
| 40003 | 30000 | 1.533333333 |
| 40004 | 30001 | 1.533333333 |
| 40005 | 30002 | 1.533333333 |
| 40006 | 30003 | 1.533333333 |
| 40007 | 30004 | 1.533333333 |
| 40008 | 30005 | 1.533333333 |
| 40009 | 30006 | 1.533333333 |
| 40010 | 30007 | 1.533333333 |
| 40011 | 30008 | 1.533333333 |
| 40012 | 30009 | 1.533333333 |
| 40013 | 30010 | 1.533333333 |
| 40014 | 30011 | 1.533333333 |
| 40015 | 30012 | 1.533333333 |
| 40016 | 30013 | 1.533333333 |
| 40017 | 30014 | 1.524861878 |
| 40018 | 30015 | 1.518151815 |
| 40019 | 30016 | 1.516483516 |
| 40020 | 30017 | 1.516483516 |
| 40021 | 30018 | 1.514403292 |
| 40022 | 30019 | 1.514403292 |
| 40023 | 30020 | 1.514403292 |
| 40024 | 30021 | 1.514403292 |
| 40025 | 30022 | 1.511737089 |
| 40026 | 30023 | 1.511737089 |
| 40027 | 30024 | 1.51010101 |

| DNA SEQ ID NO | AA SEQ ID NO | Kidney 1 Enrichment |
|---|---|---|
| 40028 | 30025 | 1.508196721 |
| 40029 | 30026 | 1.508196721 |
| 40030 | 30027 | 1.508196721 |
| 40031 | 30028 | 1.508196721 |
| 40032 | 30029 | 1.508196721 |
| 40033 | 30030 | 1.508196721 |
| 40034 | 30031 | 1.505952381 |
| 40035 | 30032 | 1.503267974 |
| 40036 | 30033 | 1.503267974 |
| 40037 | 30034 | 1.5 |
| 40038 | 30035 | 1.5 |
| 40039 | 30036 | 1.5 |
| 40040 | 30037 | 1.498746867 |
| 40041 | 30038 | 1.495934959 |
| 40042 | 30039 | 1.495934959 |
| 40043 | 30040 | 1.495934959 |
| 40044 | 30041 | 1.495934959 |
| 40045 | 30042 | 1.495934959 |
| 40046 | 30043 | 1.495934959 |
| 40047 | 30044 | 1.495934959 |
| 40048 | 30045 | 1.495934959 |
| 40049 | 30046 | 1.495934959 |
| 40050 | 30047 | 1.492625369 |
| 40051 | 30048 | 1.490740741 |
| 40052 | 30049 | 1.490740741 |
| 40053 | 30050 | 1.490740741 |
| 40054 | 30051 | 1.487562189 |
| 40055 | 30052 | 1.483870968 |
| 40056 | 30053 | 1.483870968 |

FIG. 6 (Cont.)

| DNA SEQ ID NO | AA SEQ ID NO | Kidney 1 Enrichment |
|---|---|---|
| 40057 | 30054 | 1.483870968 |
| 40058 | 30055 | 1.483870968 |
| 40059 | 30056 | 1.483870968 |
| 40060 | 30057 | 1.483870968 |
| 40061 | 30058 | 1.483870968 |
| 40062 | 30059 | 1.483870968 |
| 40063 | 30060 | 1.483870968 |
| 40064 | 30061 | 1.483870968 |
| 40065 | 30062 | 1.483870968 |
| 40066 | 30063 | 1.483870968 |
| 40067 | 30064 | 1.481060606 |
| 40068 | 30065 | 1.477911647 |
| 40069 | 30066 | 1.477911647 |
| 40070 | 30067 | 1.477911647 |
| 40071 | 30068 | 1.477911647 |
| 40072 | 30069 | 1.474358974 |
| 40073 | 30070 | 1.474358974 |
| 40074 | 30071 | 1.474358974 |
| 40075 | 30072 | 1.474358974 |
| 40076 | 30073 | 1.474358974 |
| 40077 | 30074 | 1.474358974 |
| 40078 | 30075 | 1.474358974 |
| 40079 | 30076 | 1.470319635 |
| 40080 | 30077 | 1.470319635 |
| 40081 | 30078 | 1.470319635 |
| 40082 | 30079 | 1.468085106 |
| 40083 | 30080 | 1.468085106 |
| 40084 | 30081 | 1.468085106 |
| 40085 | 30082 | 1.466666667 |
| 40086 | 30083 | 1.465686275 |
| 40087 | 30084 | 1.46031746 |
| 40088 | 30085 | 1.46031746 |
| 40089 | 30086 | 1.46031746 |
| 40090 | 30087 | 1.46031746 |
| 40091 | 30088 | 1.46031746 |
| 40092 | 30089 | 1.46031746 |
| 40093 | 30090 | 1.46031746 |
| 40094 | 30091 | 1.46031746 |
| 40095 | 30092 | 1.46031746 |
| 40096 | 30093 | 1.46031746 |
| 40097 | 30094 | 1.46031746 |
| 40098 | 30095 | 1.46031746 |
| 40099 | 30096 | 1.46031746 |
| 40100 | 30097 | 1.46031746 |
| 40101 | 30098 | 1.46031746 |
| 40102 | 30099 | 1.46031746 |
| 40103 | 30100 | 1.46031746 |
| 40104 | 30101 | 1.46031746 |
| 40105 | 30102 | 1.46031746 |
| 40106 | 30103 | 1.46031746 |
| 40107 | 30104 | 1.46031746 |
| 40108 | 30105 | 1.454987835 |
| 40109 | 30106 | 1.454987835 |
| 40110 | 30107 | 1.454022989 |
| 40111 | 30108 | 1.45045045 |
| 40112 | 30109 | 1.45045045 |
| 40113 | 30110 | 1.45045045 |
| 40114 | 30111 | 1.45045045 |
| 40115 | 30112 | 1.446540881 |
| 40116 | 30113 | 1.446540881 |
| 40117 | 30114 | 1.446540881 |
| 40118 | 30115 | 1.446540881 |
| 40119 | 30116 | 1.446540881 |
| 40120 | 30117 | 1.446540881 |
| 40121 | 30118 | 1.446540881 |
| 40122 | 30119 | 1.446540881 |
| 40123 | 30120 | 1.443137255 |
| 40124 | 30121 | 1.441595442 |
| 40125 | 30122 | 1.441595442 |
| 40126 | 30123 | 1.4375 |
| 40127 | 30124 | 1.4375 |
| 40128 | 30125 | 1.4375 |
| 40129 | 30126 | 1.4375 |
| 40130 | 30127 | 1.4375 |
| 40131 | 30128 | 1.4375 |
| 40132 | 30129 | 1.4375 |
| 40133 | 30130 | 1.4375 |
| 40134 | 30131 | 1.4375 |
| 40135 | 30132 | 1.4375 |
| 40136 | 30133 | 1.4375 |
| 40137 | 30134 | 1.4375 |
| 40138 | 30135 | 1.4375 |
| 40139 | 30136 | 1.433021807 |
| 40140 | 30137 | 1.431111111 |
| 40141 | 30138 | 1.431111111 |
| 40142 | 30139 | 1.431111111 |
| 40143 | 30140 | 1.431111111 |
| 40144 | 30141 | 1.429378531 |
| 40145 | 30142 | 1.426356589 |
| 40146 | 30143 | 1.426356589 |
| 40147 | 30144 | 1.426356589 |
| 40148 | 30145 | 1.426356589 |
| 40149 | 30146 | 1.426356589 |
| 40150 | 30147 | 1.426356589 |
| 40151 | 30148 | 1.426356589 |
| 40152 | 30149 | 1.426356589 |
| 40153 | 30150 | 1.426356589 |
| 40154 | 30151 | 1.426356589 |
| 40155 | 30152 | 1.426356589 |
| 40156 | 30153 | 1.422680412 |
| 40157 | 30154 | 1.422680412 |
| 40158 | 30155 | 1.422680412 |
| 40159 | 30156 | 1.422680412 |
| 40160 | 30157 | 1.422680412 |
| 40161 | 30158 | 1.420849421 |
| 40162 | 30159 | 1.419753086 |
| 40163 | 30160 | 1.419753086 |
| 40164 | 30161 | 1.419753086 |
| 40165 | 30162 | 1.419753086 |
| 40166 | 30163 | 1.419753086 |
| 40167 | 30164 | 1.419753086 |
| 40168 | 30165 | 1.419753086 |
| 40169 | 30166 | 1.419753086 |
| 40170 | 30167 | 1.415384615 |
| 40171 | 30168 | 1.415384615 |
| 40172 | 30169 | 1.412280702 |
| 40173 | 30170 | 1.412280702 |
| 40174 | 30171 | 1.412280702 |
| 40175 | 30172 | 1.412280702 |
| 40176 | 30173 | 1.409961686 |
| 40177 | 30174 | 1.409961686 |
| 40178 | 30175 | 1.409961686 |
| 40179 | 30176 | 1.408163265 |
| 40180 | 30177 | 1.406727829 |
| 40181 | 30178 | 1.405555556 |
| 40182 | 30179 | 1.404580153 |
| 40183 | 30180 | 1.404580153 |
| 40184 | 30181 | 1.402439024 |
| 40185 | 30182 | 1.401904762 |
| 40186 | 30183 | 1.393939394 |
| 40187 | 30184 | 1.393939394 |
| 40188 | 30185 | 1.393939394 |
| 40189 | 30186 | 1.393939394 |
| 40190 | 30187 | 1.393939394 |
| 40191 | 30188 | 1.393939394 |
| 40192 | 30189 | 1.393939394 |
| 40193 | 30190 | 1.393939394 |
| 40194 | 30191 | 1.393939394 |
| 40195 | 30192 | 1.393939394 |
| 40196 | 30193 | 1.393939394 |
| 40197 | 30194 | 1.393939394 |
| 40198 | 30195 | 1.393939394 |
| 40199 | 30196 | 1.393939394 |
| 40200 | 30197 | 1.393939394 |
| 40201 | 30198 | 1.393939394 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 40202 | 30199 | 1.393939394 | 40231 | 30228 | 1.383458647 | 40260 | 30257 | 1.358649789 | 40289 | 30286 | 1.333333333 | 40318 | 30315 | 1.314285714 |
| 40203 | 30200 | 1.393939394 | 40232 | 30229 | 1.382513661 | 40261 | 30258 | 1.35600907 | 40290 | 30287 | 1.333333333 | 40319 | 30316 | 1.314285714 |
| 40204 | 30201 | 1.393939394 | 40233 | 30230 | 1.38 | 40262 | 30259 | 1.352941176 | 40291 | 30288 | 1.333333333 | 40320 | 30317 | 1.314285714 |
| 40205 | 30202 | 1.393939394 | 40234 | 30231 | 1.38 | 40263 | 30260 | 1.352941176 | 40292 | 30289 | 1.333333333 | 40321 | 30318 | 1.314285714 |
| 40206 | 30203 | 1.393939394 | 40235 | 30232 | 1.378277154 | 40264 | 30261 | 1.352941176 | 40293 | 30290 | 1.333333333 | 40322 | 30319 | 1.314285714 |
| 40207 | 30204 | 1.393939394 | 40236 | 30233 | 1.376068376 | 40265 | 30262 | 1.352941176 | 40294 | 30291 | 1.333333333 | 40323 | 30320 | 1.308943089 |
| 40208 | 30205 | 1.393939394 | 40237 | 30234 | 1.376068376 | 40266 | 30263 | 1.352941176 | 40295 | 30292 | 1.333333333 | 40324 | 30321 | 1.304964539 |
| 40209 | 30206 | 1.393939394 | 40238 | 30235 | 1.373134328 | 40267 | 30264 | 1.352941176 | 40296 | 30293 | 1.333333333 | 40325 | 30322 | 1.304964539 |
| 40210 | 30207 | 1.393939394 | 40239 | 30236 | 1.373134328 | 40268 | 30265 | 1.352941176 | 40297 | 30294 | 1.333333333 | 40326 | 30323 | 1.304964539 |
| 40211 | 30208 | 1.393939394 | 40240 | 30237 | 1.373134328 | 40269 | 30266 | 1.352941176 | 40298 | 30295 | 1.333333333 | 40327 | 30324 | 1.304964539 |
| 40212 | 30209 | 1.393939394 | 40241 | 30238 | 1.373134328 | 40270 | 30267 | 1.352941176 | 40299 | 30296 | 1.333333333 | 40328 | 30325 | 1.304964539 |
| 40213 | 30210 | 1.393939394 | 40242 | 30239 | 1.373134328 | 40271 | 30268 | 1.349333333 | 40300 | 30297 | 1.333333333 | 40329 | 30326 | 1.304964539 |
| 40214 | 30211 | 1.393939394 | 40243 | 30240 | 1.369047619 | 40272 | 30269 | 1.347985348 | 40301 | 30298 | 1.333333333 | 40330 | 30327 | 1.304964539 |
| 40215 | 30212 | 1.393939394 | 40244 | 30241 | 1.369047619 | 40273 | 30270 | 1.347985348 | 40302 | 30299 | 1.333333333 | 40331 | 30328 | 1.304964539 |
| 40216 | 30213 | 1.393939394 | 40245 | 30242 | 1.369047619 | 40274 | 30271 | 1.347985348 | 40303 | 30300 | 1.326923077 | 40332 | 30329 | 1.304964539 |
| 40217 | 30214 | 1.393939394 | 40246 | 30243 | 1.369047619 | 40275 | 30272 | 1.34502924 | 40304 | 30301 | 1.326923077 | 40333 | 30330 | 1.304964539 |
| 40218 | 30215 | 1.393939394 | 40247 | 30244 | 1.369047619 | 40276 | 30273 | 1.34502924 | 40305 | 30302 | 1.32183908 | 40334 | 30331 | 1.301886792 |
| 40219 | 30216 | 1.393939394 | 40248 | 30245 | 1.369047619 | 40277 | 30274 | 1.34502924 | 40306 | 30303 | 1.32183908 | 40335 | 30332 | 1.299435028 |
| 40220 | 30217 | 1.393939394 | 40249 | 30246 | 1.366336634 | 40278 | 30275 | 1.34502924 | 40307 | 30304 | 1.32183908 | 40336 | 30333 | 1.299435028 |
| 40221 | 30218 | 1.393939394 | 40250 | 30247 | 1.364746946 | 40279 | 30276 | 1.34502924 | 40308 | 30305 | 1.32183908 | 40337 | 30334 | 1.299435028 |
| 40222 | 30219 | 1.393939394 | 40251 | 30248 | 1.362962963 | 40280 | 30277 | 1.34502924 | 40309 | 30306 | 1.318996416 | 40338 | 30335 | 1.299435028 |
| 40223 | 30220 | 1.393939394 | 40252 | 30249 | 1.362962963 | 40281 | 30278 | 1.34502924 | 40310 | 30307 | 1.318996416 | 40339 | 30336 | 1.299435028 |
| 40224 | 30221 | 1.393939394 | 40253 | 30250 | 1.362962963 | 40282 | 30279 | 1.34502924 | 40311 | 30308 | 1.318996416 | 40340 | 30337 | 1.299435028 |
| 40225 | 30222 | 1.393939394 | 40254 | 30251 | 1.362962963 | 40283 | 30280 | 1.34502924 | 40312 | 30309 | 1.317708333 | 40341 | 30338 | 1.299435028 |
| 40226 | 30223 | 1.393939394 | 40255 | 30252 | 1.362962963 | 40284 | 30281 | 1.341666667 | 40313 | 30310 | 1.314285714 | 40342 | 30339 | 1.295774648 |
| 40227 | 30224 | 1.393939394 | 40256 | 30253 | 1.362962963 | 40285 | 30282 | 1.341666667 | 40314 | 30311 | 1.314285714 | 40343 | 30340 | 1.295774648 |
| 40228 | 30225 | 1.393939394 | 40257 | 30254 | 1.362962963 | 40286 | 30283 | 1.341666667 | 40315 | 30312 | 1.314285714 | 40344 | 30341 | 1.293172691 |
| 40229 | 30226 | 1.393939394 | 40258 | 30255 | 1.358649789 | 40287 | 30284 | 1.333333333 | 40316 | 30313 | 1.314285714 | 40345 | 30342 | 1.293172691 |
| 40230 | 30227 | 1.393939394 | 40259 | 30256 | 1.358649789 | 40288 | 30285 | 1.333333333 | 40317 | 30314 | 1.314285714 | 40346 | 30343 | 1.287531807 |

FIG. 6 (Cont.)

| DNA SEQ ID NO | AA SEQ ID NO | Kidney 1 Enrichment |
|---|---|---|
| 40347 | 30344 | 1.277777778 |
| 40348 | 30345 | 1.277777778 |
| 40349 | 30346 | 1.277777778 |
| 40350 | 30347 | 1.277777778 |
| 40351 | 30348 | 1.277777778 |
| 40352 | 30349 | 1.277777778 |
| 40353 | 30350 | 1.277777778 |
| 40354 | 30351 | 1.277777778 |
| 40355 | 30352 | 1.277777778 |
| 40356 | 30353 | 1.277777778 |
| 40357 | 30354 | 1.277777778 |
| 40358 | 30355 | 1.277777778 |
| 40359 | 30356 | 1.277777778 |
| 40360 | 30357 | 1.277777778 |
| 40361 | 30358 | 1.277777778 |
| 40362 | 30359 | 1.277777778 |
| 40363 | 30360 | 1.277777778 |
| 40364 | 30361 | 1.277777778 |
| 40365 | 30362 | 1.277777778 |
| 40366 | 30363 | 1.277777778 |
| 40367 | 30364 | 1.277777778 |
| 40368 | 30365 | 1.277777778 |
| 40369 | 30366 | 1.277777778 |
| 40370 | 30367 | 1.277777778 |
| 40371 | 30368 | 1.277777778 |
| 40372 | 30369 | 1.277777778 |
| 40373 | 30370 | 1.277777778 |
| 40374 | 30371 | 1.277777778 |
| 40375 | 30372 | 1.267217631 |
| 40376 | 30373 | 1.266055046 |
| 40377 | 30374 | 1.264604811 |
| 40378 | 30375 | 1.262745098 |
| 40379 | 30376 | 1.262745098 |
| 40380 | 30377 | 1.262745098 |
| 40381 | 30378 | 1.262745098 |
| 40382 | 30379 | 1.260273973 |
| 40383 | 30380 | 1.260273973 |
| 40384 | 30381 | 1.260273973 |
| 40385 | 30382 | 1.260273973 |
| 40386 | 30383 | 1.256830601 |
| 40387 | 30384 | 1.256830601 |
| 40388 | 30385 | 1.256830601 |
| 40389 | 30386 | 1.256830601 |
| 40390 | 30387 | 1.256830601 |
| 40391 | 30388 | 1.256830601 |
| 40392 | 30389 | 1.254545455 |
| 40393 | 30390 | 1.254545455 |
| 40394 | 30391 | 1.254545455 |
| 40395 | 30392 | 1.254545455 |
| 40396 | 30393 | 1.25170068 |
| 40397 | 30394 | 1.25170068 |
| 40398 | 30395 | 1.25170068 |
| 40399 | 30396 | 1.25170068 |
| 40400 | 30397 | 1.245833333 |
| 40401 | 30398 | 1.243243243 |
| 40402 | 30399 | 1.243243243 |
| 40403 | 30400 | 1.243243243 |
| 40404 | 30401 | 1.243243243 |
| 40405 | 30402 | 1.243243243 |
| 40406 | 30403 | 1.243243243 |
| 40407 | 30404 | 1.243243243 |
| 40408 | 30405 | 1.243243243 |
| 40409 | 30406 | 1.243243243 |
| 40410 | 30407 | 1.243243243 |
| 40411 | 30408 | 1.243243243 |
| 40412 | 30409 | 1.243243243 |
| 40413 | 30410 | 1.239057239 |
| 40414 | 30411 | 1.239057239 |
| 40415 | 30412 | 1.23655914 |
| 40416 | 30413 | 1.23655914 |
| 40417 | 30414 | 1.23655914 |
| 40418 | 30415 | 1.23655914 |
| 40419 | 30416 | 1.233716475 |
| 40420 | 30417 | 1.233716475 |
| 40421 | 30418 | 1.232142857 |
| 40422 | 30419 | 1.231143552 |
| 40423 | 30420 | 1.230452675 |
| 40424 | 30421 | 1.226666667 |
| 40425 | 30422 | 1.226666667 |
| 40426 | 30423 | 1.226666667 |
| 40427 | 30424 | 1.226666667 |
| 40428 | 30425 | 1.226666667 |
| 40429 | 30426 | 1.226666667 |
| 40430 | 30427 | 1.226666667 |
| 40431 | 30428 | 1.226666667 |
| 40432 | 30429 | 1.226666667 |
| 40433 | 30430 | 1.226666667 |
| 40434 | 30431 | 1.226666667 |
| 40435 | 30432 | 1.226666667 |
| 40436 | 30433 | 1.226666667 |
| 40437 | 30434 | 1.221238938 |
| 40438 | 30435 | 1.21969697 |
| 40439 | 30436 | 1.21969697 |
| 40440 | 30437 | 1.21969697 |
| 40441 | 30438 | 1.216931217 |
| 40442 | 30439 | 1.216931217 |
| 40443 | 30440 | 1.216931217 |
| 40444 | 30441 | 1.216931217 |
| 40445 | 30442 | 1.210526316 |
| 40446 | 30443 | 1.210526316 |
| 40447 | 30444 | 1.210526316 |
| 40448 | 30445 | 1.210526316 |
| 40449 | 30446 | 1.210526316 |
| 40450 | 30447 | 1.210526316 |
| 40451 | 30448 | 1.210526316 |
| 40452 | 30449 | 1.210526316 |
| 40453 | 30450 | 1.210526316 |
| 40454 | 30451 | 1.210526316 |
| 40455 | 30452 | 1.210526316 |
| 40456 | 30453 | 1.210526316 |
| 40457 | 30454 | 1.210526316 |
| 40458 | 30455 | 1.210526316 |
| 40459 | 30456 | 1.210526316 |
| 40460 | 30457 | 1.210526316 |
| 40461 | 30458 | 1.205992509 |
| 40462 | 30459 | 1.202614379 |
| 40463 | 30460 | 1.202614379 |
| 40464 | 30461 | 1.202614379 |
| 40465 | 30462 | 1.202614379 |
| 40466 | 30463 | 1.202614379 |
| 40467 | 30464 | 1.202614379 |
| 40468 | 30465 | 1.202614379 |
| 40469 | 30466 | 1.2 |
| 40470 | 30467 | 1.197916667 |
| 40471 | 30468 | 1.197916667 |
| 40472 | 30469 | 1.197916667 |
| 40473 | 30470 | 1.194805195 |
| 40474 | 30471 | 1.194805195 |
| 40475 | 30472 | 1.194805195 |
| 40476 | 30473 | 1.192592593 |
| 40477 | 30474 | 1.192592593 |
| 40478 | 30475 | 1.190938511 |
| 40479 | 30476 | 1.190938511 |
| 40480 | 30477 | 1.179487179 |
| 40481 | 30478 | 1.179487179 |
| 40482 | 30479 | 1.179487179 |
| 40483 | 30480 | 1.179487179 |
| 40484 | 30481 | 1.179487179 |
| 40485 | 30482 | 1.179487179 |
| 40486 | 30483 | 1.179487179 |
| 40487 | 30484 | 1.179487179 |
| 40488 | 30485 | 1.179487179 |
| 40489 | 30486 | 1.179487179 |
| 40490 | 30487 | 1.179487179 |
| 40491 | 30488 | 1.179487179 |

FIG. 6 (Cont.)

| DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment | DNA SEQ ID NO | AA SEQ ID NO | Kidney 1 Enrichment |
|---|---|---|---|---|---|---|---|---|---|---|---|---|---|---|
| 40492 | 30489 | 1.179487179 | 40521 | 30518 | 1.157232704 | 40550 | 30547 | 1.135802469 | 40579 | 30576 | 1.115151515 | 40608 | 30605 | 1.095238095 |
| 40493 | 30490 | 1.179487179 | 40522 | 30519 | 1.154121864 | 40551 | 30548 | 1.135802469 | 40580 | 30577 | 1.115151515 | 40609 | 30606 | 1.095238095 |
| 40494 | 30491 | 1.179487179 | 40523 | 30520 | 1.154121864 | 40552 | 30549 | 1.135802469 | 40581 | 30578 | 1.115151515 | 40610 | 30607 | 1.095238095 |
| 40495 | 30492 | 1.179487179 | 40524 | 30521 | 1.154121864 | 40553 | 30550 | 1.135802469 | 40582 | 30579 | 1.115151515 | 40611 | 30608 | 1.095238095 |
| 40496 | 30493 | 1.179487179 | 40525 | 30522 | 1.154121864 | 40554 | 30551 | 1.135802469 | 40583 | 30580 | 1.115151515 | 40612 | 30609 | 1.095238095 |
| 40497 | 30494 | 1.179487179 | 40526 | 30523 | 1.15 | 40555 | 30552 | 1.135802469 | 40584 | 30581 | 1.115151515 | 40613 | 30610 | 1.095238095 |
| 40498 | 30495 | 1.179487179 | 40527 | 30524 | 1.15 | 40556 | 30553 | 1.135802469 | 40585 | 30582 | 1.115151515 | 40614 | 30611 | 1.095238095 |
| 40499 | 30496 | 1.179487179 | 40528 | 30525 | 1.15 | 40557 | 30554 | 1.135802469 | 40586 | 30583 | 1.111111111 | 40615 | 30612 | 1.095238095 |
| 40500 | 30497 | 1.179487179 | 40529 | 30526 | 1.15 | 40558 | 30555 | 1.129824561 | 40587 | 30584 | 1.111111111 | 40616 | 30613 | 1.095238095 |
| 40501 | 30498 | 1.179487179 | 40530 | 30527 | 1.15 | 40559 | 30556 | 1.129824561 | 40588 | 30585 | 1.111111111 | 40617 | 30614 | 1.095238095 |
| 40502 | 30499 | 1.179487179 | 40531 | 30528 | 1.15 | 40560 | 30557 | 1.128834356 | 40589 | 30586 | 1.111111111 | 40618 | 30615 | 1.095238095 |
| 40503 | 30500 | 1.179487179 | 40532 | 30529 | 1.15 | 40561 | 30558 | 1.12745098 | 40590 | 30587 | 1.111111111 | 40619 | 30616 | 1.095238095 |
| 40504 | 30501 | 1.179487179 | 40533 | 30530 | 1.15 | 40562 | 30559 | 1.12745098 | 40591 | 30588 | 1.111111111 | 40620 | 30617 | 1.095238095 |
| 40505 | 30502 | 1.179487179 | 40534 | 30531 | 1.144278607 | 40563 | 30560 | 1.12745098 | 40592 | 30589 | 1.111111111 | 40621 | 30618 | 1.095238095 |
| 40506 | 30503 | 1.179487179 | 40535 | 30532 | 1.144278607 | 40564 | 30561 | 1.125382263 | 40593 | 30590 | 1.109649123 | 40622 | 30619 | 1.095238095 |
| 40507 | 30504 | 1.179487179 | 40536 | 30533 | 1.144278607 | 40565 | 30562 | 1.12195122 | 40594 | 30591 | 1.108433735 | 40623 | 30620 | 1.095238095 |
| 40508 | 30505 | 1.179487179 | 40537 | 30534 | 1.144278607 | 40566 | 30563 | 1.12195122 | 40595 | 30592 | 1.108433735 | 40624 | 30621 | 1.095238095 |
| 40509 | 30506 | 1.179487179 | 40538 | 30535 | 1.141843972 | 40567 | 30564 | 1.12195122 | 40596 | 30593 | 1.104 | 40625 | 30622 | 1.095238095 |
| 40510 | 30507 | 1.169491525 | 40539 | 30536 | 1.141843972 | 40568 | 30565 | 1.12195122 | 40597 | 30594 | 1.102396514 | 40626 | 30623 | 1.095238095 |
| 40511 | 30508 | 1.169491525 | 40540 | 30537 | 1.141843972 | 40569 | 30566 | 1.12195122 | 40598 | 30595 | 1.095238095 | 40627 | 30624 | 1.095238095 |
| 40512 | 30509 | 1.168253968 | 40541 | 30538 | 1.141843972 | 40570 | 30567 | 1.12195122 | 40599 | 30596 | 1.095238095 | 40628 | 30625 | 1.084175084 |
| 40513 | 30510 | 1.164556962 | 40542 | 30539 | 1.135802469 | 40571 | 30568 | 1.12195122 | 40600 | 30597 | 1.095238095 | 40629 | 30626 | 1.084175084 |
| 40514 | 30511 | 1.164556962 | 40543 | 30540 | 1.135802469 | 40572 | 30569 | 1.12195122 | 40601 | 30598 | 1.095238095 | 40630 | 30627 | 1.082352941 |
| 40515 | 30512 | 1.164556962 | 40544 | 30541 | 1.135802469 | 40573 | 30570 | 1.12195122 | 40602 | 30599 | 1.095238095 | 40631 | 30628 | 1.079812207 |
| 40516 | 30513 | 1.164556962 | 40545 | 30542 | 1.135802469 | 40574 | 30571 | 1.12195122 | 40603 | 30600 | 1.095238095 | 40632 | 30629 | 1.079812207 |
| 40517 | 30514 | 1.164556962 | 40546 | 30543 | 1.135802469 | 40575 | 30572 | 1.12195122 | 40604 | 30601 | 1.095238095 | 40633 | 30630 | 1.079812207 |
| 40518 | 30515 | 1.161616162 | 40547 | 30544 | 1.135802469 | 40576 | 30573 | 1.119221411 | 40605 | 30602 | 1.095238095 | 40634 | 30631 | 1.078125 |
| 40519 | 30516 | 1.161616162 | 40548 | 30545 | 1.135802469 | 40577 | 30574 | 1.118055556 | 40606 | 30603 | 1.095238095 | 40635 | 30632 | 1.076023392 |
| 40520 | 30517 | 1.157232704 | 40549 | 30546 | 1.135802469 | 40578 | 30575 | 1.115151515 | 40607 | 30604 | 1.095238095 | 40636 | 30633 | 1.076023392 |

FIG. 6 (Cont.)

| DNA SEQ ID NO | AA SEQ ID NO | Kidney 1 Enrichment |
|---|---|---|
| 40637 | 30634 | 1.076023392 |
| 40638 | 30635 | 1.069767442 |
| 40639 | 30636 | 1.069767442 |
| 40640 | 30637 | 1.069767442 |
| 40641 | 30638 | 1.069767442 |
| 40642 | 30639 | 1.069767442 |
| 40643 | 30640 | 1.069767442 |
| 40644 | 30641 | 1.069767442 |
| 40645 | 30642 | 1.069767442 |
| 40646 | 30643 | 1.069767442 |
| 40647 | 30644 | 1.064814815 |
| 40648 | 30645 | 1.062706271 |
| 40649 | 30646 | 1.057471264 |
| 40650 | 30647 | 1.057471264 |
| 40651 | 30648 | 1.057471264 |
| 40652 | 30649 | 1.057471264 |
| 40653 | 30650 | 1.057471264 |
| 40654 | 30651 | 1.057471264 |

| DNA SEQ ID NO | AA SEQ ID NO | Kidney 1 Enrichment |
|---|---|---|
| 40655 | 30652 | 1.057471264 |
| 40656 | 30653 | 1.057471264 |
| 40657 | 30654 | 1.057471264 |
| 40658 | 30655 | 1.057471264 |
| 40659 | 30656 | 1.057471264 |
| 40660 | 30657 | 1.057471264 |
| 40661 | 30658 | 1.057471264 |
| 40662 | 30659 | 1.057471264 |
| 40663 | 30660 | 1.057471264 |
| 40664 | 30661 | 1.050228311 |
| 40665 | 30662 | 1.050228311 |
| 40666 | 30663 | 1.050228311 |
| 40667 | 30664 | 1.050228311 |
| 40668 | 30665 | 1.050228311 |
| 40669 | 30666 | 1.050228311 |
| 40670 | 30667 | 1.048433048 |
| 40671 | 30668 | 1.045454545 |
| 40672 | 30669 | 1.045454545 |

| DNA SEQ ID NO | AA SEQ ID NO | Kidney 1 Enrichment |
|---|---|---|
| 40673 | 30670 | 1.045454545 |
| 40674 | 30671 | 1.045454545 |
| 40675 | 30672 | 1.045454545 |
| 40676 | 30673 | 1.045454545 |
| 40677 | 30674 | 1.045454545 |
| 40678 | 30675 | 1.045454545 |
| 40679 | 30676 | 1.045454545 |
| 40680 | 30677 | 1.042071197 |
| 40681 | 30678 | 1.039548023 |
| 40682 | 30679 | 1.039548023 |
| 40683 | 30680 | 1.039548023 |
| 40684 | 30681 | 1.039548023 |
| 40685 | 30682 | 1.036036036 |
| 40686 | 30683 | 1.032051282 |
| 40687 | 30684 | 1.030812325 |
| 40688 | 30685 | 1.029850746 |
| 40689 | 30686 | 1.022222222 |
| 40690 | 30687 | 1.022222222 |

| DNA SEQ ID NO | AA SEQ ID NO | Kidney 1 Enrichment |
|---|---|---|
| 40691 | 30688 | 1.022222222 |
| 40692 | 30689 | 1.022222222 |
| 40693 | 30690 | 1.022222222 |
| 40694 | 30691 | 1.022222222 |
| 40695 | 30692 | 1.022222222 |
| 40696 | 30693 | 1.022222222 |
| 40697 | 30694 | 1.022222222 |
| 40698 | 30695 | 1.022222222 |
| 40699 | 30696 | 1.022222222 |
| 40700 | 30697 | 1.022222222 |
| 40701 | 30698 | 1.022222222 |
| 40702 | 30699 | 1.022222222 |
| 40703 | 30700 | 1.022222222 |
| 40704 | 30701 | 1.022222222 |
| 40705 | 30702 | 1.022222222 |
| 40706 | 30703 | 1.022222222 |
| 40707 | 30704 | 1.022222222 |
| 40708 | 30705 | 1.022222222 |

| DNA SEQ ID NO | AA SEQ ID NO | Kidney 1 Enrichment |
|---|---|---|
| 40709 | 30706 | 1.022222222 |
| 40710 | 30707 | 1.022222222 |
| 40711 | 30708 | 1.022222222 |
| 40712 | 30709 | 1.022222222 |
| 40713 | 30710 | 1.022222222 |
| 40714 | 30711 | 1.012578616 |
| 40715 | 30712 | 1.010989011 |
| 40716 | 30713 | 1.010989011 |
| 40717 | 30714 | 1.00877193 |
| 40718 | 30715 | 1.00877193 |
| 40719 | 30716 | 1.00877193 |
| 40720 | 30717 | 1.00877193 |
| 40721 | 30718 | 1.005464481 |
| 40722 | 30719 | 1.005464481 |

FIG. 7

| DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment |
|---|---|---|---|---|---|---|---|---|---|---|---|---|---|---|---|
| 40723 | 30720 | 5.227272727 | 3.538461538 | 40749 | 30746 | 1.870813397 | 1.978744939 | 40775 | 30772 | 1.524621212 | 1.492788462 | 40801 | 30798 | 1.36489899 | 1.277777778 |
| 40724 | 30721 | 5.084710744 | 2.573426573 | 40750 | 30747 | 1.858585859 | 1.990384615 | 40776 | 30773 | 1.517595308 | 2.168734491 | 40802 | 30799 | 1.356265356 | 1.123700624 |
| 40725 | 30722 | 4.122077922 | 3.525824176 | 40751 | 30748 | 1.844919786 | 1.209841629 | 40777 | 30774 | 1.512572534 | 1.505728314 | 40803 | 30800 | 1.352941176 | 3.052790347 |
| 40726 | 30723 | 3.659090909 | 4.201923077 | 40752 | 30749 | 1.829545455 | 1.105769231 | 40778 | 30775 | 1.493506494 | 2.021978022 | 40804 | 30801 | 1.347474747 | 1.061538462 |
| 40727 | 30724 | 3.136363636 | 1.326923077 | 40753 | 30750 | 1.796875 | 1.520432692 | 40779 | 30776 | 1.493506494 | 1.453296703 | 40805 | 30802 | 1.347027972 | 1.122781065 |
| 40728 | 30725 | 3.090909091 | 2.807692308 | 40754 | 30751 | 1.792207792 | 1.39010989 | 40780 | 30777 | 1.493506494 | 2.021978022 | 40806 | 30803 | 1.34032634 | 1.088757396 |
| 40729 | 30726 | 3.055944056 | 2.517751479 | 40755 | 30752 | 1.787390029 | 1.598014888 | 40781 | 30778 | 1.478935698 | 7.141651032 | 40807 | 30804 | 1.339488636 | 1.592307692 |
| 40730 | 30727 | 3.013368984 | 4.475113122 | 40756 | 30753 | 1.777272727 | 1.857692308 | 40782 | 30779 | 1.475935829 | 1.509049774 | 40808 | 30805 | 1.327803583 | 1.478663672 |
| 40731 | 30728 | 2.955667789 | 2.178774929 | 40757 | 30754 | 1.777272727 | 1.238461538 | 40783 | 30780 | 1.473140496 | 1.145979021 | 40809 | 30806 | 1.326322931 | 1.161882893 |
| 40732 | 30729 | 2.923400673 | 1.015669516 | 40758 | 30755 | 1.756794752 | 1.942505948 | 40784 | 30781 | 1.473140496 | 1.005244755 | 40810 | 30807 | 1.324242424 | 1.518589744 |
| 40733 | 30730 | 2.882063882 | 1.47037422 | 40759 | 30756 | 1.742424242 | 1.503846154 | 40785 | 30782 | 1.470724191 | 1.859191656 | 40811 | 30808 | 1.322820037 | 1.335949765 |
| 40734 | 30731 | 2.852597403 | 1.074175824 | 40760 | 30757 | 1.669059011 | 1.458839406 | 40786 | 30783 | 1.463636364 | 1.194230769 | 40812 | 30809 | 1.318881119 | 1.047928994 |
| 40735 | 30732 | 2.851239669 | 2.573426573 | 40761 | 30758 | 1.666827853 | 1.373977087 | 40787 | 30784 | 1.444628099 | 1.238461538 | 40813 | 30810 | 1.314285714 | 1.023626374 |
| 40736 | 30733 | 2.800324675 | 1.216346154 | 40762 | 30759 | 1.638820639 | 1.004158004 | 40788 | 30785 | 1.443722944 | 1.221611722 | 40814 | 30811 | 1.306818182 | 1.232142857 |
| 40737 | 30734 | 2.566115702 | 3.833333333 | 40763 | 30760 | 1.636363636 | 1.211538462 | 40789 | 30786 | 1.442462601 | 1.466893866 | 40815 | 30812 | 1.302797203 | 1.279289941 |
| 40738 | 30735 | 2.538961039 | 1.769230769 | 40764 | 30761 | 1.631929047 | 1.100375235 | 40790 | 30787 | 1.439393939 | 1.192307692 | 40816 | 30813 | 1.300443459 | 1.672138837 |
| 40739 | 30736 | 2.352272727 | 1.105769231 | 40765 | 30762 | 1.628964059 | 1.398926655 | 40791 | 30788 | 1.436179982 | 1.331390831 | 40817 | 30814 | 1.296363636 | 1.096923077 |
| 40740 | 30737 | 2.352272727 | 1.769230769 | 40766 | 30763 | 1.585043988 | 1.255583127 | 40792 | 30789 | 1.425619835 | 1.548076923 | 40818 | 30815 | 1.296363636 | 5.118974359 |
| 40741 | 30738 | 2.3 | 1.326923077 | 40767 | 30764 | 1.575544174 | 1.270855905 | 40793 | 30790 | 1.421348315 | 1.500864304 | 40819 | 30816 | 1.294372294 | 1.053113553 |
| 40742 | 30739 | 2.3 | 1.592307692 | 40768 | 30765 | 1.568181818 | 1.326923077 | 40794 | 30791 | 1.418831169 | 1.105769231 | 40820 | 30817 | 1.281524927 | 1.612282878 |
| 40743 | 30740 | 2.233471074 | 2.452797203 | 40769 | 30766 | 1.568181818 | 1.326923077 | 40795 | 30792 | 1.418831169 | 1.358516484 | 40821 | 30818 | 1.277777778 | 1.4375 |
| 40744 | 30741 | 2.153636364 | 4.14 | 40770 | 30767 | 1.568181818 | 1.326923077 | 40796 | 30793 | 1.414438503 | 1.114479638 | 40822 | 30819 | 1.277777778 | 1.277777778 |
| 40745 | 30742 | 2.090909091 | 3.538461538 | 40771 | 30768 | 1.568181818 | 2.653846154 | 40797 | 30794 | 1.40684624 | 1.234093067 | 40823 | 30820 | 1.273310023 | 1.49704142 |
| 40746 | 30743 | 1.974747475 | 1.965811966 | 40772 | 30769 | 1.568181818 | 2.211538462 | 40798 | 30795 | 1.393939394 | 2.948717949 | 40824 | 30821 | 1.272727273 | 1.596153846 |
| 40747 | 30744 | 1.916666667 | 1.621794872 | 40773 | 30770 | 1.596125519 | 1.044136192 | 40799 | 30796 | 1.384520885 | 1.434511435 | 40825 | 30822 | 1.272727273 | 1.538461538 |
| 40748 | 30745 | 1.916666667 | 1.179487179 | 40774 | 30771 | 1.551846591 | 1.423677885 | 40800 | 30797 | 1.370707071 | 1.690598291 | 40826 | 30823 | 1.272727273 | 1.346153846 |

FIG. 7 (Cont.)

| DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment | DNA SEQ ID NO | AA SEQ ID NO | Liver 1 Enrichment | Liver 2 Enrichment |
|---|---|---|---|---|---|---|---|---|---|---|---|---|---|---|---|
| 40827 | 30824 | 1.272727273 | 1.192307692 | 40853 | 30850 | 1.194805195 | 1.990384615 | 40879 | 30876 | 1.085664336 | 1.156804734 | 40905 | 30902 | 1.045454545 | 1.575721154 |
| 40828 | 30825 | 1.258812616 | 1.173469388 | 40854 | 30851 | 1.187211094 | 1.274445893 | 40880 | 30877 | 1.082792208 | 1.57967033 | 40906 | 30903 | 1.045454545 | 3.538461538 |
| 40829 | 30826 | 1.254545455 | 1.454700855 | 40855 | 30852 | 1.184848485 | 1.415384615 | 40881 | 30878 | 1.080893683 | 1.304432855 | 40907 | 30904 | 1.045454545 | 1.474358974 |
| 40830 | 30827 | 1.254545455 | 1.216346154 | 40856 | 30853 | 1.180351906 | 1.227047146 | 40882 | 30879 | 1.08030303 | 1.110683761 | 40908 | 30905 | 1.045454545 | 1.326923077 |
| 40831 | 30828 | 1.25 | 1.115384615 | 40857 | 30854 | 1.176136364 | 1.216346154 | 40883 | 30880 | 1.077788191 | 1.285884219 | 40909 | 30906 | 1.045454545 | 1.326923077 |
| 40832 | 30829 | 1.249445676 | 1.03564728 | 40858 | 30855 | 1.173232323 | 1.15982906 | 40884 | 30881 | 1.077134986 | 1.045454545 | 40910 | 30907 | 1.030934343 | 1.105769231 |
| 40833 | 30830 | 1.248737374 | 1.326923077 | 40859 | 30856 | 1.169491525 | 1.244458931 | 40885 | 30882 | 1.077134986 | 1.501165501 | 40911 | 30908 | 1.030729834 | 1.196099675 |
| 40834 | 30831 | 1.247208931 | 1.25708502 | 40860 | 30857 | 1.168449198 | 1.990384615 | 40886 | 30883 | 1.075324675 | 1.061538462 | 40912 | 30909 | 1.028030303 | 1.091025641 |
| 40835 | 30832 | 1.243243243 | 1.123700624 | 40861 | 30858 | 1.161616162 | 1.818376068 | 40887 | 30884 | 1.075324675 | 1.112087912 | 40913 | 30910 | 1.026446281 | 1.576223776 |
| 40836 | 30833 | 1.239957717 | 1.913237925 | 40862 | 30859 | 1.157467532 | 1.263736264 | 40888 | 30885 | 1.074494949 | 1.056623932 | 40914 | 30911 | 1.026094276 | 1.261396011 |
| 40837 | 30834 | 1.2368758 | 1.171180932 | 40863 | 30860 | 1.156336088 | 1.179487179 | 40889 | 30886 | 1.074097136 | 1.514752371 | 40915 | 30912 | 1.02534965 | 1.394970414 |
| 40838 | 30835 | 1.233979136 | 1.392181589 | 40864 | 30861 | 1.142706131 | 1.54293381 | 40890 | 30887 | 1.071590909 | 1.371153846 | 40916 | 30913 | 1.02534965 | 1.105769231 |
| 40839 | 30836 | 1.233979136 | 1.116645649 | 40865 | 30862 | 1.140495868 | 1.769230769 | 40891 | 30888 | 1.070953437 | 1.197467167 | 40917 | 30914 | 1.023674242 | 2.432692308 |
| 40840 | 30837 | 1.233100233 | 1.633136095 | 40866 | 30863 | 1.140495868 | 1.206293706 | 40892 | 30889 | 1.069767442 | 1.080053667 | 40918 | 30915 | 1.021694215 | 1.02534965 |
| 40841 | 30838 | 1.233100233 | 1.088757396 | 40867 | 30864 | 1.137700535 | 1.378959276 | 40893 | 30890 | 1.069487983 | 1.230327144 | 40919 | 30916 | 1.020562771 | 1.010989011 |
| 40842 | 30839 | 1.233100233 | 1.247534517 | 40868 | 30865 | 1.132575758 | 1.007478632 | 40894 | 30891 | 1.061294766 | 1.005244755 | 40920 | 30917 | 1.014705882 | 1.040723982 |
| 40843 | 30840 | 1.228409091 | 1.205288462 | 40869 | 30866 | 1.124144673 | 1.20802316 | 40895 | 30892 | 1.045454545 | 1.114615385 | 40921 | 30918 | 1.013450835 | 1.426216641 |
| 40844 | 30841 | 1.224675325 | 1.516483516 | 40870 | 30867 | 1.12012987 | 1.137362637 | 40896 | 30893 | 1.045454545 | 1.061538462 | 40922 | 30919 | 1.010606061 | 1.091025641 |
| 40845 | 30842 | 1.21969697 | 1.474358974 | 40871 | 30868 | 1.117554859 | 1.113395225 | 40897 | 30894 | 1.045454545 | 1.184485007 | 40923 | 30920 | 1.006372133 | 1.339324227 |
| 40846 | 30843 | 1.21969697 | 1.032051282 | 40872 | 30869 | 1.110795455 | 1.202524038 | 40898 | 30895 | 1.045454545 | 1.608391608 | 40924 | 30921 | 1.006003431 | 1.185050798 |
| 40847 | 30844 | 1.21969697 | 2.211538462 | 40873 | 30870 | 1.103535354 | 1.081196581 | 40899 | 30896 | 1.045454545 | 1.032051282 | 40925 | 30922 | 1.004456328 | 1.16214178 |
| 40848 | 30845 | 1.217096336 | 1.399540758 | 40874 | 30871 | 1.100478469 | 2.188259109 | 40900 | 30897 | 1.045454545 | 2.653846154 | 40926 | 30923 | 1.000967118 | 1.138707038 |
| 40849 | 30846 | 1.210526316 | 1.489878543 | 40875 | 30872 | 1.099343955 | 1.422680412 | 40901 | 30898 | 1.045454545 | 1.061538462 | | | | |
| 40850 | 30847 | 1.206293706 | 1.147083686 | 40876 | 30873 | 1.096452328 | 1.488742964 | 40902 | 30899 | 1.045454545 | 3.685897436 | | | | |
| 40851 | 30848 | 1.203856749 | 1.594988345 | 40877 | 30874 | 1.095238095 | 1.558608059 | 40903 | 30900 | 1.045454545 | 1.274886878 | | | | |
| 40852 | 30849 | 1.194805195 | 1.137362637 | 40878 | 30875 | 1.088418431 | 1.163329821 | 40904 | 30901 | 1.045454545 | 1.326923077 | | | | |

FIG. 8

| DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment |
|---|---|---|---|---|---|---|---|---|---|---|---|---|---|---|---|
| 40927 | 30924 | 317.4 | 56.35 | 40953 | 30950 | 114.4102564 | 17.3974359 | 40979 | 30976 | 92 | 32.47058824 | 41005 | 31002 | 80.20512821 | 10.32051282 |
| 40928 | 30925 | 275.1481481 | 9.37037037 | 40954 | 30951 | 113.3170732 | 1.402439024 | 40980 | 30977 | 91.4025974 | 7.766233766 | 41006 | 31003 | 79.91919192 | 10.57070707 |
| 40929 | 30926 | 247.25 | 57.5 | 40955 | 30952 | 112.6206897 | 25.18103448 | 40981 | 30978 | 91.23333333 | 20.125 | 41007 | 31004 | 79.45454545 | 3.206060606 |
| 40930 | 30927 | 220.5909091 | 20.38636364 | 40956 | 30953 | 110.0392157 | 17.0245098 | 40982 | 30979 | 90.51612903 | 39.69354839 | 41008 | 31005 | 79.26153846 | 14.50769231 |
| 40931 | 30928 | 219.5454545 | 25.61363636 | 40957 | 30954 | 109.754386 | 8.877192982 | 40983 | 30980 | 90.06315789 | 5.205263158 | 41009 | 31006 | 79.14705882 | 16.91176471 |
| 40932 | 30929 | 200 | 54.5 | 40958 | 30955 | 109.6923077 | 7.961538462 | 40984 | 30981 | 89.25373134 | 11.84328358 | 41010 | 31007 | 78.64516129 | 36.72580645 |
| 40933 | 30930 | 163.915493 | 11.82394366 | 40959 | 30956 | 109.25 | 9.670454545 | 40985 | 30982 | 89.21212121 | 2.439393939 | 41011 | 31008 | 78.42622951 | 12.44262295 |
| 40934 | 30931 | 154.2352941 | 31.11764706 | 40960 | 30957 | 109.1641791 | 1.544776119 | 40986 | 30983 | 89.125 | 19.88541667 | 41012 | 31009 | 77.7027027 | 6.527027027 |
| 40935 | 30932 | 152.2058824 | 8.117647059 | 40961 | 30958 | 109.1162791 | 9.093023256 | 40987 | 30984 | 88.79069767 | 12.56976744 | 41013 | 31010 | 77.66233766 | 5.376623377 |
| 40936 | 30933 | 151.6296296 | 12.13888889 | 40962 | 30959 | 108.4285714 | 32.30952381 | 40988 | 30985 | 88.55 | 6.325 | 41014 | 31011 | 77 | 22.75 |
| 40937 | 30934 | 146.1176471 | 25.57058824 | 40963 | 30960 | 107.6818182 | 14.11363636 | 40989 | 30986 | 88.53763441 | 12.24193548 | 41015 | 31012 | 76.86075949 | 11.5 |
| 40938 | 30935 | 145.8113208 | 13.45283019 | 40964 | 30961 | 107.09375 | 15.09375 | 40990 | 30987 | 87.24137931 | 11.5 | 41016 | 31013 | 76.85365854 | 14.44512195 |
| 40939 | 30936 | 145.4022989 | 15.59770115 | 40965 | 30962 | 105.9393939 | 9.060606061 | 40991 | 30988 | 87.18095238 | 4.928571429 | 41017 | 31014 | 76.66666667 | 9.684210526 |
| 40940 | 30937 | 139.4375 | 15.2734375 | 40966 | 30963 | 103.7804878 | 7.152439024 | 40992 | 30989 | 86.88888889 | 23.76666667 | 41018 | 31015 | 75.44 | 40.71 |
| 40941 | 30938 | 135.8095238 | 59.14285714 | 40967 | 30964 | 101.7575758 | 17.42424242 | 40993 | 30990 | 86.65116279 | 14.70930233 | 41019 | 31016 | 75.3037037 | 1.874074074 |
| 40942 | 30939 | 135.7 | 73.025 | 40968 | 30965 | 101.7307692 | 16.03365385 | 40994 | 30991 | 85.03030303 | 24.39393939 | 41020 | 31017 | 75.27272727 | 3.833333333 |
| 40943 | 30940 | 134.7906977 | 22.73255814 | 40969 | 30966 | 101.627907 | 18.72093023 | 40995 | 30992 | 84.58064516 | 24.85483871 | 41021 | 31018 | 75.05263158 | 18.76315789 |
| 40944 | 30941 | 131.2352941 | 4.397058824 | 40970 | 30967 | 99.66666667 | 7.1875 | 40996 | 30993 | 84.5203252 | 5.329268293 | 41022 | 31019 | 74.47619048 | 6.936507937 |
| 40945 | 30942 | 130.9830508 | 9.161016949 | 40971 | 30968 | 97.52 | 15.41 | 40997 | 30994 | 84.23376623 | 6.870129987 | 41023 | 31020 | 73.47222222 | 12.9375 |
| 40946 | 30943 | 130.9230769 | 8.467032967 | 40972 | 30969 | 96.4 | 13 | 40998 | 30995 | 84.11428571 | 6.571428571 | 41024 | 31021 | 73.128205128 | 26.24358974 |
| 40947 | 30944 | 130 | 3.5 | 40973 | 30970 | 96.24615385 | 6.9 | 40999 | 30996 | 82.41666667 | 20.125 | 41025 | 31022 | 73.10714286 | 4.825892857 |
| 40948 | 30945 | 125.5254237 | 12.08474576 | 40974 | 30971 | 96.18181818 | 31.71212121 | 41000 | 30997 | 82.36190476 | 13.25238095 | 41026 | 31023 | 72.98666667 | 9.353333333 |
| 40949 | 30946 | 122.6666667 | 22.04166667 | 40975 | 30972 | 94.35897436 | 17.98717949 | 41001 | 30998 | 81.38461538 | 31.84615385 | 41027 | 31024 | 72.953125 | 13.56640625 |
| 40950 | 30947 | 119.4230769 | 24.99038462 | 40976 | 30973 | 94 | 23 | 41002 | 30999 | 81.17647059 | 12.40196078 | 41028 | 31025 | 72.92682927 | 14.30487805 |
| 40951 | 30948 | 116.0615385 | 11.67692308 | 40977 | 30974 | 92.68656716 | 12.52985075 | 41003 | 31000 | 81.10526316 | 30.86842105 | 41029 | 31026 | 72.66666667 | 8.5 |
| 40952 | 30949 | 115.3538462 | 1.061538462 | 40978 | 30975 | 92 | 19.32 | 41004 | 31001 | 80.39252336 | 14.61682243 | 41030 | 31027 | 72.48484848 | 7.492424242 |

FIG. 8 (Cont.)

| DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment |
|---|---|---|---|---|---|---|---|---|---|---|---|---|---|---|---|
| 41031 | 31028 | 71.90291262 | 6.475728155 | 41059 | 31056 | 61.75342466 | 11.34246575 | 41087 | 31084 | 55.3559322 | 8.771186441 | 41115 | 31112 | 48.70588235 | 12.62745098 |
| 41032 | 31029 | 71.72881356 | 9.745762712 | 41060 | 31057 | 61.33333333 | 4.259259259 | 41088 | 31085 | 55.2 | 35.9375 | 41116 | 31113 | 48.62857143 | 12.15714286 |
| 41033 | 31030 | 71.48648649 | 15.22972973 | 41061 | 31058 | 60.6031746 | 16.24603175 | 41089 | 31086 | 55.2 | 23 | 41117 | 31114 | 48.46428571 | 12.9375 |
| 41034 | 31031 | 70.27777778 | 11.5 | 41062 | 31059 | 60.52631579 | 16.79605263 | 41090 | 31087 | 54.68888889 | 18.52777778 | 41118 | 31115 | 48.3 | 7.475 |
| 41035 | 31032 | 70 | 9.5 | 41063 | 31060 | 60.52631579 | 8.070175439 | 41091 | 31088 | 54.36363636 | 11.5 | 41119 | 31116 | 47.97849462 | 16.56989247 |
| 41036 | 31033 | 69.97183099 | 21.38028169 | 41064 | 31061 | 60.34862385 | 5.591743119 | 41092 | 31089 | 54.19178082 | 5.51369863 | 41120 | 31117 | 47.84 | 10.12 |
| 41037 | 31034 | 69 | 48.875 | 41065 | 31062 | 60.2972973 | 10.41216216 | 41093 | 31090 | 53.85365854 | 28.32926829 | 41121 | 31118 | 47.76923077 | 36.04807692 |
| 41038 | 31035 | 69 | 9.2 | 41066 | 31063 | 60.27586207 | 11.5 | 41094 | 31091 | 53.51020408 | 1.173469388 | 41122 | 31119 | 47.73584906 | 5.316037736 |
| 41039 | 31036 | 69 | 9.234848485 | 41067 | 31064 | 60.05555556 | 4.046296296 | 41095 | 31092 | 53.34042553 | 5.260638298 | 41123 | 31120 | 47.73584906 | 22.3490566 |
| 41040 | 31037 | 69 | 22.09210526 | 41068 | 31065 | 59.90697674 | 14.1744186 | 41096 | 31093 | 53.15555556 | 13.03333333 | 41124 | 31121 | 47.5862069 | 7.336206897 |
| 41041 | 31038 | 68.53061224 | 11.57823129 | 41069 | 31066 | 59.84070796 | 13.94247788 | 41097 | 31094 | 52.73170732 | 14.02439024 | 41125 | 31122 | 47.31428571 | 8.542857143 |
| 41042 | 31039 | 67.02857143 | 17.41428571 | 41070 | 31067 | 59.225 | 7.7625 | 41098 | 31095 | 52.09638554 | 13.57831325 | 41126 | 31123 | 46.75409836 | 1.508196721 |
| 41043 | 31040 | 66.44444444 | 6.814814815 | 41071 | 31068 | 59.14285714 | 41.89285714 | 41099 | 31096 | 51.49253731 | 23.51492537 | 41127 | 31124 | 46.73015873 | 7.849206349 |
| 41044 | 31041 | 66.19512195 | 11.6402439 | 41072 | 31069 | 57.71974522 | 7.251592357 | 41100 | 31097 | 51.47619048 | 15.88095238 | 41128 | 31125 | 46.6969697 | 13.93939394 |
| 41045 | 31042 | 66.18705036 | 18.03597122 | 41073 | 31070 | 57.5 | 5.60625 | 41101 | 31098 | 51.16853933 | 7.494382022 | 41129 | 31126 | 46.60526316 | 7.868421053 |
| 41046 | 31043 | 65.91044776 | 9.268656716 | 41074 | 31071 | 57.23863636 | 4.508522727 | 41102 | 31099 | 51.11111111 | 13.92777778 | 41130 | 31127 | 46.52272727 | 6.272727273 |
| 41047 | 31044 | 65.52830189 | 5.099056604 | 41075 | 31072 | 57.21393035 | 8.467661692 | 41103 | 31100 | 51.04109589 | 11.34246575 | 41131 | 31128 | 46 | 3.653645833 |
| 41048 | 31045 | 65.40625 | 10.2421875 | 41076 | 31073 | 57.18918919 | 13.98648649 | 41104 | 31101 | 50.89361702 | 2.691489362 | 41132 | 31129 | 46 | 22.58928571 |
| 41049 | 31046 | 64.89285714 | 11.08928571 | 41077 | 31074 | 57.10344828 | 42.82758621 | 41105 | 31102 | 50.84210526 | 4.842105263 | 41133 | 31130 | 46 | 11.5 |
| 41050 | 31047 | 64.78873239 | 14.57746479 | 41078 | 31075 | 57.08433735 | 11.91566265 | 41106 | 31103 | 50.6 | 8.51 | 41134 | 31131 | 46 | 5.141176471 |
| 41051 | 31048 | 64.59574468 | 14.43617021 | 41079 | 31076 | 56.61538462 | 15.92307692 | 41107 | 31104 | 50.08888889 | 16.1 | 41135 | 31132 | 46 | 13.75 |
| 41052 | 31049 | 64.4 | 19.71428571 | 41080 | 31077 | 56.28235294 | 7.982352941 | 41108 | 31105 | 50.08888889 | 15.07777778 | 41136 | 31133 | 46 | 6.546153846 |
| 41053 | 31050 | 63.75438596 | 15.93859649 | 41081 | 31078 | 56.22222222 | 7.347222222 | 41109 | 31106 | 49.92682927 | 6.170731707 | 41137 | 31134 | 46 | 13.11 |
| 41054 | 31051 | 63.58823529 | 9.301470588 | 41082 | 31079 | 56.22222222 | 5.504273504 | 41110 | 31107 | 49.91489362 | 25.93617021 | 41138 | 31135 | 45.53535354 | 1.742424242 |
| 41055 | 31052 | 63.48 | 11.73 | 41083 | 31080 | 55.81333333 | 8.74 | 41111 | 31108 | 49.58865248 | 10.43971631 | 41139 | 31136 | 45.0212766 | 9.053191489 |
| 41056 | 31053 | 62.53932584 | 3.359550562 | 41084 | 31081 | 55.68421053 | 41.76315789 | 41112 | 31109 | 49.3253012 | 6.096385542 | 41140 | 31137 | 44.62686567 | 8.925373134 |
| 41057 | 31054 | 62.16216216 | 11.81081081 | 41085 | 31082 | 55.55844156 | 10.75324675 | 41113 | 31110 | 48.96774194 | 34.00537634 | 41141 | 31138 | 44.2962963 | 15.33333333 |
| 41058 | 31055 | 62 | 46.5 | 41086 | 31083 | 55.48453608 | 18.61340206 | 41114 | 31111 | 48.9009009 | 10.67117117 | 41142 | 31139 | 44.12244898 | 7.510204082 |

FIG. 8 (Cont.)

| DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment |
|---|---|---|---|---|---|---|---|---|---|---|---|---|---|---|---|
| 41143 | 31140 | 43.90909091 | 19.99431818 | 41171 | 31168 | 39.26829268 | 6.731707317 | 41199 | 31196 | 34.81081081 | 17.25 | 41227 | 31224 | 30.78195489 | 4.669172932 |
| 41144 | 31141 | 43.88990826 | 10.86697248 | 41172 | 31169 | 38.87323944 | 12.14788732 | 41200 | 31197 | 34.76744186 | 5.549418605 | 41228 | 31225 | 30.66666667 | 6.388888889 |
| 41145 | 31142 | 43.7 | 11.06875 | 41173 | 31170 | 38.33333333 | 5.083333333 | 41201 | 31198 | 34.73469388 | 15.95918367 | 41229 | 31226 | 30.66666667 | 5.649122807 |
| 41146 | 31143 | 43.7 | 12.075 | 41174 | 31171 | 38.21538462 | 13.26923077 | 41202 | 31199 | 34.2195122 | 2.243902439 | 41230 | 31227 | 30.66666667 | 2.555555556 |
| 41147 | 31144 | 43.29411765 | 20.51960784 | 41175 | 31172 | 38.14634146 | 2.617886179 | 41203 | 31200 | 34.07407407 | 15.58888889 | 41231 | 31228 | 30.66666667 | 7.027777778 |
| 41148 | 31145 | 43.07936508 | 37.78571429 | 41176 | 31173 | 38 | 8.833333333 | 41204 | 31201 | 34 | 4.125 | 41232 | 31229 | 30.2994012 | 6.473053892 |
| 41149 | 31146 | 42.89189189 | 8.081081081 | 41177 | 31174 | 37.88235294 | 4.735294118 | 41205 | 31202 | 33.73333333 | 10.05185185 | 41233 | 31230 | 30.29268293 | 8.274390244 |
| 41150 | 31147 | 42.79069767 | 14.97674419 | 41178 | 31175 | 37.84236453 | 2.60591133 | 41206 | 31203 | 33.62248996 | 5.149598394 | 41234 | 31231 | 30.10909091 | 10.24545455 |
| 41151 | 31148 | 42.71428571 | 16.92142857 | 41179 | 31176 | 37.69444444 | 8.784722222 | 41207 | 31204 | 33.52542373 | 15.98305085 | 41235 | 31232 | 30.07692308 | 7.224358974 |
| 41152 | 31149 | 42.27027027 | 11.81081081 | 41180 | 31177 | 37.57746479 | 3.077464789 | 41208 | 31205 | 33.49514563 | 13.39805825 | 41236 | 31233 | 29.9 | 3.59375 |
| 41153 | 31150 | 42.16666667 | 14.56666667 | 41181 | 31178 | 37.54022989 | 13.0862069 | 41209 | 31206 | 33.45454545 | 18.66883117 | 41237 | 31234 | 29.62711864 | 10.52542373 |
| 41154 | 31151 | 41.91111111 | 24.02222222 | 41182 | 31179 | 37.2972973 | 35.43243243 | 41210 | 31207 | 33.38709677 | 6.677419355 | 41238 | 31235 | 29.58918919 | 6.962162162 |
| 41155 | 31152 | 41.84337349 | 7.620481928 | 41183 | 31180 | 37.23809524 | 10.76984127 | 41211 | 31208 | 33.31034483 | 18.90229885 | 41239 | 31236 | 29.15492958 | 19.43661972 |
| 41156 | 31153 | 41.66037736 | 7.268867925 | 41184 | 31181 | 37.02439024 | 14.58536585 | 41212 | 31209 | 33.13978495 | 11.62365591 | 41240 | 31237 | 29.13333333 | 18.59166667 |
| 41157 | 31154 | 41.56626506 | 19.39759036 | 41185 | 31182 | 36.94488189 | 4.88976378 | 41213 | 31210 | 32.35862069 | 8.882758621 | 41241 | 31238 | 29.08045977 | 10.70689655 |
| 41158 | 31155 | 41.51219512 | 38.42682927 | 41186 | 31183 | 36.93939394 | 11.67424242 | 41214 | 31211 | 32.1369863 | 6.45890411 | 41242 | 31239 | 29.02912621 | 14.84951456 |
| 41159 | 31156 | 41.4 | 4.913636364 | 41187 | 31184 | 36.91358025 | 10.93209877 | 41215 | 31212 | 32.12698413 | 8.214285714 | 41243 | 31240 | 28.96296296 | 7.524691358 |
| 41160 | 31157 | 40.70503597 | 4.302158273 | 41188 | 31185 | 36.8 | 5.622222222 | 41216 | 31213 | 32.07894737 | 17.55263158 | 41244 | 31241 | 28.95104895 | 11.01748252 |
| 41161 | 31158 | 40.66666667 | 14.33333333 | 41189 | 31186 | 36.54794521 | 4.726027397 | 41217 | 31214 | 31.97560976 | 7.713414634 | 41245 | 31242 | 28.91428571 | 20.37142857 |
| 41162 | 31159 | 40.66666667 | 18.33333333 | 41190 | 31187 | 36.25423729 | 9.258474576 | 41218 | 31215 | 31.84615385 | 4.286982249 | 41246 | 31243 | 28.66666667 | 24.66666667 |
| 41163 | 31160 | 40.48 | 12.65 | 41191 | 31188 | 36 | 13.64285714 | 41219 | 31216 | 31.68888889 | 1.874074074 | 41247 | 31244 | 28.64912281 | 17.35087719 |
| 41164 | 31161 | 40.43956044 | 2.906593407 | 41192 | 31189 | 35.77777778 | 27.08888889 | 41220 | 31217 | 31.67213115 | 5.467213115 | 41248 | 31245 | 28.58252427 | 17.19417476 |
| 41165 | 31162 | 40.41428571 | 9.528571429 | 41193 | 31190 | 35.77777778 | 5.00462963 | 41221 | 31218 | 31.43333333 | 2.683333333 | 41249 | 31246 | 28.49253731 | 3.003731343 |
| 41166 | 31163 | 40.35849057 | 14.97169811 | 41194 | 31191 | 35.50877193 | 15.93859649 | 41222 | 31219 | 31.41463415 | 6.451219512 | 41250 | 31247 | 28.30769231 | 5.93956044 |
| 41167 | 31164 | 40.06451613 | 19.47580645 | 41195 | 31192 | 35.38461538 | 18.28205128 | 41223 | 31220 | 31.33333333 | 16.66666667 | 41251 | 31248 | 28.30769231 | 5.528846154 |
| 41168 | 31165 | 39.80769231 | 9.951923077 | 41196 | 31193 | 35.21875 | 10.421875 | 41224 | 31221 | 31.1496063 | 2.807086614 | 41252 | 31249 | 28.25714286 | 10.35 |
| 41169 | 31166 | 39.68627451 | 12.62745098 | 41197 | 31194 | 35.15447154 | 9.443089431 | 41225 | 31222 | 30.86842105 | 18.91447368 | 41253 | 31250 | 28.175 | 7.475 |
| 41170 | 31167 | 39.65517241 | 26.96551724 | 41198 | 31195 | 34.94230769 | 11.83173077 | 41226 | 31223 | 30.82978723 | 14.68085106 | 41254 | 31251 | 28.16326531 | 9.505102041 |

FIG. 8 (Cont.)

| DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment |
|---|---|---|---|---|---|---|---|---|---|---|---|---|---|---|---|
| 41255 | 31252 | 28.11111111 | 16.93055556 | 41283 | 31280 | 25.3 | 1.035 | 41311 | 31308 | 21.96129032 | 5.712903226 | 41339 | 31336 | 18.16806723 | 9.953781513 |
| 41256 | 31253 | 28.04878049 | 8.882113821 | 41284 | 31281 | 25.25490196 | 14.88235294 | 41312 | 31309 | 21.85 | 31.9125 | 41340 | 31337 | 18.13461538 | 10.61538462 |
| 41257 | 31254 | 28.02298851 | 30.53448276 | 41285 | 31282 | 24.98765432 | 7.666666667 | 41313 | 31310 | 21.26415094 | 6.726415094 | 41341 | 31338 | 17.95121951 | 8.040650407 |
| 41258 | 31255 | 27.97938144 | 16.83505155 | 41286 | 31283 | 24.5862069 | 8.922413793 | 41314 | 31311 | 21.12244898 | 15.60714286 | 41342 | 31339 | 17.94 | 6.9 |
| 41259 | 31256 | 27.6 | 12.65 | 41287 | 31284 | 24.53333333 | 2.453333333 | 41315 | 31312 | 21.10091743 | 26.79816514 | 41343 | 31340 | 17.90604027 | 20.53020134 |
| 41260 | 31257 | 27.6 | 16.24375 | 41288 | 31285 | 24.33057851 | 18.24793388 | 41316 | 31313 | 20.90909091 | 8.524475524 | 41344 | 31341 | 17.69230769 | 1.84965035 |
| 41261 | 31258 | 27.6 | 2.3 | 41289 | 31286 | 24.32183908 | 10.44252874 | 41317 | 31314 | 20.87037037 | 6.069444444 | 41345 | 31342 | 17.50442478 | 6.411504425 |
| 41262 | 31259 | 27.40425532 | 6.239361702 | 41290 | 31287 | 24.22900763 | 3.248091603 | 41318 | 31315 | 20.83018868 | 22.3490566 | 41346 | 31343 | 17.42424242 | 3.484848485 |
| 41263 | 31260 | 27.40425532 | 6.85106383 | 41291 | 31288 | 24.21052632 | 10.28947368 | 41319 | 31316 | 20.82432432 | 9.47972973 | 41347 | 31344 | 17.35087719 | 8.877192982 |
| 41264 | 31261 | 27.21666667 | 9.966666667 | 41292 | 31289 | 24.12195122 | 14.16463415 | 41320 | 31317 | 20.74509804 | 14.76960784 | 41348 | 31345 | 17.35087719 | 7.464912281 |
| 41265 | 31262 | 27.21126761 | 6.478873239 | 41293 | 31290 | 24.11290323 | 7.326612903 | 41321 | 31318 | 20.65306122 | 7.979591837 | 41349 | 31346 | 16.74871795 | 2.830769231 |
| 41266 | 31263 | 27.2 | 4.4 | 41294 | 31291 | 24.05504587 | 8.018348624 | 41322 | 31319 | 20 | 14.16666667 | 41350 | 31347 | 16.56 | 12.42 |
| 41267 | 31264 | 27.15662651 | 8.86746988 | 41295 | 31292 | 23.81176471 | 9.064705882 | 41323 | 31320 | 19.89189189 | 11.29279279 | 41351 | 31348 | 16.53125 | 1.4375 |
| 41268 | 31265 | 26.90566038 | 4.773584906 | 41296 | 31293 | 23.79310345 | 4.626436782 | 41324 | 31321 | 19.82113821 | 10.00406504 | 41352 | 31349 | 16.48333333 | 12.74583333 |
| 41269 | 31266 | 26.8 | 6.1 | 41297 | 31294 | 23.65714286 | 12.15714286 | 41325 | 31322 | 19.71428571 | 9.34375 | 41353 | 31350 | 16.34210526 | 3.404605263 |
| 41270 | 31267 | 26.7761194 | 9.611940299 | 41298 | 31295 | 23.58974359 | 8.256410256 | 41326 | 31323 | 19.66666667 | 5.75 | 41354 | 31351 | 16.32258065 | 3.338709677 |
| 41271 | 31268 | 26.70967742 | 4.266129032 | 41299 | 31296 | 23.42592593 | 3.833333333 | 41327 | 31324 | 19.55905512 | 2.625984252 | 41355 | 31352 | 16.171875 | 8.265625 |
| 41272 | 31269 | 26.59375 | 8.0859375 | 41300 | 31297 | 23.32857143 | 6.571428571 | 41328 | 31325 | 19.52830189 | 4.990566038 | 41356 | 31353 | 15.8125 | 6.109375 |
| 41273 | 31270 | 26.52252252 | 3.418918919 | 41301 | 31298 | 23.29113924 | 29.40506329 | 41329 | 31326 | 19.42222222 | 12.86296296 | 41357 | 31354 | 15.80152672 | 4.213740458 |
| 41274 | 31271 | 26.51764706 | 5.817647059 | 41302 | 31299 | 23.24210526 | 9.442105263 | 41330 | 31327 | 19.36842105 | 3.480263158 | 41358 | 31355 | 15.65277778 | 3.434027778 |
| 41275 | 31272 | 26.47169811 | 10.74056604 | 41303 | 31300 | 23 | 5 | 41331 | 31328 | 19.35172414 | 8.565517241 | 41359 | 31356 | 15.33333333 | 5.594594595 |
| 41276 | 31273 | 26.45 | 18.1125 | 41304 | 31301 | 22.8034188 | 10.41880342 | 41332 | 31329 | 19.16666667 | 6.882575758 | 41360 | 31357 | 15.33333333 | 6.683760684 |
| 41277 | 31274 | 26.28571429 | 23 | 41305 | 31302 | 22.8 | 4.6 | 41333 | 31330 | 19 | 4.5 | 41361 | 31358 | 15.11428571 | 21.68571429 |
| 41278 | 31275 | 25.65384615 | 8.735576923 | 41306 | 31303 | 22.77227723 | 8.198019802 | 41334 | 31331 | 18.99082569 | 6.119266055 | 41362 | 31359 | 14.93506494 | 4.555194805 |
| 41279 | 31276 | 25.55555556 | 6.708333333 | 41307 | 31304 | 22.38938053 | 5.902654867 | 41335 | 31332 | 18.95757576 | 7.527272727 | 41363 | 31360 | 14.22368421 | 7.036184211 |
| 41280 | 31277 | 25.55555556 | 18.74074074 | 41308 | 31305 | 22.34285714 | 7.721428571 | 41336 | 31333 | 18.31067961 | 10.7184466 | 41364 | 31361 | 13.88679245 | 10.8490566 |
| 41281 | 31278 | 25.42105263 | 11.80263158 | 41309 | 31306 | 22.16363636 | 12.44090909 | 41337 | 31334 | 18.21782178 | 9.336633663 | 41365 | 31362 | 13.66060606 | 5.715151515 |
| 41282 | 31279 | 25.3258427 | 7.235955056 | 41310 | 31307 | 22.1 | 1.75 | 41338 | 31335 | 18.21782178 | 2.448019802 | 41366 | 31363 | 12.71544715 | 4.674796748 |

FIG. 8 (Cont.)

| DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment | DNA SEQ ID NO | AA SEQ ID NO | Muscle 1 Enrichment | Muscle 2 Enrichment |
|---|---|---|---|---|---|---|---|---|---|---|---|---|---|---|---|
| 41367 | 31364 | 11.90049751 | 14.58955224 | 41390 | 31387 | 8.658823529 | 9.470588235 | 41413 | 31410 | 4.6 | 17.60384615 | 41436 | 31433 | 2.3 | 24.15 |
| 41368 | 31365 | 11.79487179 | 1.081196581 | 41391 | 31388 | 8.653465347 | 2.277227723 | 41414 | 31411 | 4.6 | 8.9125 | 41437 | 31434 | 2.3 | 12.3625 |
| 41369 | 31366 | 11.70909091 | 5.959090909 | 41392 | 31389 | 8.625 | 5.190972222 | 41415 | 31412 | 4.451612903 | 1.483870968 | 41438 | 31435 | 2.164705882 | 12.04117647 |
| 41370 | 31367 | 11.68548387 | 4.3125 | 41393 | 31390 | 8.363636364 | 3.397727273 | 41416 | 31413 | 4.404255319 | 6.239361702 | 41439 | 31436 | 2.123076923 | 15.39230769 |
| 41371 | 31368 | 11.67164179 | 16.30597015 | 41394 | 31391 | 8.214285714 | 10.0625 | 41417 | 31414 | 4.351351351 | 6.527027027 | 41440 | 31437 | 2.059701493 | 18.53731343 |
| 41372 | 31369 | 11.32835821 | 2.059701493 | 41395 | 31392 | 8.161290323 | 27.82258065 | 41418 | 31415 | 4.211267606 | 8.665492958 | 41441 | 31438 | 2.044444444 | 12.90555556 |
| 41373 | 31370 | 11.18232044 | 5.972375691 | 41396 | 31393 | 7.885714286 | 14.45714286 | 41419 | 31416 | 3.942857143 | 14.45714286 | 41442 | 31439 | 2 | 57.5 |
| 41374 | 31371 | 11.15151515 | 1.393939394 | 41397 | 31394 | 7.585106383 | 6.055851064 | 41420 | 31417 | 3.72972973 | 5.905405405 | 41443 | 31440 | 1.916666667 | 7.427083333 |
| 41375 | 31372 | 11.10344828 | 1.586206897 | 41398 | 31395 | 7.540983607 | 34.31147541 | 41421 | 31418 | 3.659090909 | 25.74431818 | 41444 | 31441 | 1.642857143 | 14.375 |
| 41376 | 31373 | 11.06329114 | 17.46835443 | 41399 | 31396 | 7.109090909 | 6.795454545 | 41422 | 31419 | 3.538461538 | 1.769230769 | 41445 | 31442 | 1.586206897 | 3.899425287 |
| 41377 | 31374 | 11.02083333 | 1.916666667 | 41400 | 31397 | 6.924731183 | 4.451612903 | 41423 | 31420 | 3.538461538 | 22.41025641 | 41446 | 31443 | 1.533333333 | 35.65 |
| 41378 | 31375 | 10.95238095 | 26.28571429 | 41401 | 31398 | 6.814814815 | 16.18518519 | 41424 | 31421 | 3.478991597 | 1.836134454 | 41447 | 31444 | 1.415384615 | 8.138461538 |
| 41379 | 31376 | 10.51038576 | 2.866468843 | 41402 | 31399 | 6.192307692 | 10.72596154 | 41425 | 31422 | 3.256637168 | 13.94247788 | 41448 | 31445 | 1.408163265 | 20.41836735 |
| 41380 | 31377 | 10.32653061 | 19.24489796 | 41403 | 31400 | 5.75 | 2.875 | 41426 | 31423 | 3.2 | 5.3 | 41449 | 31446 | 1.383458647 | 6.312030075 |
| 41381 | 31378 | 10.22222222 | 2.12962963 | 41404 | 31401 | 5.56043956 | 6.697802198 | 41427 | 31424 | 3.172413793 | 6.344827586 | 41450 | 31447 | 1.326923077 | 9.067307692 |
| 41382 | 31379 | 10.15584416 | 1.642857143 | 41405 | 31402 | 5.492537313 | 14.41791045 | 41428 | 31425 | 3.136363636 | 12.80681818 | 41451 | 31448 | 1.314285714 | 9.528571429 |
| 41383 | 31380 | 10.03636364 | 16.93636364 | 41406 | 31403 | 5.476190476 | 23.41071429 | 41429 | 31426 | 3.016393443 | 7.980874317 | 41452 | 31449 | 1.243243243 | 8.236486486 |
| 41384 | 31381 | 10.02564103 | 15.77564103 | 41407 | 31404 | 5.326315789 | 4.357894737 | 41430 | 31427 | 2.967741935 | 8.717741935 | 41453 | 31450 | 1.243243243 | 42.89189189 |
| 41385 | 31382 | 10 | 1.666666667 | 41408 | 31405 | 5.193548387 | 18.5483871 | 41431 | 31428 | 2.591549296 | 16.52112676 | 41454 | 31451 | 1.164556962 | 2.620253165 |
| 41386 | 31383 | 9.97044335 | 7.81773399 | 41409 | 31406 | 5.111111111 | 6.753968254 | 41432 | 31429 | 2.555555556 | 4.983333333 | | | | |
| 41387 | 31384 | 9.857142857 | 1.095238095 | 41410 | 31407 | 4.842105263 | 23.60526316 | 41433 | 31430 | 2.509090909 | 13.59090909 | | | | |
| 41388 | 31385 | 9.419795222 | 2.060580205 | 41411 | 31408 | 4.842105263 | 19.77192982 | 41434 | 31431 | 2.453333333 | 5.52 | | | | |
| 41389 | 31386 | 8.672131148 | 5.56147541 | 41412 | 31409 | 4.651685393 | 8.657303371 | 41435 | 31432 | 2.358974359 | 6.487179487 | | | | |

FIG. 9

| DNA SEQ ID NO | AA SEQ ID NO | Pancreas 1 Enrichment | Pancreas 2 Enrichment |
|---|---|---|---|
| 41455 | 31452 | 8198 | 14.18181818 |
| 41456 | 31453 | 3830.047619 | 27.48051948 |
| 41457 | 31454 | 3552.173077 | 33.91695804 |
| 41458 | 31455 | 371.0163934 | 6.478390462 |
| 41459 | 31456 | 356.8709677 | 3.271260997 |
| 41460 | 31457 | 301.2258065 | 8.431085044 |
| 41461 | 31458 | 221.3333333 | 3.696969697 |
| 41462 | 31459 | 51.27868852 | 2.947839046 |
| 41463 | 31460 | 11.5 | 23.83636364 |
| 41464 | 31461 | 3.833333333 | 52.27272727 |
| 41465 | 31462 | 2.520547945 | 3.207970112 |
| 41466 | 31463 | 1.703703704 | 6.698653199 |
| 41467 | 31464 | 1.533333333 | 29.27272727 |
| 41468 | 31465 | 1.277777778 | 11.79040404 |
| 41469 | 31466 | 1.121951220 | 3.39135255 |
| 41470 | 31467 | 1.045454545 | 9.219008264 |

FIG. 10

| DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment |
|---|---|---|---|---|---|---|---|---|---|---|---|
| 41471 | 31468 | 32.85714286 | 9.333333333 | 41497 | 31494 | 3.817687075 | 2.3 | 41549 | 31546 | 2.607709751 | 1.003968254 |
| 41472 | 31469 | 13.66941392 | 4.459935897 | 41498 | 31495 | 3.731922399 | 2.697530864 | 41550 | 31547 | 2.584761905 | 1.073333333 |
| 41473 | 31470 | 13.245553571 | 1.9765625 | 41499 | 31496 | 3.714285714 | 1.666666667 | 41551 | 31548 | 2.527472527 | 1.621794872 |
| 41474 | 31471 | 10.40476190 | 7.666666667 | 41500 | 31497 | 3.650793651 | 2.697530864 | 41552 | 31549 | 2.527472527 | 1.277777778 |
| 41475 | 31472 | 10.13095238 | 6.229166667 | 41501 | 31498 | 3.625615764 | 2.379310345 | 41553 | 31550 | 2.514991182 | 4.117283951 |
| 41476 | 31473 | 9.435897436 | 2.948717949 | 41502 | 31499 | 3.622710623 | 1.621794872 | 41554 | 31551 | 2.514991182 | 1.561728395 |
| 41477 | 31474 | 6.414965986 | 3.285714286 | 41503 | 31500 | 3.619047619 | 2 | 41555 | 31552 | 2.511033682 | 2.150406504 |
| 41478 | 31475 | 5.841269841 | 1.444444444 | 41504 | 31501 | 3.520408163 | 4.107142857 | 41556 | 31553 | 2.492610837 | 1.189655172 |
| 41479 | 31476 | 5.632653061 | 3.285714286 | 41505 | 31502 | 3.504761905 | 4.6 | 41557 | 31554 | 2.482539683 | 1.15 |
| 41480 | 31477 | 5.202380952 | 1.677083333 | 41506 | 31503 | 3.495440729 | 1.141843972 | 41558 | 31555 | 2.464285714 | 2.875 |
| 41481 | 31478 | 5.171957672 | 4.472222222 | 41507 | 31504 | 3.468253968 | 2.236111111 | 41559 | 31556 | 2.453333333 | 1.38 |
| 41482 | 31479 | 4.693877551 | 3.285714286 | 41508 | 31505 | 3.458646617 | 2.824561404 | 41560 | 31557 | 2.451247166 | 1.003968254 |
| 41483 | 31480 | 4.673015873 | 1.277777778 | 41509 | 31506 | 3.350140056 | 5.862745098 | 41561 | 31558 | 2.433862434 | 1.703703704 |
| 41484 | 31481 | 4.624338624 | 7.666666667 | 41510 | 31507 | 3.346560847 | 1.064814815 | 41562 | 31559 | 2.421052632 | 2.622807018 |
| 41485 | 31482 | 4.58008658 | 1.045454545 | 41511 | 31508 | 3.337868481 | 1.369047619 | 41563 | 31560 | 2.40952381 | 1.277777778 |
| 41486 | 31483 | 4.380952381 | 1.21969697 | 41512 | 31509 | 3.285714286 | 2.327380952 | 41564 | 31561 | 2.399092971 | 1.825396825 |
| 41487 | 31484 | 4.380952381 | 4.472222222 | 41513 | 31510 | 3.233560091 | 2.373015873 | 41565 | 31562 | 2.386638237 | 1.487562189 |
| 41488 | 31485 | 4.380952381 | 3.833333333 | 41514 | 31511 | 3.11417097 | 1.477911647 | 41566 | 31563 | 2.383753501 | 1.014705882 |
| 41489 | 31486 | 4.276643991 | 4.015873016 | 41515 | 31512 | 3.085177733 | 2.159624413 | 41567 | 31564 | 2.346938776 | 1.360047619 |
| 41490 | 31487 | 4.126245847 | 1.604651163 | 41516 | 31513 | 3.078507079 | 1.13963964 | 41568 | 31565 | 2.319327731 | 1.352941176 |
| 41491 | 31488 | 3.994397759 | 3.382352941 | 41517 | 31514 | 3.077097506 | 1.551587302 | 41569 | 31566 | 2.319327731 | 1.578431373 |
| 41492 | 31489 | 3.994397759 | 1.127450980 | 41518 | 31515 | 3.075987842 | 2.039007092 | 41570 | 31567 | 2.319327731 | 1.352941176 |
| 41493 | 31490 | 3.942857143 | 4.983333333 | 41519 | 31516 | 3.066666667 | 1.71025641 | 41571 | 31568 | 2.312169312 | 1.348765432 |
| 41494 | 31491 | 3.942857143 | 1.533333333 | 41520 | 31517 | 3.024943311 | 3.285714286 | 41572 | 31569 | 2.308243728 | 2.267025090 |
| 41495 | 31492 | 3.859410431 | 1.825396825 | 41521 | 31518 | 3.011904762 | 3.1625 | 41573 | 31570 | 2.302808303 | 1.081196581 |
| 41496 | 31493 | 3.844509232 | 1.564462585 | 41522 | 31519 | 3.011904762 | 1.4375 | 41574 | 31571 | 2.29004329 | 1.219969697 |

| DNA SEQ ID NO | AA SEQ ID NO | Spleen 1 Enrichment | Spleen 2 Enrichment |
|---|---|---|---|
| 41523 | 31520 | 2.976800977 | 3.047008547 |
| 41524 | 31521 | 2.972789116 | 4.517857143 |
| 41525 | 31522 | 2.972789116 | 1.916666667 |
| 41526 | 31523 | 2.967741935 | 1.483870968 |
| 41527 | 31524 | 2.952380952 | 4.5 |
| 41528 | 31525 | 2.920634921 | 1.277777778 |
| 41529 | 31526 | 2.920634921 | 1.916666667 |
| 41530 | 31527 | 2.864468864 | 1.769230769 |
| 41531 | 31528 | 2.857142857 | 1.333333333 |
| 41532 | 31529 | 2.816326531 | 1.752380952 |
| 41533 | 31530 | 2.80952381 | 1.833333333 |
| 41534 | 31531 | 2.787878788 | 2.29004329 |
| 41535 | 31532 | 2.758377425 | 1.419753086 |
| 41536 | 31533 | 2.738095238 | 1.194987179 |
| 41537 | 31534 | 2.738095238 | 1.277777778 |
| 41538 | 31535 | 2.724738676 | 1.869918699 |
| 41539 | 31536 | 2.723294723 | 2.279279279 |
| 41540 | 31537 | 2.716190476 | 2.913333333 |
| 41541 | 31538 | 2.708225108 | 2.578787879 |
| 41542 | 31539 | 2.705882353 | 1.803921569 |
| 41543 | 31540 | 2.700587084 | 1.99543379 |
| 41544 | 31541 | 2.688311688 | 2.090909091 |
| 41545 | 31542 | 2.665079365 | 1.086111111 |
| 41546 | 31543 | 2.659863946 | 3.833333333 |
| 41547 | 31544 | 2.635416667 | 2.455729167 |
| 41548 | 31545 | 2.634116938 | 1.116033755 |

FIG. 10 (Cont.)

| DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment |
|---|---|---|---|---|---|---|---|---|---|---|---|---|---|---|---|
| 41575 | 31572 | 2.268707483 | 1.916666667 | 41603 | 31600 | 2.021978022 | 1.769230769 | 41631 | 31628 | 1.84 | 1.226666667 | 41659 | 31656 | 1.642857143 | 1.022222222 |
| 41576 | 31573 | 2.238618524 | 2.358974359 | 41604 | 31601 | 2.01754386 | 1.614035088 | 41632 | 31629 | 1.825396825 | 1.742424242 | 41660 | 31657 | 1.642857143 | 1.829545455 |
| 41577 | 31574 | 2.238095238 | 1.916666667 | 41605 | 31602 | 2.016013485 | 1.017699115 | 41633 | 31630 | 1.80952381 | 1.166666667 | 41661 | 31658 | 1.637325637 | 1.084175084 |
| 41578 | 31575 | 2.228243021 | 1.057471264 | 41606 | 31603 | 2.01423098 | 1.409961686 | 41634 | 31631 | 1.806182122 | 1.00877193 | 41662 | 31659 | 1.633249791 | 1.176900585 |
| 41579 | 31576 | 2.19047619 | 1.032051282 | 41607 | 31604 | 2.005365526 | 3.023474178 | 41635 | 31632 | 1.803921569 | 1.014705882 | 41663 | 31660 | 1.632119514 | 3.006535948 |
| 41580 | 31577 | 2.19047619 | 6.098484848 | 41608 | 31605 | 2.001175779 | 1.609053498 | 41636 | 31633 | 1.797313797 | 2.555555556 | 41664 | 31661 | 1.628815629 | 1.769230769 |
| 41581 | 31578 | 2.19047619 | 1.533333333 | 41609 | 31606 | 1.991341991 | 2.265151515 | 41637 | 31634 | 1.784832451 | 2.768518519 | 41665 | 31662 | 1.627210884 | 1.478571429 |
| 41582 | 31579 | 2.19047619 | 1.15 | 41610 | 31607 | 1.991341991 | 2.003787879 | 41638 | 31635 | 1.777178796 | 2.386792453 | 41666 | 31663 | 1.614035088 | 1.210526316 |
| 41583 | 31580 | 2.19047619 | 3.120155039 | 41611 | 31608 | 1.991341991 | 1.568181818 | 41639 | 31636 | 1.77456299 | 1.164556962 | 41667 | 31664 | 1.614035088 | 1.361842105 |
| 41584 | 31581 | 2.19047619 | 2.896296296 | 41612 | 31609 | 1.991341991 | 1.045454545 | 41640 | 31637 | 1.752380952 | 1.672727273 | 41668 | 31665 | 1.614035088 | 1.614035088 |
| 41585 | 31582 | 2.19047619 | 2.175675676 | 41613 | 31610 | 1.985119048 | 1.557291667 | 41641 | 31638 | 1.73727422 | 1.80651341 | 41669 | 31666 | 1.611384784 | 1.498084291 |
| 41586 | 31583 | 2.19047619 | 1.317708333 | 41614 | 31611 | 1.971428571 | 2.683333333 | 41642 | 31639 | 1.73047619 | 1.878333333 | 41670 | 31667 | 1.604651163 | 2.228682171 |
| 41587 | 31584 | 2.139534884 | 1.515503876 | 41615 | 31612 | 1.955782313 | 2.875 | 41643 | 31640 | 1.721088435 | 1.779761905 | 41671 | 31668 | 1.600732601 | 1.621794872 |
| 41588 | 31585 | 2.138321995 | 1.003968254 | 41616 | 31613 | 1.943164363 | 1.731182796 | 41644 | 31641 | 1.716859717 | 1.087837838 | 41672 | 31669 | 1.598455598 | 1.346846847 |
| 41589 | 31586 | 2.131274131 | 1.761261261 | 41617 | 31614 | 1.937728938 | 2.358974359 | 41645 | 31642 | 1.714285714 | 1.111111111 | 41673 | 31670 | 1.593073593 | 1.161616162 |
| 41590 | 31587 | 2.124098124 | 1.626262626 | 41618 | 31615 | 1.935769657 | 3.298449612 | 41646 | 31643 | 1.712554113 | 1.184848485 | 41674 | 31671 | 1.593073593 | 2.787878788 |
| 41591 | 31588 | 2.112244898 | 2.053571429 | 41619 | 31616 | 1.932773109 | 1.578431373 | 41647 | 31644 | 1.703703704 | 1.064814815 | 41675 | 31672 | 1.593073593 | 1.443722944 |
| 41592 | 31589 | 2.102857143 | 1.226666667 | 41620 | 31617 | 1.927619048 | 1.38 | 41648 | 31645 | 1.693968254 | 1.635555556 | 41676 | 31673 | 1.589861751 | 2.287634409 |
| 41593 | 31590 | 2.099206349 | 1.118055556 | 41621 | 31618 | 1.898412698 | 1.022222222 | 41649 | 31646 | 1.690893901 | 1.68128655 | 41677 | 31674 | 1.589861751 | 2.040322581 |
| 41594 | 31591 | 2.097920858 | 1.187793427 | 41622 | 31619 | 1.898412698 | 1.277777778 | 41650 | 31647 | 1.688492063 | 2.315972222 | 41678 | 31675 | 1.589169001 | 1.954248366 |
| 41595 | 31592 | 2.089377289 | 1.120512821 | 41623 | 31620 | 1.898412698 | 1.788888889 | 41651 | 31648 | 1.67781155 | 1.875886525 | 41679 | 31676 | 1.584599797 | 1.141843972 |
| 41596 | 31593 | 2.082747853 | 2.136612022 | 41624 | 31621 | 1.895604396 | 1.032051282 | 41652 | 31649 | 1.656898657 | 1.326923077 | 41680 | 31677 | 1.584599797 | 1.712765957 |
| 41597 | 31594 | 2.068783069 | 2.768518519 | 41625 | 31622 | 1.890726817 | 1.533333333 | 41653 | 31650 | 1.650358774 | 1.155251142 | 41681 | 31678 | 1.579180509 | 1.515503876 |
| 41598 | 31595 | 2.06162465 | 1.12745098 | 41626 | 31623 | 1.87755102 | 1.095238095 | 41654 | 31651 | 1.649617872 | 1.325102881 | 41682 | 31679 | 1.577142857 | 1.993333333 |
| 41599 | 31596 | 2.06162465 | 2.198529412 | 41627 | 31624 | 1.87755102 | 2.3 | 41655 | 31652 | 1.642857143 | 1.384259259 | 41683 | 31680 | 1.574404762 | 1.677083333 |
| 41600 | 31597 | 2.050658561 | 1.060283688 | 41628 | 31625 | 1.865961199 | 2.413580247 | 41656 | 31653 | 1.642857143 | 1.105769231 | 41684 | 31681 | 1.56984127 | 1.15 |
| 41601 | 31598 | 2.044444444 | 1.277777778 | 41629 | 31626 | 1.853479853 | 1.769230769 | 41657 | 31654 | 1.642857143 | 1.109649123 | 41685 | 31682 | 1.569296375 | 1.258706468 |
| 41602 | 31599 | 2.034013605 | 1.505952381 | 41630 | 31627 | 1.846258503 | 1.423809524 | 41658 | 31655 | 1.642857143 | 1.677083333 | 41686 | 31683 | 1.551587302 | 4.152777778 |

FIG. 10 (Cont.)

| DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment |
|---|---|---|---|---|---|---|---|---|---|---|---|---|---|---|---|
| 41687 | 31684 | 1.546218487 | 2.029411765 | 41715 | 31712 | 1.432234432 | 1.032051282 | 41743 | 31740 | 1.335656214 | 1.495934959 | 41771 | 31768 | 1.25170068 | 3.833333333 |
| 41688 | 31685 | 1.544106167 | 1.256830601 | 41716 | 31713 | 1.430515063 | 1.603741497 | 41744 | 31741 | 1.335656214 | 2.056910569 | 41772 | 31769 | 1.24235963 | 1.315920398 |
| 41689 | 31686 | 1.541446208 | 2.910493827 | 41717 | 31714 | 1.427128427 | 1.103535354 | 41745 | 31742 | 1.333333333 | 1.666666667 | 41773 | 31770 | 1.241269841 | 1.277777778 |
| 41690 | 31687 | 1.535851122 | 1.718390805 | 41718 | 31715 | 1.423809524 | 1.15 | 41746 | 31743 | 1.331809524 | 1.165333333 | 41774 | 31771 | 1.235653236 | 1.376068376 |
| 41691 | 31688 | 1.533333333 | 1.4375 | 41719 | 31716 | 1.419753086 | 2.271604938 | 41747 | 31744 | 1.33146592 | 1.202614379 | 41775 | 31772 | 1.234632035 | 1.184848485 |
| 41692 | 31689 | 1.526695527 | 1.103535354 | 41720 | 31717 | 1.414104882 | 2.329113924 | 41748 | 31745 | 1.33146592 | 1.16503268 | 41776 | 31773 | 1.234071093 | 1.889671362 |
| 41693 | 31690 | 1.523809524 | 1.5 | 41721 | 31718 | 1.408163265 | 1.095238095 | 41749 | 31746 | 1.329931973 | 1.779761905 | 41777 | 31774 | 1.232142857 | 1.197916667 |
| 41694 | 31691 | 1.523809524 | 1.75 | 41722 | 31719 | 1.404151404 | 1.769230769 | 41750 | 31747 | 1.328649493 | 1.508196721 | 41778 | 31775 | 1.232142857 | 2.555555556 |
| 41695 | 31692 | 1.523809524 | 1.111111111 | 41723 | 31720 | 1.40327381 | 2.575520833 | 41751 | 31748 | 1.322551662 | 1.735849057 | 41779 | 31776 | 1.230839002 | 2.153968254 |
| 41696 | 31693 | 1.500326158 | 1.52283105 | 41724 | 31721 | 1.399470899 | 1.171296296 | 41752 | 31749 | 1.314285714 | 1.245833333 | 41780 | 31777 | 1.229741019 | 1.479532164 |
| 41697 | 31694 | 1.498746867 | 2.219298246 | 41725 | 31722 | 1.393939394 | 2.090909091 | 41753 | 31750 | 1.314285714 | 1.533333333 | 41781 | 31778 | 1.226666667 | 2.453333333 |
| 41698 | 31695 | 1.493506494 | 5.75 | 41726 | 31723 | 1.391865079 | 1.317708333 | 41754 | 31751 | 1.314285714 | 7.283333333 | 41782 | 31779 | 1.221611722 | 2.211538462 |
| 41699 | 31696 | 1.492063492 | 1.555555556 | 41727 | 31724 | 1.385811467 | 1.173469388 | 41755 | 31752 | 1.314285714 | 4.6 | 41783 | 31780 | 1.219440353 | 1.027491409 |
| 41700 | 31697 | 1.492063492 | 1.611111111 | 41728 | 31725 | 1.380300065 | 1.102739726 | 41756 | 31753 | 1.308943089 | 1.636178862 | 41784 | 31781 | 1.216931217 | 1.022222222 |
| 41701 | 31698 | 1.491388045 | 1.468085106 | 41729 | 31726 | 1.376870748 | 1.861904762 | 41757 | 31754 | 1.305860806 | 2.064102564 | 41785 | 31782 | 1.216931217 | 1.135802469 |
| 41702 | 31699 | 1.483870968 | 1.483870968 | 41730 | 31727 | 1.375415282 | 1.515503876 | 41758 | 31755 | 1.302445302 | 1.243243243 | 41786 | 31783 | 1.214285714 | 1.5 |
| 41703 | 31700 | 1.481792717 | 1.12745098 | 41731 | 31728 | 1.374416433 | 1.12745098 | 41759 | 31756 | 1.299435028 | 1.36440678 | 41787 | 31784 | 1.207570208 | 1.277777778 |
| 41704 | 31701 | 1.477297896 | 1.426356589 | 41732 | 31729 | 1.373688458 | 1.559322034 | 41760 | 31757 | 1.299003322 | 1.114341085 | 41788 | 31785 | 1.203558346 | 1.179487179 |
| 41705 | 31702 | 1.47172619 | 1.497395833 | 41733 | 31730 | 1.369047619 | 1.245833333 | 41761 | 31758 | 1.296404276 | 1.486394558 | 41789 | 31786 | 1.201228879 | 2.596774194 |
| 41706 | 31703 | 1.465686275 | 1.775735294 | 41734 | 31731 | 1.365491651 | 1.244588745 | 41762 | 31759 | 1.285714286 | 1.416666667 | 41790 | 31787 | 1.197460317 | 2.146666667 |
| 41707 | 31704 | 1.46031746 | 1.597222222 | 41735 | 31732 | 1.363881402 | 1.08490566 | 41763 | 31760 | 1.280586081 | 1.71025641 | 41791 | 31788 | 1.19047619 | 1.416666667 |
| 41708 | 31705 | 1.46031746 | 1.357638889 | 41736 | 31733 | 1.360401003 | 1.492982456 | 41764 | 31761 | 1.272844273 | 2.797297297 | 41792 | 31789 | 1.18501171 | 1.885245902 |
| 41709 | 31706 | 1.46031746 | 2.3 | 41737 | 31734 | 1.352941176 | 1.240196078 | 41765 | 31762 | 1.272562358 | 1.241269841 | 41793 | 31790 | 1.18501171 | 1.948087432 |
| 41710 | 31707 | 1.46031746 | 2.738095238 | 41738 | 31735 | 1.351570415 | 2.691489362 | 41766 | 31763 | 1.271889401 | 1.731182796 | 41794 | 31791 | 1.182161754 | 2.007936508 |
| 41711 | 31708 | 1.45211343 | 1.205992509 | 41739 | 31736 | 1.347985348 | 2.064102564 | 41767 | 31764 | 1.263736264 | 1.474358974 | 41795 | 31792 | 1.179487179 | 1.432234432 |
| 41712 | 31709 | 1.447941889 | 3.508474576 | 41740 | 31737 | 1.34595525 | 1.431726908 | 41768 | 31765 | 1.258358663 | 2.528368794 | 41796 | 31793 | 1.179487179 | 1.326923077 |
| 41713 | 31710 | 1.447941889 | 1.234463277 | 41741 | 31738 | 1.338624339 | 1.064814815 | 41769 | 31766 | 1.256830601 | 1.256830601 | 41797 | 31794 | 1.176972281 | 1.087064677 |
| 41714 | 31711 | 1.446540881 | 1.952830189 | 41742 | 31739 | 1.338624339 | 1.419753086 | 41770 | 31767 | 1.25170068 | 1.241269841 | 41798 | 31795 | 1.176972281 | 2.288557214 |

FIG. 10 (Cont.)

| DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment | DNA SEQ ID NO | AA SEQ ID NO | Spleen 1 Enrichment | Spleen 2 Enrichment |
|---|---|---|---|---|---|---|---|---|---|---|---|---|---|---|---|
| 41799 | 31796 | 1.17593985 | 1.492982456 | 41819 | 31816 | 1.131746032 | 1.118055556 | 41839 | 31836 | 1.095238095 | 1.13963964 | 41859 | 31856 | 1.035497835 | 1.324242424 |
| 41800 | 31797 | 1.174275896 | 1.067010309 | 41820 | 31817 | 1.129464286 | 1.4375 | 41840 | 31837 | 1.095238095 | 1.427304965 | 41860 | 31857 | 1.034870641 | 1.056430446 |
| 41801 | 31798 | 1.173469388 | 2.327380952 | 41821 | 31818 | 1.124839125 | 1.657657658 | 41841 | 31838 | 1.082932049 | 1.292134831 | 41861 | 31858 | 1.034391534 | 2.236111111 |
| 41802 | 31799 | 1.171650055 | 1.872093023 | 41822 | 31819 | 1.123321123 | 1.425213675 | 41842 | 31839 | 1.081014224 | 1.095238095 | 41862 | 31859 | 1.030812325 | 2.818627451 |
| 41803 | 31800 | 1.170771757 | 1.123563218 | 41823 | 31820 | 1.11957672 | 1.533333333 | 41843 | 31840 | 1.075324675 | 1.184848485 | 41863 | 31860 | 1.030812325 | 1.623529412 |
| 41804 | 31801 | 1.168253968 | 1.448148148 | 41824 | 31821 | 1.119047619 | 1.375 | 41844 | 31841 | 1.069767442 | 3.387596899 | 41864 | 31861 | 1.030812325 | 1.428104575 |
| 41805 | 31802 | 1.159663866 | 2.179738562 | 41825 | 31822 | 1.118541033 | 1.631205674 | 41845 | 31842 | 1.068524971 | 1.495934959 | 41865 | 31862 | 1.024577573 | 1.23655914 |
| 41806 | 31803 | 1.159663866 | 1.240196078 | 41826 | 31823 | 1.114795918 | 1.4375 | 41846 | 31843 | 1.067155067 | 1.376068376 | 41866 | 31863 | 1.022222222 | 1.405555556 |
| 41807 | 31804 | 1.159663866 | 1.202614379 | 41827 | 31824 | 1.112622827 | 1.582010582 | 41847 | 31844 | 1.065637066 | 1.657657658 | 41867 | 31864 | 1.022222222 | 1.788888889 |
| 41808 | 31805 | 1.152882206 | 1.210526316 | 41828 | 31825 | 1.112087912 | 1.887179487 | 41848 | 31845 | 1.063945578 | 4.380952381 | 41868 | 31865 | 1.018108652 | 2.051643192 |
| 41809 | 31806 | 1.152882206 | 2.824561404 | 41829 | 31826 | 1.112087912 | 1.651282051 | 41849 | 31846 | 1.062049062 | 1.742424242 | 41869 | 31866 | 1.017006803 | 1.848214286 |
| 41810 | 31807 | 1.152882206 | 1.815789474 | 41830 | 31827 | 1.111111111 | 2 | 41850 | 31847 | 1.058730159 | 1.597222222 | 41870 | 31867 | 1.016380952 | 1.349333333 |
| 41811 | 31808 | 1.152882206 | 1.311403509 | 41831 | 31828 | 1.110241357 | 1.52283105 | 41851 | 31848 | 1.057471264 | 1.32183908 | 41871 | 31868 | 1.013095238 | 1.102083333 |
| 41812 | 31809 | 1.151404151 | 1.228632479 | 41832 | 31829 | 1.109461967 | 1.244588745 | 41852 | 31849 | 1.056122449 | 1.505952381 | 41872 | 31869 | 1.010989011 | 2.137820513 |
| 41813 | 31810 | 1.14739229 | 2.099206349 | 41833 | 31830 | 1.095238095 | 1.823170732 | 41853 | 31850 | 1.051428571 | 4.063333333 | 41873 | 31870 | 1.006435006 | 1.346846847 |
| 41814 | 31811 | 1.14739229 | 1.216931217 | 41834 | 31831 | 1.095238095 | 1.742424242 | 41854 | 31851 | 1.051428571 | 1.226666667 | 41874 | 31871 | 1.001360544 | 1.095238095 |
| 41815 | 31812 | 1.142857143 | 1.333333333 | 41835 | 31832 | 1.095238095 | 2.555555556 | 41855 | 31852 | 1.047619048 | 4.666666667 | 41875 | 31872 | 1.000587889 | 1.514403292 |
| 41816 | 31813 | 1.134353741 | 1.095238095 | 41836 | 31833 | 1.095238095 | 2.058641975 | 41856 | 31853 | 1.041811847 | 1.12195122 | | | | |
| 41817 | 31814 | 1.133380715 | 1.029850746 | 41837 | 31834 | 1.095238095 | 1.277777778 | 41857 | 31854 | 1.04047619 | 1.29375 | | | | |
| 41818 | 31815 | 1.133004926 | 1.057471264 | 41838 | 31835 | 1.095238095 | 1.4375 | 41858 | 31855 | 1.039072039 | 3.391025641 | | | | |

FIG. 11

| DNA SEQ ID NO | AA SEQ ID NO | Stomach 1 Enrichment | Stomach 2 Enrichment |
|---|---|---|---|
| 41876 | 31873 | 2139.442308 | 239.7307692 |
| 41877 | 31874 | 2110 | 335.3333333 |
| 41878 | 31875 | 1502 | 36 |
| 41879 | 31876 | 1421.157895 | 36.31578947 |
| 41880 | 31877 | 1177.6 | 19.42222222 |
| 41881 | 31878 | 1048.690476 | 63.34126984 |
| 41882 | 31879 | 1023.189189 | 16.57657658 |
| 41883 | 31880 | 1000.676923 | 21.93846154 |
| 41884 | 31881 | 1000.074074 | 21.58024691 |
| 41885 | 31882 | 991.0444444 | 40.03703704 |
| 41886 | 31883 | 889.1232877 | 11.13242009 |
| 41887 | 31884 | 775.4285714 | 7.119047619 |
| 41888 | 31885 | 685.2083333 | 13.73611111 |
| 41889 | 31886 | 585.35 | 41.01666667 |
| 41890 | 31887 | 511.3488372 | 2.852713178 |
| 41891 | 31888 | 483.8846154 | 15.62820513 |
| 41892 | 31889 | 461.3939394 | 58.54545455 |
| 41893 | 31890 | 446.3703704 | 11.07407407 |
| 41894 | 31891 | 445.3191489 | 38.17021277 |
| 41895 | 31892 | 440.2150538 | 4.946236559 |
| 41896 | 31893 | 420.7153285 | 19.36253041 |
| 41897 | 31894 | 418.1071429 | 73.92857143 |
| 41898 | 31895 | 414.6478873 | 3.887323944 |
| 41899 | 31896 | 404 | 4.444444444 |
| 41900 | 31897 | 402.9259259 | 15.90123457 |
| 41901 | 31898 | 400.8571429 | 3.066666667 |

| DNA SEQ ID NO | AA SEQ ID NO | Stomach 1 Enrichment | Stomach 2 Enrichment |
|---|---|---|---|
| 41902 | 31899 | 381.8730159 | 24.33862434 |
| 41903 | 31900 | 381.5737705 | 12.31693989 |
| 41904 | 31901 | 378.5416667 | 8.944444444 |
| 41905 | 31902 | 373.52 | 6.378666667 |
| 41906 | 31903 | 370.2330097 | 28.13592233 |
| 41907 | 31904 | 365.8095238 | 15.33333333 |
| 41908 | 31905 | 365.4444444 | 8.802469136 |
| 41909 | 31906 | 363.4 | 5.914285714 |
| 41910 | 31907 | 359.4814815 | 24.04115226 |
| 41911 | 31908 | 358.9508197 | 38.20765027 |
| 41912 | 31909 | 351.7083333 | 14.21527778 |
| 41913 | 31910 | 350.7008547 | 14.28490028 |
| 41914 | 31911 | 337.3333333 | 5.366666667 |
| 41915 | 31912 | 337.3333333 | 13.62962963 |
| 41916 | 31913 | 327.1111111 | 14.19753086 |
| 41917 | 31914 | 319.9402985 | 1.144278607 |
| 41918 | 31915 | 309.58 | 14.72 |
| 41919 | 31916 | 300.4375 | 30.90625 |
| 41920 | 31917 | 297.4059406 | 1.214521452 |
| 41921 | 31918 | 291.7714286 | 7.885714286 |
| 41922 | 31919 | 285.0103093 | 12.64604811 |
| 41923 | 31920 | 276 | 5.484184915 |
| 41924 | 31921 | 270.3777778 | 17.54814815 |
| 41925 | 31922 | 269.6382979 | 14.5177305 |
| 41926 | 31923 | 265.8529412 | 14.09313725 |
| 41927 | 31924 | 264.2553191 | 16.96453901 |

| DNA SEQ ID NO | AA SEQ ID NO | Stomach 1 Enrichment | Stomach 2 Enrichment |
|---|---|---|---|
| 41928 | 31925 | 256.2857143 | 1.792207792 |
| 41929 | 31926 | 241.2653061 | 7.197278912 |
| 41930 | 31927 | 240.4545455 | 19.97979798 |
| 41931 | 31928 | 240.3870968 | 13.84946237 |
| 41932 | 31929 | 236.6506024 | 4.064257028 |
| 41933 | 31930 | 231.9166667 | 21.50925926 |
| 41934 | 31931 | 220.9896907 | 15.01718213 |
| 41935 | 31932 | 215.28 | 3.475555556 |
| 41936 | 31933 | 214.0533333 | 2.044444444 |
| 41937 | 31934 | 213.8241758 | 16.51282051 |
| 41938 | 31935 | 202.2891566 | 14.77911647 |
| 41939 | 31936 | 202.0166667 | 13.92777778 |
| 41940 | 31937 | 200.990991 | 15.47147147 |
| 41941 | 31938 | 198.7010309 | 7.745704467 |
| 41942 | 31939 | 198.1869159 | 3.439252336 |
| 41943 | 31940 | 192 | 16.83333333 |
| 41944 | 31941 | 187.3658537 | 23.74796748 |
| 41945 | 31942 | 176.3909774 | 13.25814536 |
| 41946 | 31943 | 176.0595238 | 1.642857143 |
| 41947 | 31944 | 174.8760331 | 15.96694215 |
| 41948 | 31945 | 170.5833333 | 21.08333333 |
| 41949 | 31946 | 158.4444444 | 7.666666667 |
| 41950 | 31947 | 156.852459 | 1.508196721 |
| 41951 | 31948 | 154.1343284 | 1.60199005 |
| 41952 | 31949 | 152.8135593 | 3.378531073 |
| 41953 | 31950 | 150.047619 | 10.03968254 |

| DNA SEQ ID NO | AA SEQ ID NO | Stomach 1 Enrichment | Stomach 2 Enrichment |
|---|---|---|---|
| 41954 | 31951 | 149.3982301 | 12.21238938 |
| 41955 | 31952 | 144.7083333 | 7.506944444 |
| 41956 | 31953 | 103.5966387 | 14.94677871 |
| 41957 | 31954 | 78.85714286 | 3.285714286 |
| 41958 | 31955 | 55.97202797 | 4.181818182 |
| 41959 | 31956 | 37.59437751 | 10.37617135 |
| 41960 | 31957 | 27.28813559 | 1.559322034 |
| 41961 | 31958 | 27.01587302 | 13.87301587 |
| 41962 | 31959 | 24.64285714 | 21.35714286 |
| 41963 | 31960 | 24.53333333 | 1.533333333 |
| 41964 | 31961 | 24.35294118 | 7.215686275 |
| 41965 | 31962 | 24 | 10 |
| 41966 | 31963 | 23 | 2.279279279 |
| 41967 | 31964 | 19.46153846 | 12.08974359 |
| 41968 | 31965 | 19.29032258 | 30.41935484 |
| 41969 | 31966 | 19.07317073 | 3.739837398 |
| 41970 | 31967 | 19.07317073 | 1.121951220 |
| 41971 | 31968 | 17.44827586 | 10.31034483 |
| 41972 | 31969 | 16.675 | 22.23333333 |
| 41973 | 31970 | 16.12987013 | 3.584415584 |
| 41974 | 31971 | 15.92307692 | 17.1025641 |
| 41975 | 31972 | 15.77142857 | 2.19047619 |
| 41976 | 31973 | 13.14285714 | 2.19047619 |
| 41977 | 31974 | 12.54545455 | 3.717171717 |
| 41978 | 31975 | 12.54545455 | 6.969696970 |
| 41979 | 31976 | 12.17647059 | 5.862745098 |

FIG. 11 (Cont.)

| DNA SEQ ID NO | AA SEQ ID NO | Stomach 1 Enrichment | Stomach 2 Enrichment | DNA SEQ ID NO | AA SEQ ID NO | Stomach 1 Enrichment | Stomach 2 Enrichment | DNA SEQ ID NO | AA SEQ ID NO | Stomach 1 Enrichment | Stomach 2 Enrichment | DNA SEQ ID NO | AA SEQ ID NO | Stomach 1 Enrichment | Stomach 2 Enrichment |
|---|---|---|---|---|---|---|---|---|---|---|---|---|---|---|---|
| 41980 | 31977 | 12.10526316 | 1.614035088 | 42002 | 31999 | 5.935483871 | 2.967741935 | 42024 | 32021 | 2.76 | 1.84 | 42046 | 32043 | 1.15 | 25.68333333 |
| 41981 | 31978 | 12 | 14.22222222 | 42003 | 32000 | 5.75 | 2.3 | 42025 | 32022 | 2.225806452 | 29.67741935 | 42047 | 32044 | 1.15 | 12.84166667 |
| 41982 | 31979 | 11.87096774 | 6.677419355 | 42004 | 32001 | 5.75 | 13.17708333 | 42026 | 32023 | 2.123076923 | 11.55897436 | 42048 | 32045 | 1.15 | 6.133333333 |
| 41983 | 31980 | 11.5 | 65.16666667 | 42005 | 32002 | 5.376623377 | 11.15151515 | 42027 | 32024 | 2 | 8.666666667 | 42049 | 32046 | 1.12195122 | 15.14634146 |
| 41984 | 31981 | 11.24444444 | 11.58518519 | 42006 | 32003 | 5.227272727 | 1.045454545 | 42028 | 32025 | 1.957446809 | 25.77304965 | 42050 | 32047 | 1.12195122 | 46 |
| 41985 | 31982 | 11.01408451 | 34.33802817 | 42007 | 32004 | 5.158878505 | 7.738317757 | 42029 | 32026 | 1.916666667 | 31.30555556 | 42051 | 32048 | 1.12195122 | 7.853658537 |
| 41986 | 31983 | 10.22222222 | 3.975308642 | 42008 | 32005 | 5.111111111 | 110.7407407 | 42030 | 32027 | 1.84 | 20.85333333 | 42052 | 32049 | 1.108433735 | 10.71485944 |
| 41987 | 31984 | 10.01980198 | 3.491749175 | 42009 | 32006 | 4.901639344 | 2.010928962 | 42031 | 32028 | 1.792207792 | 2.588744589 | 42053 | 32050 | 1.095238095 | 50.38095238 |
| 41988 | 31985 | 9.857142857 | 10.03968254 | 42010 | 32007 | 4.813953488 | 10.34108527 | 42032 | 32029 | 1.769230769 | 29.19230769 | 42054 | 32051 | 1.095238095 | 13.14285714 |
| 41989 | 31986 | 9.517241379 | 2.643678161 | 42011 | 32008 | 4.693877551 | 2.816326531 | 42033 | 32030 | 1.735849057 | 1.735849057 | 42055 | 32052 | 1.069767442 | 4.635658915 |
| 41990 | 31987 | 9.2 | 10.73333333 | 42012 | 32009 | 4.6 | 12.26666667 | 42034 | 32031 | 1.703703704 | 53.95061728 | 42056 | 32053 | 1.069767442 | 51.70542636 |
| 41991 | 31988 | 8 | 6.666666667 | 42013 | 32010 | 4.543209877 | 15.14403292 | 42035 | 32032 | 1.642857143 | 28.47619048 | 42057 | 32054 | 1.069767442 | 3.209302326 |
| 41992 | 31989 | 7.666666667 | 4.472222222 | 42014 | 32011 | 4.503496503 | 5.897435897 | 42036 | 32033 | 1.642857143 | 1.423809524 | 42058 | 32055 | 1.069767442 | 11.41085271 |
| 41993 | 31990 | 7.666666667 | 2.555555556 | 42015 | 32012 | 4.380952381 | 22.63492063 | 42037 | 32034 | 1.623529412 | 16.23529412 | 42059 | 32056 | 1.069767442 | 7.666666667 |
| 41994 | 31991 | 7.666666667 | 1.277777778 | 42016 | 32013 | 4.1 | 7.566666667 | 42038 | 32035 | 1.483870968 | 26.21505376 | 42060 | 32057 | 1.022222222 | 23.17037037 |
| 41995 | 31992 | 7.561643836 | 1.470319635 | 42017 | 32014 | 3.887323944 | 19.8685446 | 42039 | 32036 | 1.4375 | 16.77083333 | 42061 | 32058 | 1.022222222 | 13.11851852 |
| 41996 | 31993 | 7.527272727 | 8.642424242 | 42018 | 32015 | 3.59375 | 3.59375 | 42040 | 32037 | 1.393939394 | 56.22222222 | 42062 | 32059 | 1.022222222 | 36.11851852 |
| 41997 | 31994 | 7.276836158 | 8.316384181 | 42019 | 32016 | 3.538461538 | 1.651282051 | 42041 | 32038 | 1.277777778 | 48.55555556 | 42063 | 32060 | 1.010989011 | 2.695970696 |
| 41998 | 31995 | 7.1875 | 3.673611111 | 42020 | 32017 | 3.285714286 | 10.4829932 | 42042 | 32039 | 1.254545455 | 38.05454545 | | | | |
| 41999 | 31996 | 6.686046512 | 1.872093023 | 42021 | 32018 | 2.967741935 | 2.720430108 | 42043 | 32040 | 1.243243243 | 28.59459459 | | | | |
| 42000 | 31997 | 6.571428571 | 14.6031746 | 42022 | 32019 | 2.920634921 | 9.492063492 | 42044 | 32041 | 1.179487179 | 21.23076923 | | | | |
| 42001 | 31998 | 6.258503401 | 7.092970522 | 42023 | 32020 | 2.875 | 15.65277778 | 42045 | 32042 | 1.179487179 | 18.47863248 | | | | |

FIG. 12

| DNA SEQ ID NO | AA SEQ ID NO | Testicle 1 Enrichment |
|---|---|---|
| 42064 | 32061 | 26.45 |
| 42065 | 32062 | 10.15833333 |
| 42066 | 32063 | 8.625 |
| 42067 | 32064 | 8.05 |
| 42068 | 32065 | 7.59 |
| 42069 | 32066 | 7.283333333 |
| 42070 | 32067 | 7.1875 |
| 42071 | 32068 | 6.708333333 |
| 42072 | 32069 | 5.635 |
| 42073 | 32070 | 5.175 |
| 42074 | 32071 | 5.092857143 |
| 42075 | 32072 | 4.74375 |
| 42076 | 32073 | 4.6 |
| 42077 | 32074 | 4.45625 |
| 42078 | 32075 | 4.255 |
| 42079 | 32076 | 4.14 |
| 42080 | 32077 | 3.641666667 |
| 42081 | 32078 | 3.408928571 |
| 42082 | 32079 | 3.370689655 |
| 42083 | 32080 | 3.345454545 |
| 42084 | 32081 | 3.258333333 |
| 42085 | 32082 | 3.258333333 |
| 42086 | 32083 | 3.066666667 |
| 42087 | 32084 | 3.066666667 |
| 42088 | 32085 | 2.998214286 |
| 42089 | 32086 | 2.902380952 |
| 42090 | 32087 | 2.9 |

| DNA SEQ ID NO | AA SEQ ID NO | Testicle 1 Enrichment |
|---|---|---|
| 42091 | 32088 | 2.890540541 |
| 42092 | 32089 | 2.875 |
| 42093 | 32090 | 2.875 |
| 42094 | 32091 | 2.834883721 |
| 42095 | 32092 | 2.795138889 |
| 42096 | 32093 | 2.792857143 |
| 42097 | 32094 | 2.747222222 |
| 42098 | 32095 | 2.742307692 |
| 42099 | 32096 | 2.738095238 |
| 42100 | 32097 | 2.73125 |
| 42101 | 32098 | 2.653846154 |
| 42102 | 32099 | 2.60546875 |
| 42103 | 32100 | 2.5875 |
| 42104 | 32101 | 2.555555556 |
| 42105 | 32102 | 2.546428571 |
| 42106 | 32103 | 2.506410256 |
| 42107 | 32104 | 2.464285714 |
| 42108 | 32105 | 2.464285714 |
| 42109 | 32106 | 2.373404255 |
| 42110 | 32107 | 2.366666667 |
| 42111 | 32108 | 2.361333333 |
| 42112 | 32109 | 2.323469388 |
| 42113 | 32110 | 2.3 |
| 42114 | 32111 | 2.3 |
| 42115 | 32112 | 2.3 |
| 42116 | 32113 | 2.3 |
| 42117 | 32114 | 2.283088235 |

| DNA SEQ ID NO | AA SEQ ID NO | Testicle 1 Enrichment |
|---|---|---|
| 42118 | 32115 | 2.264615385 |
| 42119 | 32116 | 2.25 |
| 42120 | 32117 | 2.2425 |
| 42121 | 32118 | 2.223333333 |
| 42122 | 32119 | 2.211538462 |
| 42123 | 32120 | 2.167307692 |
| 42124 | 32121 | 2.15625 |
| 42125 | 32122 | 2.15 |
| 42126 | 32123 | 2.124576271 |
| 42127 | 32124 | 2.121111111 |
| 42128 | 32125 | 2.118421053 |
| 42129 | 32126 | 2.108333333 |
| 42130 | 32127 | 2.090909091 |
| 42131 | 32128 | 2.075609756 |
| 42132 | 32129 | 2.064772727 |
| 42133 | 32130 | 2.057894737 |
| 42134 | 32131 | 2.05 |
| 42135 | 32132 | 2.05 |
| 42136 | 32133 | 2.044444444 |
| 42137 | 32134 | 2.044444444 |
| 42138 | 32135 | 2.038636364 |
| 42139 | 32136 | 1.990384615 |
| 42140 | 32137 | 1.988235529 |
| 42141 | 32138 | 1.976056338 |
| 42142 | 32139 | 1.971428571 |
| 42143 | 32140 | 1.95 |
| 42144 | 32141 | 1.934090909 |

| DNA SEQ ID NO | AA SEQ ID NO | Testicle 1 Enrichment |
|---|---|---|
| 42145 | 32142 | 1.916666667 |
| 42146 | 32143 | 1.916666667 |
| 42147 | 32144 | 1.907317073 |
| 42148 | 32145 | 1.891111111 |
| 42149 | 32146 | 1.889285714 |
| 42150 | 32147 | 1.887735849 |
| 42151 | 32148 | 1.886 |
| 42152 | 32149 | 1.881818182 |
| 42153 | 32150 | 1.876315789 |
| 42154 | 32151 | 1.86875 |
| 42155 | 32152 | 1.865555556 |
| 42156 | 32153 | 1.861904762 |
| 42157 | 32154 | 1.861904762 |
| 42158 | 32155 | 1.84 |
| 42159 | 32156 | 1.826470588 |
| 42160 | 32157 | 1.807142857 |
| 42161 | 32158 | 1.807142857 |
| 42162 | 32159 | 1.786607143 |
| 42163 | 32160 | 1.785526316 |
| 42164 | 32161 | 1.777272727 |
| 42165 | 32162 | 1.775 |
| 42166 | 32163 | 1.758823529 |
| 42167 | 32164 | 1.756944444 |
| 42168 | 32165 | 1.753278689 |
| 42169 | 32166 | 1.752380952 |
| 42170 | 32167 | 1.750746269 |
| 42171 | 32168 | 1.744827586 |

| DNA SEQ ID NO | AA SEQ ID NO | Testicle 1 Enrichment |
|---|---|---|
| 42172 | 32169 | 1.742424242 |
| 42173 | 32170 | 1.737777778 |
| 42174 | 32171 | 1.735087719 |
| 42175 | 32172 | 1.725 |
| 42176 | 32173 | 1.725 |
| 42177 | 32174 | 1.725 |
| 42178 | 32175 | 1.71097561 |
| 42179 | 32176 | 1.709459459 |
| 42180 | 32177 | 1.707575758 |
| 42181 | 32178 | 1.707216495 |
| 42182 | 32179 | 1.703703704 |
| 42183 | 32180 | 1.702884615 |
| 42184 | 32181 | 1.684883721 |
| 42185 | 32182 | 1.680769231 |
| 42186 | 32183 | 1.680769231 |
| 42187 | 32184 | 1.677868852 |
| 42188 | 32185 | 1.675714286 |
| 42189 | 32186 | 1.671649485 |
| 42190 | 32187 | 1.669354839 |
| 42191 | 32188 | 1.6675 |
| 42192 | 32189 | 1.657352941 |
| 42193 | 32190 | 1.646315789 |
| 42194 | 32191 | 1.642857143 |
| 42195 | 32192 | 1.642857143 |
| 42196 | 32193 | 1.642857143 |
| 42197 | 32194 | 1.636538462 |
| 42198 | 32195 | 1.635555556 |

FIG. 12 (Cont.)

| DNA SEQ ID NO | AA SEQ ID NO | Testicle 1 Enrichment |
|---|---|---|
| 42199 | 32196 | 1.634210526 |
| 42200 | 32197 | 1.627922078 |
| 42201 | 32198 | 1.622321429 |
| 42202 | 32199 | 1.620454545 |
| 42203 | 32200 | 1.61 |
| 42204 | 32201 | 1.603947368 |
| 42205 | 32202 | 1.602459016 |
| 42206 | 32203 | 1.6 |
| 42207 | 32204 | 1.598780488 |
| 42208 | 32205 | 1.59516129 |
| 42209 | 32206 | 1.593373494 |
| 42210 | 32207 | 1.592307692 |
| 42211 | 32208 | 1.592307692 |
| 42212 | 32209 | 1.590833333 |
| 42213 | 32210 | 1.588815789 |
| 42214 | 32211 | 1.588095238 |
| 42215 | 32212 | 1.588095238 |
| 42216 | 32213 | 1.583333333 |
| 42217 | 32214 | 1.58125 |
| 42218 | 32215 | 1.580272109 |
| 42219 | 32216 | 1.575925926 |
| 42220 | 32217 | 1.568181818 |
| 42221 | 32218 | 1.564 |
| 42222 | 32219 | 1.560714286 |
| 42223 | 32220 | 1.560714286 |
| 42224 | 32221 | 1.553508772 |
| 42225 | 32222 | 1.546551724 |
| 42226 | 32223 | 1.544285714 |
| 42227 | 32224 | 1.543835616 |

| DNA SEQ ID NO | AA SEQ ID NO | Testicle 1 Enrichment |
|---|---|---|
| 42228 | 32225 | 1.541 |
| 42229 | 32226 | 1.539516129 |
| 42230 | 32227 | 1.533333333 |
| 42231 | 32228 | 1.533333333 |
| 42232 | 32229 | 1.519642857 |
| 42233 | 32230 | 1.519135802 |
| 42234 | 32231 | 1.518 |
| 42235 | 32232 | 1.517525773 |
| 42236 | 32233 | 1.515909091 |
| 42237 | 32234 | 1.511428571 |
| 42238 | 32235 | 1.506896552 |
| 42239 | 32236 | 1.503846154 |
| 42240 | 32237 | 1.500609756 |
| 42241 | 32238 | 1.5 |
| 42242 | 32239 | 1.5 |
| 42243 | 32240 | 1.495 |
| 42244 | 32241 | 1.495 |
| 42245 | 32242 | 1.487333333 |
| 42246 | 32243 | 1.482644628 |
| 42247 | 32244 | 1.478571429 |
| 42248 | 32245 | 1.478571429 |
| 42249 | 32246 | 1.474705882 |
| 42250 | 32247 | 1.465686275 |
| 42251 | 32248 | 1.458035714 |
| 42252 | 32249 | 1.458035714 |
| 42253 | 32250 | 1.456666667 |
| 42254 | 32251 | 1.456666667 |
| 42255 | 32252 | 1.450769231 |
| 42256 | 32253 | 1.448701299 |

| DNA SEQ ID NO | AA SEQ ID NO | Testicle 1 Enrichment |
|---|---|---|
| 42257 | 32254 | 1.447647059 |
| 42258 | 32255 | 1.445714286 |
| 42259 | 32256 | 1.444512195 |
| 42260 | 32257 | 1.444186047 |
| 42261 | 32258 | 1.442727273 |
| 42262 | 32259 | 1.4375 |
| 42263 | 32260 | 1.4375 |
| 42264 | 32261 | 1.4375 |
| 42265 | 32262 | 1.4375 |
| 42266 | 32263 | 1.4375 |
| 42267 | 32264 | 1.433950617 |
| 42268 | 32265 | 1.433561644 |
| 42269 | 32266 | 1.433561644 |
| 42270 | 32267 | 1.43245614 |
| 42271 | 32268 | 1.430916031 |
| 42272 | 32269 | 1.430813953 |
| 42273 | 32270 | 1.427007299 |
| 42274 | 32271 | 1.421818182 |
| 42275 | 32272 | 1.420588235 |
| 42276 | 32273 | 1.41744186 |
| 42277 | 32274 | 1.415384615 |
| 42278 | 32275 | 1.415384615 |
| 42279 | 32276 | 1.405555556 |
| 42280 | 32277 | 1.405555556 |
| 42281 | 32278 | 1.399166667 |
| 42282 | 32279 | 1.398648649 |
| 42283 | 32280 | 1.39845679 |
| 42284 | 32281 | 1.396428571 |
| 42285 | 32282 | 1.393939394 |

| DNA SEQ ID NO | AA SEQ ID NO | Testicle 1 Enrichment |
|---|---|---|
| 42286 | 32283 | 1.387931034 |
| 42287 | 32284 | 1.384259259 |
| 42288 | 32285 | 1.38 |
| 42289 | 32286 | 1.38 |
| 42290 | 32287 | 1.38 |
| 42291 | 32288 | 1.377325581 |
| 42292 | 32289 | 1.374390244 |
| 42293 | 32290 | 1.369852941 |
| 42294 | 32291 | 1.368103448 |
| 42295 | 32292 | 1.367567568 |
| 42296 | 32293 | 1.365625 |
| 42297 | 32294 | 1.362056738 |
| 42298 | 32295 | 1.36122449 |
| 42299 | 32296 | 1.359090909 |
| 42300 | 32297 | 1.359090909 |
| 42301 | 32298 | 1.355970149 |
| 42302 | 32299 | 1.355357143 |
| 42303 | 32300 | 1.354444444 |
| 42304 | 32301 | 1.354444444 |
| 42305 | 32302 | 1.351546392 |
| 42306 | 32303 | 1.348275862 |
| 42307 | 32304 | 1.348275862 |
| 42308 | 32305 | 1.345283019 |
| 42309 | 32306 | 1.341666667 |
| 42310 | 32307 | 1.341666667 |
| 42311 | 32308 | 1.341666667 |
| 42312 | 32309 | 1.341666667 |
| 42313 | 32310 | 1.34015748 |
| 42314 | 32311 | 1.3225 |

| DNA SEQ ID NO | AA SEQ ID NO | Testicle 1 Enrichment |
|---|---|---|
| 42315 | 32312 | 1.32037037 |
| 42316 | 32313 | 1.318292683 |
| 42317 | 32314 | 1.314285714 |
| 42318 | 32315 | 1.311 |
| 42319 | 32316 | 1.311 |
| 42320 | 32317 | 1.303333333 |
| 42321 | 32318 | 1.303333333 |
| 42322 | 32319 | 1.301315789 |
| 42323 | 32320 | 1.29375 |
| 42324 | 32321 | 1.29375 |
| 42325 | 32322 | 1.292380952 |
| 42326 | 32323 | 1.290243902 |
| 42327 | 32324 | 1.290243902 |
| 42328 | 32325 | 1.288 |
| 42329 | 32326 | 1.288 |
| 42330 | 32327 | 1.277777778 |
| 42331 | 32328 | 1.274698795 |
| 42332 | 32329 | 1.273214286 |
| 42333 | 32330 | 1.269480519 |
| 42334 | 32331 | 1.268556701 |
| 42335 | 32332 | 1.268382353 |
| 42336 | 32333 | 1.265 |
| 42337 | 32334 | 1.265 |
| 42338 | 32335 | 1.265 |
| 42339 | 32336 | 1.263114754 |
| 42340 | 32337 | 1.258235294 |
| 42341 | 32338 | 1.254545455 |
| 42342 | 32339 | 1.254545455 |
| 42343 | 32340 | 1.254545455 |

FIG. 12 (Cont.)

| DNA SEQ ID NO | AA SEQ ID NO | Testicle 1 Enrichment |
|---|---|---|
| 42344 | 32341 | 1.247457627 |
| 42345 | 32342 | 1.245833333 |
| 42346 | 32343 | 1.245833333 |
| 42347 | 32344 | 1.245833333 |
| 42348 | 32345 | 1.241089109 |
| 42349 | 32346 | 1.238461538 |
| 42350 | 32347 | 1.238461538 |
| 42351 | 32348 | 1.233333333 |
| 42352 | 32349 | 1.230232558 |
| 42353 | 32350 | 1.229310345 |
| 42354 | 32351 | 1.228767123 |
| 42355 | 32352 | 1.226666667 |
| 42356 | 32353 | 1.223404255 |
| 42357 | 32354 | 1.221875 |
| 42358 | 32355 | 1.220408163 |
| 42359 | 32356 | 1.219 |
| 42360 | 32357 | 1.217647059 |
| 42361 | 32358 | 1.217647059 |
| 42362 | 32359 | 1.217083333 |
| 42363 | 32360 | 1.216346154 |
| 42364 | 32361 | 1.214788732 |
| 42365 | 32362 | 1.213888889 |
| 42366 | 32363 | 1.212403101 |
| 42367 | 32364 | 1.211333333 |
| 42368 | 32365 | 1.210526316 |
| 42369 | 32366 | 1.208474576 |
| 42370 | 32367 | 1.2075 |
| 42371 | 32368 | 1.197916667 |
| 42372 | 32369 | 1.197916667 |

| DNA SEQ ID NO | AA SEQ ID NO | Testicle 1 Enrichment |
|---|---|---|
| 42373 | 32370 | 1.196938776 |
| 42374 | 32371 | 1.196 |
| 42375 | 32372 | 1.195098039 |
| 42376 | 32373 | 1.193396226 |
| 42377 | 32374 | 1.193396226 |
| 42378 | 32375 | 1.192073171 |
| 42379 | 32376 | 1.191071429 |
| 42380 | 32377 | 1.190350877 |
| 42381 | 32378 | 1.189655172 |
| 42382 | 32379 | 1.189655172 |
| 42383 | 32380 | 1.188333333 |
| 42384 | 32381 | 1.1845 |
| 42385 | 32382 | 1.182394366 |
| 42386 | 32383 | 1.181944444 |
| 42387 | 32384 | 1.179113924 |
| 42388 | 32385 | 1.17875 |
| 42389 | 32386 | 1.17804878 |
| 42390 | 32387 | 1.176744186 |
| 42391 | 32388 | 1.173 |
| 42392 | 32389 | 1.168253968 |
| 42393 | 32390 | 1.167424242 |
| 42394 | 32391 | 1.165131579 |
| 42395 | 32392 | 1.163855422 |
| 42396 | 32393 | 1.163690476 |
| 42397 | 32394 | 1.15 |
| 42398 | 32395 | 1.15 |
| 42399 | 32396 | 1.15 |
| 42400 | 32397 | 1.15 |
| 42401 | 32398 | 1.15 |

| DNA SEQ ID NO | AA SEQ ID NO | Testicle 1 Enrichment |
|---|---|---|
| 42402 | 32399 | 1.15 |
| 42403 | 32400 | 1.15 |
| 42404 | 32401 | 1.15 |
| 42405 | 32402 | 1.15 |
| 42406 | 32403 | 1.15 |
| 42407 | 32404 | 1.15 |
| 42408 | 32405 | 1.15 |
| 42409 | 32406 | 1.15 |
| 42410 | 32407 | 1.15 |
| 42411 | 32408 | 1.15 |
| 42412 | 32409 | 1.15 |
| 42413 | 32410 | 1.15 |
| 42414 | 32411 | 1.15 |
| 42415 | 32412 | 1.14222973 |
| 42416 | 32413 | 1.140944882 |
| 42417 | 32414 | 1.137894737 |
| 42418 | 32415 | 1.136470588 |
| 42419 | 32416 | 1.135802469 |
| 42420 | 32417 | 1.135064935 |
| 42421 | 32418 | 1.134459459 |
| 42422 | 32419 | 1.131451613 |
| 42423 | 32420 | 1.130833333 |
| 42424 | 32421 | 1.129464286 |
| 42425 | 32422 | 1.128504673 |
| 42426 | 32423 | 1.125789474 |
| 42427 | 32424 | 1.125531915 |
| 42428 | 32425 | 1.124157303 |
| 42429 | 32426 | 1.122177419 |
| 42430 | 32427 | 1.12125 |

| DNA SEQ ID NO | AA SEQ ID NO | Testicle 1 Enrichment |
|---|---|---|
| 42431 | 32428 | 1.119736842 |
| 42432 | 32429 | 1.119736842 |
| 42433 | 32430 | 1.117142857 |
| 42434 | 32431 | 1.115671642 |
| 42435 | 32432 | 1.115671642 |
| 42436 | 32433 | 1.1140625 |
| 42437 | 32434 | 1.1140625 |
| 42438 | 32435 | 1.112903226 |
| 42439 | 32436 | 1.111666667 |
| 42440 | 32437 | 1.111666667 |
| 42441 | 32438 | 1.111666667 |
| 42442 | 32439 | 1.111666667 |
| 42443 | 32440 | 1.111666667 |
| 42444 | 32441 | 1.108928571 |
| 42445 | 32442 | 1.108928571 |
| 42446 | 32443 | 1.106329114 |
| 42447 | 32444 | 1.106329114 |
| 42448 | 32445 | 1.105769231 |
| 42449 | 32446 | 1.105769231 |
| 42450 | 32447 | 1.104901961 |
| 42451 | 32448 | 1.102083333 |
| 42452 | 32449 | 1.102083333 |
| 42453 | 32450 | 1.1 |
| 42454 | 32451 | 1.1 |
| 42455 | 32452 | 1.1 |
| 42456 | 32453 | 1.098888889 |
| 42457 | 32454 | 1.097727273 |
| 42458 | 32455 | 1.097727273 |
| 42459 | 32456 | 1.096511628 |

| DNA SEQ ID NO | AA SEQ ID NO | Testicle 1 Enrichment |
|---|---|---|
| 42460 | 32457 | 1.095238095 |
| 42461 | 32458 | 1.095238095 |
| 42462 | 32459 | 1.094354839 |
| 42463 | 32460 | 1.0925 |
| 42464 | 32461 | 1.0925 |
| 42465 | 32462 | 1.090610329 |
| 42466 | 32463 | 1.089473684 |
| 42467 | 32464 | 1.088392857 |
| 42468 | 32465 | 1.088392857 |
| 42469 | 32466 | 1.086111111 |
| 42470 | 32467 | 1.086111111 |
| 42471 | 32468 | 1.085211268 |
| 42472 | 32469 | 1.084285714 |
| 42473 | 32470 | 1.08030303 |
| 42474 | 32471 | 1.078125 |
| 42475 | 32472 | 1.076595745 |
| 42476 | 32473 | 1.075 |
| 42477 | 32474 | 1.074590164 |
| 42478 | 32475 | 1.073333333 |
| 42479 | 32476 | 1.071590909 |
| 42480 | 32477 | 1.070689655 |
| 42481 | 32478 | 1.070689655 |
| 42482 | 32479 | 1.067857143 |
| 42483 | 32480 | 1.066363636 |
| 42484 | 32481 | 1.066145833 |
| 42485 | 32482 | 1.061538462 |
| 42486 | 32483 | 1.061538462 |
| 42487 | 32484 | 1.059803922 |
| 42488 | 32485 | 1.058730159 |

FIG. 12 (Cont.)

| DNA SEQ ID NO | AA SEQ ID NO | Testicle 1 Enrichment |
|---|---|---|
| 42489 | 32486 | 1.058730159 |
| 42490 | 32487 | 1.056122449 |
| 42491 | 32488 | 1.055294118 |
| 42492 | 32489 | 1.054166667 |
| 42493 | 32490 | 1.054166667 |
| 42494 | 32491 | 1.054166667 |
| 42495 | 32492 | 1.050393701 |
| 42496 | 32493 | 1.05 |
| 42497 | 32494 | 1.047321429 |
| 42498 | 32495 | 1.046794872 |
| 42499 | 32496 | 1.045454545 |

| DNA SEQ ID NO | AA SEQ ID NO | Testicle 1 Enrichment |
|---|---|---|
| 42500 | 32497 | 1.043846154 |
| 42501 | 32498 | 1.043518519 |
| 42502 | 32499 | 1.043023256 |
| 42503 | 32500 | 1.0421875 |
| 42504 | 32501 | 1.04047619 |
| 42505 | 32502 | 1.038709677 |
| 42506 | 32503 | 1.037804878 |
| 42507 | 32504 | 1.037254902 |
| 42508 | 32505 | 1.037254902 |
| 42509 | 32506 | 1.035 |
| 42510 | 32507 | 1.035 |

| DNA SEQ ID NO | AA SEQ ID NO | Testicle 1 Enrichment |
|---|---|---|
| 42511 | 32508 | 1.035 |
| 42512 | 32509 | 1.030208333 |
| 42513 | 32510 | 1.029651163 |
| 42514 | 32511 | 1.028947368 |
| 42515 | 32512 | 1.026344086 |
| 42516 | 32513 | 1.025 |
| 42517 | 32514 | 1.022222222 |
| 42518 | 32515 | 1.018571429 |
| 42519 | 32516 | 1.018032787 |
| 42520 | 32517 | 1.014705882 |
| 42521 | 32518 | 1.014705882 |

| DNA SEQ ID NO | AA SEQ ID NO | Testicle 1 Enrichment |
|---|---|---|
| 42522 | 32519 | 1.014705882 |
| 42523 | 32520 | 1.012393162 |
| 42524 | 32521 | 1.012 |
| 42525 | 32522 | 1.011445783 |
| 42526 | 32523 | 1.010606061 |
| 42527 | 32524 | 1.010606061 |
| 42528 | 32525 | 1.009183673 |
| 42529 | 32526 | 1.008461538 |
| 42530 | 32527 | 1.00625 |
| 42531 | 32528 | 1.00625 |
| 42532 | 32529 | 1.00625 |

| DNA SEQ ID NO | AA SEQ ID NO | Testicle 1 Enrichment |
|---|---|---|
| 42533 | 32530 | 1.00625 |
| 42534 | 32531 | 1.00625 |
| 42535 | 32532 | 1.003636364 |
| 42536 | 32533 | 1.003636364 |
| 42537 | 32534 | 1.003191489 |
| 42538 | 32535 | 1.002564103 |
| 42539 | 32536 | 1.002564103 |

FIG. 13

| DNA SEQ ID NO | AA SEQ ID NO | Lung 1 Enrichment |
|---|---|---|
| 42540 | 32537 | 34.5 |
| 42541 | 32538 | 29.30482456 |
| 42542 | 32539 | 11.5 |
| 42543 | 32540 | 8.116346154 |
| 42544 | 32541 | 7.1875 |
| 42545 | 32542 | 7.1875 |
| 42546 | 32543 | 7.027777778 |
| 42547 | 32544 | 6.160714286 |
| 42548 | 32545 | 5.869791667 |
| 42549 | 32546 | 5.75 |
| 42550 | 32547 | 5.75 |
| 42551 | 32548 | 5.75 |
| 42552 | 32549 | 5.75 |
| 42553 | 32550 | 5.175 |
| 42554 | 32551 | 5.105457227 |
| 42555 | 32552 | 5.03125 |
| 42556 | 32553 | 4.644230769 |
| 42557 | 32554 | 4.6 |
| 42558 | 32555 | 4.6 |
| 42559 | 32556 | 4.6 |
| 42560 | 32557 | 4.3125 |
| 42561 | 32558 | 4.3125 |
| 42562 | 32559 | 4.3125 |
| 42563 | 32560 | 4.3125 |
| 42564 | 32561 | 4.3125 |
| 42565 | 32562 | 4.3125 |
| 42566 | 32563 | 4.3125 |

| DNA SEQ ID NO | AA SEQ ID NO | Lung 1 Enrichment |
|---|---|---|
| 42567 | 32564 | 4.3125 |
| 42568 | 32565 | 4.216666667 |
| 42569 | 32566 | 4.212209302 |
| 42570 | 32567 | 4.201923077 |
| 42571 | 32568 | 4.181818182 |
| 42572 | 32569 | 4.107142857 |
| 42573 | 32570 | 4.046296296 |
| 42574 | 32571 | 4.004464286 |
| 42575 | 32572 | 3.953125 |
| 42576 | 32573 | 3.920454545 |
| 42577 | 32574 | 3.901785714 |
| 42578 | 32575 | 3.833333333 |
| 42579 | 32576 | 3.833333333 |
| 42580 | 32577 | 3.833333333 |
| 42581 | 32578 | 3.833333333 |
| 42582 | 32579 | 3.833333333 |
| 42583 | 32580 | 3.833333333 |
| 42584 | 32581 | 3.833333333 |
| 42585 | 32582 | 3.77734375 |
| 42586 | 32583 | 3.75 |
| 42587 | 32584 | 3.696428571 |
| 42588 | 32585 | 3.690909091 |
| 42589 | 32586 | 3.59375 |
| 42590 | 32587 | 3.59375 |
| 42591 | 32588 | 3.463068182 |
| 42592 | 32589 | 3.45 |
| 42593 | 32590 | 3.45 |

| DNA SEQ ID NO | AA SEQ ID NO | Lung 1 Enrichment |
|---|---|---|
| 42594 | 32591 | 3.397727273 |
| 42595 | 32592 | 3.367857143 |
| 42596 | 32593 | 3.285714286 |
| 42597 | 32594 | 3.285714286 |
| 42598 | 32595 | 3.234375 |
| 42599 | 32596 | 3.234375 |
| 42600 | 32597 | 3.234375 |
| 42601 | 32598 | 3.213235294 |
| 42602 | 32599 | 3.148809524 |
| 42603 | 32600 | 3.128676471 |
| 42604 | 32601 | 3.121428571 |
| 42605 | 32602 | 3.114583333 |
| 42606 | 32603 | 3.114583333 |
| 42607 | 32604 | 3.114583333 |
| 42608 | 32605 | 3.096153846 |
| 42609 | 32606 | 3.080357143 |
| 42610 | 32607 | 3.034722222 |
| 42611 | 32608 | 3.01875 |
| 42612 | 32609 | 2.981481481 |
| 42613 | 32610 | 2.9325 |
| 42614 | 32611 | 2.924568966 |
| 42615 | 32612 | 2.875 |
| 42616 | 32613 | 2.875 |
| 42617 | 32614 | 2.875 |
| 42618 | 32615 | 2.875 |
| 42619 | 32616 | 2.875 |
| 42620 | 32617 | 2.875 |

| DNA SEQ ID NO | AA SEQ ID NO | Lung 1 Enrichment |
|---|---|---|
| 42621 | 32618 | 2.875 |
| 42622 | 32619 | 2.875 |
| 42623 | 32620 | 2.875 |
| 42624 | 32621 | 2.875 |
| 42625 | 32622 | 2.875 |
| 42626 | 32623 | 2.875 |
| 42627 | 32624 | 2.875 |
| 42628 | 32625 | 2.875 |
| 42629 | 32626 | 2.875 |
| 42630 | 32627 | 2.875 |
| 42631 | 32628 | 2.826271186 |
| 42632 | 32629 | 2.815721649 |
| 42633 | 32630 | 2.78515625 |
| 42634 | 32631 | 2.764423077 |
| 42635 | 32632 | 2.75 |
| 42636 | 32633 | 2.75 |
| 42637 | 32634 | 2.75 |
| 42638 | 32635 | 2.738095238 |
| 42639 | 32636 | 2.738095238 |
| 42640 | 32637 | 2.738095238 |
| 42641 | 32638 | 2.738095238 |
| 42642 | 32639 | 2.731125 |
| 42643 | 32640 | 2.719594595 |
| 42644 | 32641 | 2.715277778 |
| 42645 | 32642 | 2.6875 |
| 42646 | 32643 | 2.683333333 |
| 42647 | 32644 | 2.683333333 |

| DNA SEQ ID NO | AA SEQ ID NO | Lung 1 Enrichment |
|---|---|---|
| 42648 | 32645 | 2.678977273 |
| 42649 | 32646 | 2.674418605 |
| 42650 | 32647 | 2.669642857 |
| 42651 | 32648 | 2.669642857 |
| 42652 | 32649 | 2.653846154 |
| 42653 | 32650 | 2.653846154 |
| 42654 | 32651 | 2.645 |
| 42655 | 32652 | 2.625 |
| 42656 | 32653 | 2.625 |
| 42657 | 32654 | 2.613636364 |
| 42658 | 32655 | 2.613636364 |
| 42659 | 32656 | 2.613636364 |
| 42660 | 32657 | 2.60755814 |
| 42661 | 32658 | 2.5875 |
| 42662 | 32659 | 2.577586207 |
| 42663 | 32660 | 2.577586207 |
| 42664 | 32661 | 2.569148936 |
| 42665 | 32662 | 2.566964286 |
| 42666 | 32663 | 2.55875 |
| 42667 | 32664 | 2.555555556 |
| 42668 | 32665 | 2.555555556 |
| 42669 | 32666 | 2.555555556 |
| 42670 | 32667 | 2.536764706 |
| 42671 | 32668 | 2.53 |
| 42672 | 32669 | 2.515625 |
| 42673 | 32670 | 2.507978723 |
| 42674 | 32671 | 2.5 |

FIG. 13 (Cont.)

| DNA SEQ ID NO | AA SEQ ID NO | Lung 1 Enrichment |
|---|---|---|
| 42675 | 32672 | 2.491666667 |
| 42676 | 32673 | 2.491666667 |
| 42677 | 32674 | 2.464285714 |
| 42678 | 32675 | 2.456818182 |
| 42679 | 32676 | 2.452205882 |
| 42680 | 32677 | 2.432692308 |
| 42681 | 32678 | 2.418650794 |
| 42682 | 32679 | 2.413580247 |
| 42683 | 32680 | 2.395833333 |
| 42684 | 32681 | 2.395833333 |
| 42685 | 32682 | 2.395833333 |
| 42686 | 32683 | 2.395833333 |
| 42687 | 32684 | 2.395833333 |
| 42688 | 32685 | 2.395833333 |
| 42689 | 32686 | 2.395833333 |
| 42690 | 32687 | 2.395833333 |
| 42691 | 32688 | 2.381313131 |
| 42692 | 32689 | 2.367647059 |
| 42693 | 32690 | 2.367647059 |
| 42694 | 32691 | 2.367647059 |
| 42695 | 32692 | 2.367647059 |
| 42696 | 32693 | 2.358974359 |
| 42697 | 32694 | 2.3359375 |
| 42698 | 32695 | 2.3359375 |
| 42699 | 32696 | 2.322115385 |
| 42700 | 32697 | 2.3 |
| 42701 | 32698 | 2.3 |
| 42702 | 32699 | 2.3 |
| 42703 | 32700 | 2.3 |
| 42704 | 32701 | 2.3 |
| 42705 | 32702 | 2.3 |
| 42706 | 32703 | 2.3 |
| 42707 | 32704 | 2.3 |
| 42708 | 32705 | 2.3 |
| 42709 | 32706 | 2.290254237 |
| 42710 | 32707 | 2.28525641 |
| 42711 | 32708 | 2.280172414 |
| 42712 | 32709 | 2.280172414 |
| 42713 | 32710 | 2.280172414 |
| 42714 | 32711 | 2.269736842 |
| 42715 | 32712 | 2.265151515 |
| 42716 | 32713 | 2.261666667 |
| 42717 | 32714 | 2.258928571 |
| 42718 | 32715 | 2.258928571 |
| 42719 | 32716 | 2.258928571 |
| 42720 | 32717 | 2.24609375 |
| 42721 | 32718 | 2.239182692 |
| 42722 | 32719 | 2.236111111 |
| 42723 | 32720 | 2.236111111 |
| 42724 | 32721 | 2.231343284 |
| 42725 | 32722 | 2.229591837 |
| 42726 | 32723 | 2.228125 |
| 42727 | 32724 | 2.225806452 |
| 42728 | 32725 | 2.224056604 |
| 42729 | 32726 | 2.211538462 |
| 42730 | 32727 | 2.211538462 |
| 42731 | 32728 | 2.20212766 |
| 42732 | 32729 | 2.200617284 |
| 42733 | 32730 | 2.198529412 |
| 42734 | 32731 | 2.198529412 |
| 42735 | 32732 | 2.19047619 |
| 42736 | 32733 | 2.185 |
| 42737 | 32734 | 2.185 |
| 42738 | 32735 | 2.181034483 |
| 42739 | 32736 | 2.178030303 |
| 42740 | 32737 | 2.170918367 |
| 42741 | 32738 | 2.15625 |
| 42742 | 32739 | 2.15625 |
| 42743 | 32740 | 2.15625 |
| 42744 | 32741 | 2.15625 |
| 42745 | 32742 | 2.15625 |
| 42746 | 32743 | 2.15625 |
| 42747 | 32744 | 2.15625 |
| 42748 | 32745 | 2.15625 |
| 42749 | 32746 | 2.15625 |
| 42750 | 32747 | 2.15625 |
| 42751 | 32748 | 2.15625 |
| 42752 | 32749 | 2.15625 |
| 42753 | 32750 | 2.15625 |
| 42754 | 32751 | 2.15625 |
| 42755 | 32752 | 2.143181818 |
| 42756 | 32753 | 2.140957447 |
| 42757 | 32754 | 2.140957447 |
| 42758 | 32755 | 2.140510949 |
| 42759 | 32756 | 2.137820513 |
| 42760 | 32757 | 2.135714286 |
| 42761 | 32758 | 2.12962963 |
| 42762 | 32759 | 2.125 |
| 42763 | 32760 | 2.125 |
| 42764 | 32761 | 2.118421053 |
| 42765 | 32762 | 2.118421053 |
| 42766 | 32763 | 2.118421053 |
| 42767 | 32764 | 2.113970588 |
| 42768 | 32765 | 2.112244898 |
| 42769 | 32766 | 2.108333333 |
| 42770 | 32767 | 2.100961538 |
| 42771 | 32768 | 2.097972973 |
| 42772 | 32769 | 2.090909091 |
| 42773 | 32770 | 2.090909091 |
| 42774 | 32771 | 2.090909091 |
| 42775 | 32772 | 2.090909091 |
| 42776 | 32773 | 2.079787234 |
| 42777 | 32774 | 2.061320755 |
| 42778 | 32775 | 2.060416667 |
| 42779 | 32776 | 2.053571429 |
| 42780 | 32777 | 2.053571429 |
| 42781 | 32778 | 2.053571429 |
| 42782 | 32779 | 2.053571429 |
| 42783 | 32780 | 2.053571429 |
| 42784 | 32781 | 2.053571429 |
| 42785 | 32782 | 2.053571429 |
| 42786 | 32783 | 2.053571429 |
| 42787 | 32784 | 2.053571429 |
| 42788 | 32785 | 2.0484375 |
| 42789 | 32786 | 2.029411765 |
| 42790 | 32787 | 2.029411765 |
| 42791 | 32788 | 2.029411765 |
| 42792 | 32789 | 2.026639344 |
| 42793 | 32790 | 2.019345238 |
| 42794 | 32791 | 2.018617021 |
| 42795 | 32792 | 2.016791045 |
| 42796 | 32793 | 2.0125 |
| 42797 | 32794 | 2.0125 |
| 42798 | 32795 | 2.0125 |
| 42799 | 32796 | 2.007936508 |
| 42800 | 32797 | 2.003787879 |
| 42801 | 32798 | 2.001 |
| 42802 | 32799 | 2 |
| 42803 | 32800 | 2 |
| 42804 | 32801 | 1.986363636 |
| 42805 | 32802 | 1.982758621 |
| 42806 | 32803 | 1.982758621 |
| 42807 | 32804 | 1.981418919 |
| 42808 | 32805 | 1.980555556 |
| 42809 | 32806 | 1.971428571 |
| 42810 | 32807 | 1.967105263 |
| 42811 | 32808 | 1.960227273 |
| 42812 | 32809 | 1.957446809 |
| 42813 | 32810 | 1.956932773 |
| 42814 | 32811 | 1.955 |
| 42815 | 32812 | 1.953525641 |
| 42816 | 32813 | 1.950892857 |
| 42817 | 32814 | 1.950892857 |
| 42818 | 32815 | 1.947580645 |
| 42819 | 32816 | 1.947580645 |

FIG. 13 (Cont.)

| DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment |
|---|---|---|---|---|---|---|---|---|---|---|---|---|---|---|
| 42820 | 32817 | 1.947580645 | 42849 | 32846 | 1.88671875 | 42878 | 32875 | 1.826822917 | 42907 | 32904 | 1.779761905 | 42936 | 32933 | 1.742424242 |
| 42821 | 32818 | 1.944852941 | 42850 | 32847 | 1.879807692 | 42879 | 32876 | 1.819620253 | 42908 | 32905 | 1.779761905 | 42937 | 32934 | 1.742424242 |
| 42822 | 32819 | 1.940625 | 42851 | 32848 | 1.879807692 | 42880 | 32877 | 1.819335938 | 42909 | 32906 | 1.779761905 | 42938 | 32935 | 1.740131579 |
| 42823 | 32820 | 1.940625 | 42852 | 32849 | 1.879807692 | 42881 | 32878 | 1.817528736 | 42910 | 32907 | 1.777960526 | 42939 | 32936 | 1.740131579 |
| 42824 | 32821 | 1.929276316 | 42853 | 32850 | 1.879807692 | 42882 | 32879 | 1.815789474 | 42911 | 32908 | 1.77393617 | 42940 | 32937 | 1.740131579 |
| 42825 | 32822 | 1.916666667 | 42854 | 32851 | 1.875 | 42883 | 32880 | 1.815789474 | 42912 | 32909 | 1.77393617 | 42941 | 32938 | 1.735849057 |
| 42826 | 32823 | 1.916666667 | 42855 | 32852 | 1.872093023 | 42884 | 32881 | 1.813461538 | 42913 | 32910 | 1.772260274 | 42942 | 32939 | 1.732876712 |
| 42827 | 32824 | 1.916666667 | 42856 | 32853 | 1.871031746 | 42885 | 32882 | 1.81125 | 42914 | 32911 | 1.769230769 | 42943 | 32940 | 1.725 |
| 42828 | 32825 | 1.916666667 | 42857 | 32854 | 1.86875 | 42886 | 32883 | 1.810185185 | 42915 | 32912 | 1.769230769 | 42944 | 32941 | 1.725 |
| 42829 | 32826 | 1.916666667 | 42858 | 32855 | 1.86875 | 42887 | 32884 | 1.810185185 | 42916 | 32913 | 1.769230769 | 42945 | 32942 | 1.725 |
| 42830 | 32827 | 1.916666667 | 42859 | 32856 | 1.86622807 | 42888 | 32885 | 1.810185185 | 42917 | 32914 | 1.769230769 | 42946 | 32943 | 1.725 |
| 42831 | 32828 | 1.916666667 | 42860 | 32857 | 1.863425926 | 42889 | 32886 | 1.810185185 | 42918 | 32915 | 1.769230769 | 42947 | 32944 | 1.725 |
| 42832 | 32829 | 1.916666667 | 42861 | 32858 | 1.860294118 | 42890 | 32887 | 1.810185185 | 42919 | 32916 | 1.766071429 | 42948 | 32945 | 1.725 |
| 42833 | 32830 | 1.916666667 | 42862 | 32859 | 1.860294118 | 42891 | 32888 | 1.807142857 | 42920 | 32917 | 1.766071429 | 42949 | 32946 | 1.725 |
| 42834 | 32831 | 1.916666667 | 42863 | 32860 | 1.860294118 | 42892 | 32889 | 1.805232558 | 42921 | 32918 | 1.762096774 | 42950 | 32947 | 1.725 |
| 42835 | 32832 | 1.916666667 | 42864 | 32861 | 1.85483871 | 42893 | 32890 | 1.805232558 | 42922 | 32919 | 1.760204082 | 42951 | 32948 | 1.725 |
| 42836 | 32833 | 1.916666667 | 42865 | 32862 | 1.852777778 | 42894 | 32891 | 1.796875 | 42923 | 32920 | 1.756944444 | 42952 | 32949 | 1.725 |
| 42837 | 32834 | 1.916666667 | 42866 | 32863 | 1.848214286 | 42895 | 32892 | 1.796875 | 42924 | 32921 | 1.756944444 | 42953 | 32950 | 1.725 |
| 42838 | 32835 | 1.916666667 | 42867 | 32864 | 1.848214286 | 42896 | 32893 | 1.796875 | 42925 | 32922 | 1.75304878 | 42954 | 32951 | 1.713942308 |
| 42839 | 32836 | 1.916666667 | 42868 | 32865 | 1.844339623 | 42897 | 32894 | 1.796875 | 42926 | 32923 | 1.75304878 | 42955 | 32952 | 1.712765957 |
| 42840 | 32837 | 1.916666667 | 42869 | 32866 | 1.844339623 | 42898 | 32895 | 1.796875 | 42927 | 32924 | 1.75304878 | 42956 | 32953 | 1.711309524 |
| 42841 | 32838 | 1.916666667 | 42870 | 32867 | 1.842429577 | 42899 | 32896 | 1.792207792 | 42928 | 32925 | 1.751953125 | 42957 | 32954 | 1.711309524 |
| 42842 | 32839 | 1.916666667 | 42871 | 32868 | 1.84 | 42900 | 32897 | 1.791666667 | 42929 | 32926 | 1.751953125 | 42958 | 32955 | 1.709459459 |
| 42843 | 32840 | 1.916666667 | 42872 | 32869 | 1.832107843 | 42901 | 32898 | 1.790983607 | 42930 | 32927 | 1.75 | 42959 | 32956 | 1.709459459 |
| 42844 | 32841 | 1.903716216 | 42873 | 32870 | 1.829545455 | 42902 | 32899 | 1.79009434 | 42931 | 32928 | 1.75 | 42960 | 32957 | 1.703703704 |
| 42845 | 32842 | 1.899553571 | 42874 | 32871 | 1.829545455 | 42903 | 32900 | 1.788888889 | 42932 | 32929 | 1.748958333 | 42961 | 32958 | 1.703703704 |
| 42846 | 32843 | 1.893292683 | 42875 | 32872 | 1.829545455 | 42904 | 32901 | 1.788888889 | 42933 | 32930 | 1.745535714 | 42962 | 32959 | 1.703703704 |
| 42847 | 32844 | 1.893292683 | 42876 | 32873 | 1.829545455 | 42905 | 32902 | 1.7825 | 42934 | 32931 | 1.743852459 | 42963 | 32960 | 1.701530612 |
| 42848 | 32845 | 1.891447368 | 42877 | 32874 | 1.829545455 | 42906 | 32903 | 1.7825 | 42935 | 32932 | 1.743852459 | 42964 | 32961 | 1.700704225 |

FIG. 13 (Cont.)

| DNA SEQ ID NO | AA SEQ ID NO | Lung1 Enrichment |
|---|---|---|
| 42965 | 32962 | 1.698863636 |
| 42966 | 32963 | 1.698863636 |
| 42967 | 32964 | 1.695512821 |
| 42968 | 32965 | 1.695512821 |
| 42969 | 32966 | 1.695512821 |
| 42970 | 32967 | 1.694736842 |
| 42971 | 32968 | 1.694736842 |
| 42972 | 32969 | 1.694196429 |
| 42973 | 32970 | 1.691176471 |
| 42974 | 32971 | 1.6875 |
| 42975 | 32972 | 1.68595679 |
| 42976 | 32973 | 1.685344828 |
| 42977 | 32974 | 1.682926829 |
| 42978 | 32975 | 1.681603774 |
| 42979 | 32976 | 1.681603774 |
| 42980 | 32977 | 1.680769231 |
| 42981 | 32978 | 1.680769231 |
| 42982 | 32979 | 1.677083333 |
| 42983 | 32980 | 1.677083333 |
| 42984 | 32981 | 1.677083333 |
| 42985 | 32982 | 1.672727273 |
| 42986 | 32983 | 1.671511628 |
| 42987 | 32984 | 1.671511628 |
| 42988 | 32985 | 1.671511628 |
| 42989 | 32986 | 1.669354839 |
| 42990 | 32987 | 1.669354839 |
| 42991 | 32988 | 1.669354839 |
| 42992 | 32989 | 1.664473684 |
| 42993 | 32990 | 1.664473684 |

| DNA SEQ ID NO | AA SEQ ID NO | Lung1 Enrichment |
|---|---|---|
| 42994 | 32991 | 1.660211268 |
| 42995 | 32992 | 1.658653846 |
| 42996 | 32993 | 1.658653846 |
| 42997 | 32994 | 1.657657658 |
| 42998 | 32995 | 1.65530303 |
| 42999 | 32996 | 1.650462963 |
| 43000 | 32997 | 1.650462963 |
| 43001 | 32998 | 1.648333333 |
| 43002 | 32999 | 1.642857143 |
| 43003 | 33000 | 1.642857143 |
| 43004 | 33001 | 1.642857143 |
| 43005 | 33002 | 1.642857143 |
| 43006 | 33003 | 1.642857143 |
| 43007 | 33004 | 1.642857143 |
| 43008 | 33005 | 1.642857143 |
| 43009 | 33006 | 1.642857143 |
| 43010 | 33007 | 1.642857143 |
| 43011 | 33008 | 1.642857143 |
| 43012 | 33009 | 1.642857143 |
| 43013 | 33010 | 1.642857143 |
| 43014 | 33011 | 1.642857143 |
| 43015 | 33012 | 1.635775862 |
| 43016 | 33013 | 1.634803922 |
| 43017 | 33014 | 1.633522727 |
| 43018 | 33015 | 1.626644737 |
| 43019 | 33016 | 1.625 |
| 43020 | 33017 | 1.625 |
| 43021 | 33018 | 1.625 |
| 43022 | 33019 | 1.625 |

| DNA SEQ ID NO | AA SEQ ID NO | Lung1 Enrichment |
|---|---|---|
| 43023 | 33020 | 1.622983871 |
| 43024 | 33021 | 1.622983871 |
| 43025 | 33022 | 1.621794872 |
| 43026 | 33023 | 1.620454545 |
| 43027 | 33024 | 1.6171875 |
| 43028 | 33025 | 1.6171875 |
| 43029 | 33026 | 1.6171875 |
| 43030 | 33027 | 1.6171875 |
| 43031 | 33028 | 1.6171875 |
| 43032 | 33029 | 1.6171875 |
| 43033 | 33030 | 1.612804878 |
| 43034 | 33031 | 1.612804878 |
| 43035 | 33032 | 1.612804878 |
| 43036 | 33033 | 1.61 |
| 43037 | 33034 | 1.608944954 |
| 43038 | 33035 | 1.608050847 |
| 43039 | 33036 | 1.608050847 |
| 43040 | 33037 | 1.606617647 |
| 43041 | 33038 | 1.606617647 |
| 43042 | 33039 | 1.606617647 |
| 43043 | 33040 | 1.606617647 |
| 43044 | 33041 | 1.606617647 |
| 43045 | 33042 | 1.604651163 |
| 43046 | 33043 | 1.604651163 |
| 43047 | 33044 | 1.604651163 |
| 43048 | 33045 | 1.600235849 |
| 43049 | 33046 | 1.597222222 |
| 43050 | 33047 | 1.597222222 |
| 43051 | 33048 | 1.597222222 |

| DNA SEQ ID NO | AA SEQ ID NO | Lung1 Enrichment |
|---|---|---|
| 43052 | 33049 | 1.597222222 |
| 43053 | 33050 | 1.597222222 |
| 43054 | 33051 | 1.597222222 |
| 43055 | 33052 | 1.597222222 |
| 43056 | 33053 | 1.597222222 |
| 43057 | 33054 | 1.597222222 |
| 43058 | 33055 | 1.597222222 |
| 43059 | 33056 | 1.591517857 |
| 43060 | 33057 | 1.590425532 |
| 43061 | 33058 | 1.588815789 |
| 43062 | 33059 | 1.587686567 |
| 43063 | 33060 | 1.586206897 |
| 43064 | 33061 | 1.586206897 |
| 43065 | 33062 | 1.586206897 |
| 43066 | 33063 | 1.584183673 |
| 43067 | 33064 | 1.584183673 |
| 43068 | 33065 | 1.582865169 |
| 43069 | 33066 | 1.58125 |
| 43070 | 33067 | 1.58125 |
| 43071 | 33068 | 1.58125 |
| 43072 | 33069 | 1.58125 |
| 43073 | 33070 | 1.58125 |
| 43074 | 33071 | 1.58125 |
| 43075 | 33072 | 1.578431373 |
| 43076 | 33073 | 1.576612903 |
| 43077 | 33074 | 1.574404762 |
| 43078 | 33075 | 1.574404762 |
| 43079 | 33076 | 1.573113208 |
| 43080 | 33077 | 1.568181818 |

| DNA SEQ ID NO | AA SEQ ID NO | Lung1 Enrichment |
|---|---|---|
| 43081 | 33078 | 1.568181818 |
| 43082 | 33079 | 1.568181818 |
| 43083 | 33080 | 1.568181818 |
| 43084 | 33081 | 1.568181818 |
| 43085 | 33082 | 1.568181818 |
| 43086 | 33083 | 1.568181818 |
| 43087 | 33084 | 1.568181818 |
| 43088 | 33085 | 1.568181818 |
| 43089 | 33086 | 1.568181818 |
| 43090 | 33087 | 1.564338235 |
| 43091 | 33088 | 1.564338235 |
| 43092 | 33089 | 1.563596491 |
| 43093 | 33090 | 1.560714286 |
| 43094 | 33091 | 1.55873494 |
| 43095 | 33092 | 1.557291667 |
| 43096 | 33093 | 1.557291667 |
| 43097 | 33094 | 1.555327869 |
| 43098 | 33095 | 1.554054054 |
| 43099 | 33096 | 1.5525 |
| 43100 | 33097 | 1.5525 |
| 43101 | 33098 | 1.550986842 |
| 43102 | 33099 | 1.548076923 |
| 43103 | 33100 | 1.548076923 |
| 43104 | 33101 | 1.548076923 |
| 43105 | 33102 | 1.548076923 |
| 43106 | 33103 | 1.548076923 |
| 43107 | 33104 | 1.548076923 |
| 43108 | 33105 | 1.548076923 |
| 43109 | 33106 | 1.548076923 |

FIG. 13 (Cont.)

| DNA SEQ ID NO | AA SEQ ID NO | Lung 1 Enrichment |
|---|---|---|
| 43110 | 33107 | 1.548076923 |
| 43111 | 33108 | 1.548076923 |
| 43112 | 33109 | 1.5453125 |
| 43113 | 33110 | 1.543981481 |
| 43114 | 33111 | 1.542682927 |
| 43115 | 33112 | 1.542682927 |
| 43116 | 33113 | 1.542682927 |
| 43117 | 33114 | 1.542682927 |
| 43118 | 33115 | 1.541666667 |
| 43119 | 33116 | 1.541666667 |
| 43120 | 33117 | 1.540178571 |
| 43121 | 33118 | 1.540178571 |
| 43122 | 33119 | 1.540178571 |
| 43123 | 33120 | 1.540178571 |
| 43124 | 33121 | 1.538732394 |
| 43125 | 33122 | 1.537790698 |
| 43126 | 33123 | 1.537790698 |
| 43127 | 33124 | 1.536637931 |
| 43128 | 33125 | 1.536637931 |
| 43129 | 33126 | 1.533333333 |
| 43130 | 33127 | 1.533333333 |
| 43131 | 33128 | 1.533333333 |
| 43132 | 33129 | 1.533333333 |
| 43133 | 33130 | 1.529255319 |
| 43134 | 33131 | 1.52734375 |
| 43135 | 33132 | 1.526548673 |
| 43136 | 33133 | 1.526548673 |
| 43137 | 33134 | 1.523065476 |
| 43138 | 33135 | 1.522058824 |

| DNA SEQ ID NO | AA SEQ ID NO | Lung 1 Enrichment |
|---|---|---|
| 43139 | 33136 | 1.522058824 |
| 43140 | 33137 | 1.522058824 |
| 43141 | 33138 | 1.522058824 |
| 43142 | 33139 | 1.519642857 |
| 43143 | 33140 | 1.518867925 |
| 43144 | 33141 | 1.518867925 |
| 43145 | 33142 | 1.518867925 |
| 43146 | 33143 | 1.517361111 |
| 43147 | 33144 | 1.517361111 |
| 43148 | 33145 | 1.515909091 |
| 43149 | 33146 | 1.513157895 |
| 43150 | 33147 | 1.513157895 |
| 43151 | 33148 | 1.513157895 |
| 43152 | 33149 | 1.513157895 |
| 43153 | 33150 | 1.513157895 |
| 43154 | 33151 | 1.513157895 |
| 43155 | 33152 | 1.51059322 |
| 43156 | 33153 | 1.509375 |
| 43157 | 33154 | 1.509375 |
| 43158 | 33155 | 1.508196721 |
| 43159 | 33156 | 1.505952381 |
| 43160 | 33157 | 1.505952381 |
| 43161 | 33158 | 1.505952381 |
| 43162 | 33159 | 1.502840909 |
| 43163 | 33160 | 1.501865672 |
| 43164 | 33161 | 1.501865672 |
| 43165 | 33162 | 1.5 |
| 43166 | 33163 | 1.5 |
| 43167 | 33164 | 1.5 |

| DNA SEQ ID NO | AA SEQ ID NO | Lung 1 Enrichment |
|---|---|---|
| 43168 | 33165 | 1.5 |
| 43169 | 33166 | 1.5 |
| 43170 | 33167 | 1.496173469 |
| 43171 | 33168 | 1.495 |
| 43172 | 33169 | 1.495 |
| 43173 | 33170 | 1.493506494 |
| 43174 | 33171 | 1.490740741 |
| 43175 | 33172 | 1.490740741 |
| 43176 | 33173 | 1.490740741 |
| 43177 | 33174 | 1.490740741 |
| 43178 | 33175 | 1.490740741 |
| 43179 | 33176 | 1.487068966 |
| 43180 | 33177 | 1.487068966 |
| 43181 | 33178 | 1.485416667 |
| 43182 | 33179 | 1.485416667 |
| 43183 | 33180 | 1.483870968 |
| 43184 | 33181 | 1.483870968 |
| 43185 | 33182 | 1.483870968 |
| 43186 | 33183 | 1.483870968 |
| 43187 | 33184 | 1.483870968 |
| 43188 | 33185 | 1.482421875 |
| 43189 | 33186 | 1.481060606 |
| 43190 | 33187 | 1.481060606 |
| 43191 | 33188 | 1.478571429 |
| 43192 | 33189 | 1.478571429 |
| 43193 | 33190 | 1.478571429 |
| 43194 | 33191 | 1.476351351 |
| 43195 | 33192 | 1.476351351 |
| 43196 | 33193 | 1.474358974 |

| DNA SEQ ID NO | AA SEQ ID NO | Lung 1 Enrichment |
|---|---|---|
| 43197 | 33194 | 1.472560976 |
| 43198 | 33195 | 1.472560976 |
| 43199 | 33196 | 1.470930233 |
| 43200 | 33197 | 1.470930233 |
| 43201 | 33198 | 1.466836735 |
| 43202 | 33199 | 1.466836735 |
| 43203 | 33200 | 1.464622642 |
| 43204 | 33201 | 1.464622642 |
| 43205 | 33202 | 1.464622642 |
| 43206 | 33203 | 1.462719298 |
| 43207 | 33204 | 1.461864407 |
| 43208 | 33205 | 1.459615385 |
| 43209 | 33206 | 1.459615385 |
| 43210 | 33207 | 1.458955224 |
| 43211 | 33208 | 1.458333333 |
| 43212 | 33209 | 1.458333333 |
| 43213 | 33210 | 1.458333333 |
| 43214 | 33211 | 1.458333333 |
| 43215 | 33212 | 1.457746479 |
| 43216 | 33213 | 1.457746479 |
| 43217 | 33214 | 1.457191781 |
| 43218 | 33215 | 1.456168831 |
| 43219 | 33216 | 1.44527027 |
| 43220 | 33217 | 1.4375 |
| 43221 | 33218 | 1.4375 |
| 43222 | 33219 | 1.4375 |
| 43223 | 33220 | 1.4375 |
| 43224 | 33221 | 1.4375 |
| 43225 | 33222 | 1.4375 |

| DNA SEQ ID NO | AA SEQ ID NO | Lung 1 Enrichment |
|---|---|---|
| 43226 | 33223 | 1.4375 |
| 43227 | 33224 | 1.4375 |
| 43228 | 33225 | 1.4375 |
| 43229 | 33226 | 1.4375 |
| 43230 | 33227 | 1.4375 |
| 43231 | 33228 | 1.4375 |
| 43232 | 33229 | 1.4375 |
| 43233 | 33230 | 1.4375 |
| 43234 | 33231 | 1.4375 |
| 43235 | 33232 | 1.4375 |
| 43236 | 33233 | 1.4375 |
| 43237 | 33234 | 1.4375 |
| 43238 | 33235 | 1.4375 |
| 43239 | 33236 | 1.4375 |
| 43240 | 33237 | 1.4375 |
| 43241 | 33238 | 1.4375 |
| 43242 | 33239 | 1.4375 |
| 43243 | 33240 | 1.4375 |
| 43244 | 33241 | 1.4375 |
| 43245 | 33242 | 1.4375 |
| 43246 | 33243 | 1.4375 |
| 43247 | 33244 | 1.4375 |
| 43248 | 33245 | 1.4375 |
| 43249 | 33246 | 1.4375 |
| 43250 | 33247 | 1.4375 |
| 43251 | 33248 | 1.4375 |
| 43252 | 33249 | 1.4375 |
| 43253 | 33250 | 1.4375 |
| 43254 | 33251 | 1.4375 |

FIG. 13 (Cont.)

| DNA SEQ ID NO | AA SEQ ID NO | Lung 1 Enrichment |
|---|---|---|
| 43255 | 33252 | 1.4375 |
| 43256 | 33253 | 1.4375 |
| 43257 | 33254 | 1.4375 |
| 43258 | 33255 | 1.4375 |
| 43259 | 33256 | 1.4375 |
| 43260 | 33257 | 1.4375 |
| 43261 | 33258 | 1.4375 |
| 43262 | 33259 | 1.4375 |
| 43263 | 33260 | 1.4375 |
| 43264 | 33261 | 1.4375 |
| 43265 | 33262 | 1.4375 |
| 43266 | 33263 | 1.4375 |
| 43267 | 33264 | 1.4375 |
| 43268 | 33265 | 1.4375 |
| 43269 | 33266 | 1.4375 |
| 43270 | 33267 | 1.4375 |
| 43271 | 33268 | 1.4375 |
| 43272 | 33269 | 1.4375 |
| 43273 | 33270 | 1.4375 |
| 43274 | 33271 | 1.4375 |
| 43275 | 33272 | 1.4375 |
| 43276 | 33273 | 1.4375 |
| 43277 | 33274 | 1.4375 |
| 43278 | 33275 | 1.425 |
| 43279 | 33276 | 1.423809524 |
| 43280 | 33277 | 1.422043011 |
| 43281 | 33278 | 1.422043011 |
| 43282 | 33279 | 1.421348315 |
| 43283 | 33280 | 1.420977011 |

| DNA SEQ ID NO | AA SEQ ID NO | Lung 1 Enrichment |
|---|---|---|
| 43284 | 33281 | 1.420180723 |
| 43285 | 33282 | 1.418831169 |
| 43286 | 33283 | 1.416044776 |
| 43287 | 33284 | 1.415384615 |
| 43288 | 33285 | 1.413934426 |
| 43289 | 33286 | 1.413541667 |
| 43290 | 33287 | 1.413135593 |
| 43291 | 33288 | 1.411363636 |
| 43292 | 33289 | 1.410377358 |
| 43293 | 33290 | 1.410377358 |
| 43294 | 33291 | 1.408163265 |
| 43295 | 33292 | 1.408163265 |
| 43296 | 33293 | 1.408163265 |
| 43297 | 33294 | 1.406914894 |
| 43298 | 33295 | 1.404829545 |
| 43299 | 33296 | 1.404069767 |
| 43300 | 33297 | 1.404069767 |
| 43301 | 33298 | 1.404069767 |
| 43302 | 33299 | 1.404069767 |
| 43303 | 33300 | 1.402439024 |
| 43304 | 33301 | 1.4015625 |
| 43305 | 33302 | 1.401260504 |
| 43306 | 33303 | 1.400641026 |
| 43307 | 33304 | 1.400641026 |
| 43308 | 33305 | 1.399671053 |
| 43309 | 33306 | 1.398648649 |
| 43310 | 33307 | 1.398648649 |
| 43311 | 33308 | 1.398648649 |
| 43312 | 33309 | 1.396428571 |

| DNA SEQ ID NO | AA SEQ ID NO | Lung 1 Enrichment |
|---|---|---|
| 43313 | 33310 | 1.396428571 |
| 43314 | 33311 | 1.396428571 |
| 43315 | 33312 | 1.396428571 |
| 43316 | 33313 | 1.396428571 |
| 43317 | 33314 | 1.39480198 |
| 43318 | 33315 | 1.394589552 |
| 43319 | 33316 | 1.393041237 |
| 43320 | 33317 | 1.391129032 |
| 43321 | 33318 | 1.389583333 |
| 43322 | 33319 | 1.389583333 |
| 43323 | 33320 | 1.387931034 |
| 43324 | 33321 | 1.387931034 |
| 43325 | 33322 | 1.387931034 |
| 43326 | 33323 | 1.387931034 |
| 43327 | 33324 | 1.387931034 |
| 43328 | 33325 | 1.386764706 |
| 43329 | 33326 | 1.386764706 |
| 43330 | 33327 | 1.384259259 |
| 43331 | 33328 | 1.382211538 |
| 43332 | 33329 | 1.381127451 |
| 43333 | 33330 | 1.38 |
| 43334 | 33331 | 1.38 |
| 43335 | 33332 | 1.38 |
| 43336 | 33333 | 1.377604167 |
| 43337 | 33334 | 1.377604167 |
| 43338 | 33335 | 1.377604167 |
| 43339 | 33336 | 1.376760563 |
| 43340 | 33337 | 1.375 |
| 43341 | 33338 | 1.375 |

| DNA SEQ ID NO | AA SEQ ID NO | Lung 1 Enrichment |
|---|---|---|
| 43342 | 33339 | 1.375 |
| 43343 | 33340 | 1.373134328 |
| 43344 | 33341 | 1.372747748 |
| 43345 | 33342 | 1.372159091 |
| 43346 | 33343 | 1.372159091 |
| 43347 | 33344 | 1.372159091 |
| 43348 | 33345 | 1.371153846 |
| 43349 | 33346 | 1.371153846 |
| 43350 | 33347 | 1.369047619 |
| 43351 | 33348 | 1.369047619 |
| 43352 | 33349 | 1.369047619 |
| 43353 | 33350 | 1.369047619 |
| 43354 | 33351 | 1.369047619 |
| 43355 | 33352 | 1.369047619 |
| 43356 | 33353 | 1.369047619 |
| 43357 | 33354 | 1.369047619 |
| 43358 | 33355 | 1.369047619 |
| 43359 | 33356 | 1.366803279 |
| 43360 | 33357 | 1.36489899 |
| 43361 | 33358 | 1.36440678 |
| 43362 | 33359 | 1.363782051 |
| 43363 | 33360 | 1.363782051 |
| 43364 | 33361 | 1.362962963 |
| 43365 | 33362 | 1.361842105 |
| 43366 | 33363 | 1.361842105 |
| 43367 | 33364 | 1.361842105 |
| 43368 | 33365 | 1.361842105 |
| 43369 | 33366 | 1.359496124 |
| 43370 | 33367 | 1.359090909 |

| DNA SEQ ID NO | AA SEQ ID NO | Lung 1 Enrichment |
|---|---|---|
| 43371 | 33368 | 1.358516484 |
| 43372 | 33369 | 1.357638889 |
| 43373 | 33370 | 1.357638889 |
| 43374 | 33371 | 1.357638889 |
| 43375 | 33372 | 1.357638889 |
| 43376 | 33373 | 1.357638889 |
| 43377 | 33374 | 1.356741573 |
| 43378 | 33375 | 1.356132075 |
| 43379 | 33376 | 1.356132075 |
| 43380 | 33377 | 1.352941176 |
| 43381 | 33378 | 1.352941176 |
| 43382 | 33379 | 1.352941176 |
| 43383 | 33380 | 1.352941176 |
| 43384 | 33381 | 1.352941176 |
| 43385 | 33382 | 1.352941176 |
| 43386 | 33383 | 1.352941176 |
| 43387 | 33384 | 1.352941176 |
| 43388 | 33385 | 1.352941176 |
| 43389 | 33386 | 1.352941176 |
| 43390 | 33387 | 1.352941176 |
| 43391 | 33388 | 1.352941176 |
| 43392 | 33389 | 1.352941176 |
| 43393 | 33390 | 1.352941176 |
| 43394 | 33391 | 1.351092896 |
| 43395 | 33392 | 1.349489796 |
| 43396 | 33393 | 1.348765432 |
| 43397 | 33394 | 1.34765625 |
| 43398 | 33395 | 1.34765625 |
| 43399 | 33396 | 1.34765625 |

FIG. 13 (Cont.)

| DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment |
|---|---|---|---|---|---|---|---|---|---|---|---|---|---|---|
| 43400 | 33397 | 1.345744681 | 43429 | 33426 | 1.328781513 | 43458 | 33455 | 1.317708333 | 43487 | 33484 | 1.29375 | 43516 | 33513 | 1.277777778 |
| 43401 | 33398 | 1.344758065 | 43430 | 33427 | 1.326923077 | 43459 | 33456 | 1.317708333 | 43488 | 33485 | 1.29375 | 43517 | 33514 | 1.277777778 |
| 43402 | 33399 | 1.344758065 | 43431 | 33428 | 1.326923077 | 43460 | 33457 | 1.317708333 | 43489 | 33486 | 1.29375 | 43518 | 33515 | 1.277777778 |
| 43403 | 33400 | 1.344758065 | 43432 | 33429 | 1.326923077 | 43461 | 33458 | 1.317708333 | 43490 | 33487 | 1.29375 | 43519 | 33516 | 1.277777778 |
| 43404 | 33401 | 1.344758065 | 43433 | 33430 | 1.326923077 | 43462 | 33459 | 1.316021127 | 43491 | 33488 | 1.29375 | 43520 | 33517 | 1.274764151 |
| 43405 | 33402 | 1.344758065 | 43434 | 33431 | 1.326923077 | 43463 | 33460 | 1.315677966 | 43492 | 33489 | 1.29375 | 43521 | 33518 | 1.273734177 |
| 43406 | 33403 | 1.344155844 | 43435 | 33432 | 1.326923077 | 43464 | 33461 | 1.313271605 | 43493 | 33490 | 1.29375 | 43522 | 33519 | 1.273734177 |
| 43407 | 33404 | 1.344155844 | 43436 | 33433 | 1.326923077 | 43465 | 33462 | 1.313271605 | 43494 | 33491 | 1.29375 | 43523 | 33520 | 1.273214286 |
| 43408 | 33405 | 1.344155844 | 43437 | 33434 | 1.326923077 | 43466 | 33463 | 1.3125 | 43495 | 33492 | 1.292635659 | 43524 | 33521 | 1.272540984 |
| 43409 | 33406 | 1.344155844 | 43438 | 33435 | 1.326923077 | 43467 | 33464 | 1.310661765 | 43496 | 33493 | 1.292134831 | 43525 | 33522 | 1.272540984 |
| 43410 | 33407 | 1.341666667 | 43439 | 33436 | 1.326923077 | 43468 | 33465 | 1.306818182 | 43497 | 33494 | 1.290816327 | 43526 | 33523 | 1.271634615 |
| 43411 | 33408 | 1.341666667 | 43440 | 33437 | 1.326923077 | 43469 | 33466 | 1.306818182 | 43498 | 33495 | 1.290816327 | 43527 | 33524 | 1.271634615 |
| 43412 | 33409 | 1.341666667 | 43441 | 33438 | 1.326923077 | 43470 | 33467 | 1.306818182 | 43499 | 33496 | 1.290816327 | 43528 | 33525 | 1.271634615 |
| 43413 | 33410 | 1.338362069 | 43442 | 33439 | 1.326923077 | 43471 | 33468 | 1.306818182 | 43500 | 33497 | 1.288793103 | 43529 | 33526 | 1.270833333 |
| 43414 | 33411 | 1.337209302 | 43443 | 33440 | 1.326923077 | 43472 | 33469 | 1.306818182 | 43501 | 33498 | 1.288793103 | 43530 | 33527 | 1.270348837 |
| 43415 | 33412 | 1.337209302 | 43444 | 33441 | 1.326923077 | 43473 | 33470 | 1.306818182 | 43502 | 33499 | 1.286184211 | 43531 | 33528 | 1.270348837 |
| 43416 | 33413 | 1.337209302 | 43445 | 33442 | 1.326923077 | 43474 | 33471 | 1.306818182 | 43503 | 33500 | 1.286184211 | 43532 | 33529 | 1.269480519 |
| 43417 | 33414 | 1.336267606 | 43446 | 33443 | 1.326923077 | 43475 | 33472 | 1.306818182 | 43504 | 33501 | 1.284574468 | 43533 | 33530 | 1.269480519 |
| 43418 | 33415 | 1.335629921 | 43447 | 33444 | 1.326923077 | 43476 | 33473 | 1.30377907 | 43505 | 33502 | 1.284574468 | 43534 | 33531 | 1.269480519 |
| 43419 | 33416 | 1.334821429 | 43448 | 33445 | 1.326923077 | 43477 | 33474 | 1.301886792 | 43506 | 33503 | 1.283482143 | 43535 | 33532 | 1.265 |
| 43420 | 33417 | 1.334821429 | 43449 | 33446 | 1.326923077 | 43478 | 33475 | 1.300595238 | 43507 | 33504 | 1.277777778 | 43536 | 33533 | 1.265 |
| 43421 | 33418 | 1.333762887 | 43450 | 33447 | 1.326923077 | 43479 | 33476 | 1.300595238 | 43508 | 33505 | 1.277777778 | 43537 | 33534 | 1.265 |
| 43422 | 33419 | 1.333333333 | 43451 | 33448 | 1.323412698 | 43480 | 33477 | 1.299657534 | 43509 | 33506 | 1.277777778 | 43538 | 33535 | 1.265 |
| 43423 | 33420 | 1.333333333 | 43452 | 33449 | 1.3225 | 43481 | 33478 | 1.298387097 | 43510 | 33507 | 1.277777778 | 43539 | 33536 | 1.265 |
| 43424 | 33421 | 1.332317073 | 43453 | 33450 | 1.320153061 | 43482 | 33479 | 1.296568627 | 43511 | 33508 | 1.277777778 | 43540 | 33537 | 1.263257576 |
| 43425 | 33422 | 1.331578947 | 43454 | 33451 | 1.319672131 | 43483 | 33480 | 1.296568627 | 43512 | 33509 | 1.277777778 | 43541 | 33538 | 1.262195122 |
| 43426 | 33423 | 1.331018519 | 43455 | 33452 | 1.319672131 | 43484 | 33481 | 1.296568627 | 43513 | 33510 | 1.277777778 | 43542 | 33539 | 1.262195122 |
| 43427 | 33424 | 1.331018519 | 43456 | 33453 | 1.319672131 | 43485 | 33482 | 1.296568627 | 43514 | 33511 | 1.277777778 | 43543 | 33540 | 1.262195122 |
| 43428 | 33425 | 1.331018519 | 43457 | 33454 | 1.317708333 | 43486 | 33483 | 1.294701987 | 43515 | 33512 | 1.277777778 | 43544 | 33541 | 1.260964912 |

FIG. 13 (Cont.)

| DNA SEQ ID NO | AA SEQ ID NO | Lung 1 Enrichment |
|---|---|---|
| 43545 | 33542 | 1.259831461 |
| 43546 | 33543 | 1.25952381 |
| 43547 | 33544 | 1.2578125 |
| 43548 | 33545 | 1.2578125 |
| 43549 | 33546 | 1.2578125 |
| 43550 | 33547 | 1.2578125 |
| 43551 | 33548 | 1.2578125 |
| 43552 | 33549 | 1.2578125 |
| 43553 | 33550 | 1.2578125 |
| 43554 | 33551 | 1.2578125 |
| 43555 | 33552 | 1.2578125 |
| 43556 | 33553 | 1.2578125 |
| 43557 | 33554 | 1.2578125 |
| 43558 | 33555 | 1.254545455 |
| 43559 | 33556 | 1.253989362 |
| 43560 | 33557 | 1.253759398 |
| 43561 | 33558 | 1.253205128 |
| 43562 | 33559 | 1.253205128 |
| 43563 | 33560 | 1.253205128 |
| 43564 | 33561 | 1.252016129 |
| 43565 | 33562 | 1.252016129 |
| 43566 | 33563 | 1.250954198 |
| 43567 | 33564 | 1.25 |
| 43568 | 33565 | 1.25 |
| 43569 | 33566 | 1.25 |
| 43570 | 33567 | 1.24897541 |
| 43571 | 33568 | 1.248737374 |
| 43572 | 33569 | 1.248737374 |
| 43573 | 33570 | 1.248737374 |

| DNA SEQ ID NO | AA SEQ ID NO | Lung 1 Enrichment |
|---|---|---|
| 43574 | 33571 | 1.247641509 |
| 43575 | 33572 | 1.246987952 |
| 43576 | 33573 | 1.245833333 |
| 43577 | 33574 | 1.245833333 |
| 43578 | 33575 | 1.245833333 |
| 43579 | 33576 | 1.245833333 |
| 43580 | 33577 | 1.245833333 |
| 43581 | 33578 | 1.245833333 |
| 43582 | 33579 | 1.245833333 |
| 43583 | 33580 | 1.245833333 |
| 43584 | 33581 | 1.244845361 |
| 43585 | 33582 | 1.244402985 |
| 43586 | 33583 | 1.243243243 |
| 43587 | 33584 | 1.243243243 |
| 43588 | 33585 | 1.243243243 |
| 43589 | 33586 | 1.243243243 |
| 43590 | 33587 | 1.243243243 |
| 43591 | 33588 | 1.240196078 |
| 43592 | 33589 | 1.240196078 |
| 43593 | 33590 | 1.240196078 |
| 43594 | 33591 | 1.239224138 |
| 43595 | 33592 | 1.238461538 |
| 43596 | 33593 | 1.237847222 |
| 43597 | 33594 | 1.237341772 |
| 43598 | 33595 | 1.237341772 |
| 43599 | 33596 | 1.237341772 |
| 43600 | 33597 | 1.235981308 |
| 43601 | 33598 | 1.23553719 |
| 43602 | 33599 | 1.235351563 |

| DNA SEQ ID NO | AA SEQ ID NO | Lung 1 Enrichment |
|---|---|---|
| 43603 | 33600 | 1.235351563 |
| 43604 | 33601 | 1.232142857 |
| 43605 | 33602 | 1.232142857 |
| 43606 | 33603 | 1.232142857 |
| 43607 | 33604 | 1.232142857 |
| 43608 | 33605 | 1.232142857 |
| 43609 | 33606 | 1.232142857 |
| 43610 | 33607 | 1.232142857 |
| 43611 | 33608 | 1.232142857 |
| 43612 | 33609 | 1.232142857 |
| 43613 | 33610 | 1.232142857 |
| 43614 | 33611 | 1.232142857 |
| 43615 | 33612 | 1.232142857 |
| 43616 | 33613 | 1.232142857 |
| 43617 | 33614 | 1.232142857 |
| 43618 | 33615 | 1.232142857 |
| 43619 | 33616 | 1.232142857 |
| 43620 | 33617 | 1.232142857 |
| 43621 | 33618 | 1.22752809 |
| 43622 | 33619 | 1.226666667 |
| 43623 | 33620 | 1.226102941 |
| 43624 | 33621 | 1.225409836 |
| 43625 | 33622 | 1.223404255 |
| 43626 | 33623 | 1.223404255 |
| 43627 | 33624 | 1.21969697 |
| 43628 | 33625 | 1.21969697 |
| 43629 | 33626 | 1.21969697 |
| 43630 | 33627 | 1.21969697 |
| 43631 | 33628 | 1.21969697 |

| DNA SEQ ID NO | AA SEQ ID NO | Lung 1 Enrichment |
|---|---|---|
| 43632 | 33629 | 1.218220339 |
| 43633 | 33630 | 1.216346154 |
| 43634 | 33631 | 1.216346154 |
| 43635 | 33632 | 1.216346154 |
| 43636 | 33633 | 1.213888889 |
| 43637 | 33634 | 1.213888889 |
| 43638 | 33635 | 1.213888889 |
| 43639 | 33636 | 1.212009804 |
| 43640 | 33637 | 1.21177686 |
| 43641 | 33638 | 1.210526316 |
| 43642 | 33639 | 1.210526316 |
| 43643 | 33640 | 1.210526316 |
| 43644 | 33641 | 1.210526316 |
| 43645 | 33642 | 1.210526316 |
| 43646 | 33643 | 1.210526316 |
| 43647 | 33644 | 1.210526316 |
| 43648 | 33645 | 1.210526316 |
| 43649 | 33646 | 1.210526316 |
| 43650 | 33647 | 1.210526316 |
| 43651 | 33648 | 1.208333333 |
| 43652 | 33649 | 1.208333333 |
| 43653 | 33650 | 1.207983193 |
| 43654 | 33651 | 1.205645161 |
| 43655 | 33652 | 1.205645161 |
| 43656 | 33653 | 1.205645161 |
| 43657 | 33654 | 1.204391892 |
| 43658 | 33655 | 1.204391892 |
| 43659 | 33656 | 1.203488372 |
| 43660 | 33657 | 1.203488372 |

| DNA SEQ ID NO | AA SEQ ID NO | Lung 1 Enrichment |
|---|---|---|
| 43661 | 33658 | 1.203488372 |
| 43662 | 33659 | 1.202806122 |
| 43663 | 33660 | 1.202272727 |
| 43664 | 33661 | 1.202272727 |
| 43665 | 33662 | 1.200549451 |
| 43666 | 33663 | 1.197916667 |
| 43667 | 33664 | 1.197916667 |
| 43668 | 33665 | 1.197916667 |
| 43669 | 33666 | 1.197916667 |
| 43670 | 33667 | 1.197916667 |
| 43671 | 33668 | 1.197916667 |
| 43672 | 33669 | 1.197916667 |
| 43673 | 33670 | 1.197916667 |
| 43674 | 33671 | 1.197916667 |
| 43675 | 33672 | 1.197916667 |
| 43676 | 33673 | 1.194805195 |
| 43677 | 33674 | 1.194230769 |
| 43678 | 33675 | 1.193396226 |
| 43679 | 33676 | 1.192819149 |
| 43680 | 33677 | 1.192073171 |
| 43681 | 33678 | 1.192073171 |
| 43682 | 33679 | 1.192073171 |
| 43683 | 33680 | 1.192073171 |
| 43684 | 33681 | 1.191071429 |
| 43685 | 33682 | 1.191071429 |
| 43686 | 33683 | 1.189655172 |
| 43687 | 33684 | 1.189655172 |
| 43688 | 33685 | 1.189655172 |
| 43689 | 33686 | 1.189655172 |

FIG. 13 (Cont.)

| DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment |
|---|---|---|---|---|---|---|---|---|---|---|---|---|---|---|
| 43690 | 33687 | 1.1875 | 43719 | 33716 | 1.175492611 | 43748 | 33745 | 1.15858209 | 43777 | 33774 | 1.15 | 43806 | 33803 | 1.134868421 |
| 43691 | 33688 | 1.1875 | 43720 | 33717 | 1.174295775 | 43749 | 33746 | 1.157986111 | 43778 | 33775 | 1.15 | 43807 | 33804 | 1.134868421 |
| 43692 | 33689 | 1.186926606 | 43721 | 33718 | 1.173469388 | 43750 | 33747 | 1.157986111 | 43779 | 33776 | 1.15 | 43808 | 33805 | 1.134868421 |
| 43693 | 33690 | 1.1859375 | 43722 | 33719 | 1.173469388 | 43751 | 33748 | 1.157012195 | 43780 | 33777 | 1.15 | 43809 | 33806 | 1.134868421 |
| 43694 | 33691 | 1.183823529 | 43723 | 33720 | 1.173469388 | 43752 | 33749 | 1.156609195 | 43781 | 33778 | 1.15 | 43810 | 33807 | 1.134174312 |
| 43695 | 33692 | 1.183823529 | 43724 | 33721 | 1.172697368 | 43753 | 33750 | 1.15625 | 43782 | 33779 | 1.15 | 43811 | 33808 | 1.133413462 |
| 43696 | 33693 | 1.183823529 | 43725 | 33722 | 1.172330097 | 43754 | 33751 | 1.15 | 43783 | 33780 | 1.15 | 43812 | 33809 | 1.132575758 |
| 43697 | 33694 | 1.183823529 | 43726 | 33723 | 1.171296296 | 43755 | 33752 | 1.15 | 43784 | 33781 | 1.15 | 43813 | 33810 | 1.132575758 |
| 43698 | 33695 | 1.183823529 | 43727 | 33724 | 1.170353982 | 43756 | 33753 | 1.15 | 43785 | 33782 | 1.15 | 43814 | 33811 | 1.132575758 |
| 43699 | 33696 | 1.183823529 | 43728 | 33725 | 1.17005814 | 43757 | 33754 | 1.15 | 43786 | 33783 | 1.15 | 43815 | 33812 | 1.132575758 |
| 43700 | 33697 | 1.183823529 | 43729 | 33726 | 1.169491525 | 43758 | 33755 | 1.15 | 43787 | 33784 | 1.15 | 43816 | 33813 | 1.131648936 |
| 43701 | 33698 | 1.182242991 | 43730 | 33727 | 1.169491525 | 43759 | 33756 | 1.15 | 43788 | 33785 | 1.15 | 43817 | 33814 | 1.131147541 |
| 43702 | 33699 | 1.180263158 | 43731 | 33728 | 1.168956044 | 43760 | 33757 | 1.15 | 43789 | 33786 | 1.144675926 | 43818 | 33815 | 1.131147541 |
| 43703 | 33700 | 1.180263158 | 43732 | 33729 | 1.167293233 | 43761 | 33758 | 1.15 | 43790 | 33787 | 1.142628205 | 43819 | 33816 | 1.131147541 |
| 43704 | 33701 | 1.180263158 | 43733 | 33730 | 1.165540541 | 43762 | 33759 | 1.15 | 43791 | 33788 | 1.142123288 | 43820 | 33817 | 1.131147541 |
| 43705 | 33702 | 1.179487179 | 43734 | 33731 | 1.165540541 | 43763 | 33760 | 1.15 | 43792 | 33789 | 1.141221374 | 43821 | 33818 | 1.13034188 |
| 43706 | 33703 | 1.179487179 | 43735 | 33732 | 1.165540541 | 43764 | 33761 | 1.15 | 43793 | 33790 | 1.140873016 | 43822 | 33819 | 1.129464286 |
| 43707 | 33704 | 1.179487179 | 43736 | 33733 | 1.165540541 | 43765 | 33762 | 1.15 | 43794 | 33791 | 1.140086207 | 43823 | 33820 | 1.129464286 |
| 43708 | 33705 | 1.179487179 | 43737 | 33734 | 1.165540541 | 43766 | 33763 | 1.15 | 43795 | 33792 | 1.139150943 | 43824 | 33821 | 1.129464286 |
| 43709 | 33706 | 1.179487179 | 43738 | 33735 | 1.164556962 | 43767 | 33764 | 1.15 | 43796 | 33793 | 1.139150943 | 43825 | 33822 | 1.129464286 |
| 43710 | 33707 | 1.179487179 | 43739 | 33736 | 1.163690476 | 43768 | 33765 | 1.15 | 43797 | 33794 | 1.139150943 | 43826 | 33823 | 1.128164557 |
| 43711 | 33708 | 1.179487179 | 43740 | 33737 | 1.163690476 | 43769 | 33766 | 1.15 | 43798 | 33795 | 1.139150943 | 43827 | 33824 | 1.12745098 |
| 43712 | 33709 | 1.179487179 | 43741 | 33738 | 1.163690476 | 43770 | 33767 | 1.15 | 43799 | 33796 | 1.138020833 | 43828 | 33825 | 1.12745098 |
| 43713 | 33710 | 1.177951389 | 43742 | 33739 | 1.162234043 | 43771 | 33768 | 1.15 | 43800 | 33797 | 1.138020833 | 43829 | 33826 | 1.127 |
| 43714 | 33711 | 1.177710843 | 43743 | 33740 | 1.162234043 | 43772 | 33769 | 1.15 | 43801 | 33798 | 1.138020833 | 43830 | 33827 | 1.126689189 |
| 43715 | 33712 | 1.176136364 | 43744 | 33741 | 1.162234043 | 43773 | 33770 | 1.15 | 43802 | 33799 | 1.137362637 | 43831 | 33828 | 1.12628866 |
| 43716 | 33713 | 1.176136364 | 43745 | 33742 | 1.160087719 | 43774 | 33771 | 1.15 | 43803 | 33800 | 1.136627907 | 43832 | 33829 | 1.12628866 |
| 43717 | 33714 | 1.176136364 | 43746 | 33743 | 1.159274194 | 43775 | 33772 | 1.15 | 43804 | 33801 | 1.136627907 | 43833 | 33830 | 1.125 |
| 43718 | 33715 | 1.176136364 | 43747 | 33744 | 1.159274194 | 43776 | 33773 | 1.15 | 43805 | 33802 | 1.135802469 | 43834 | 33831 | 1.125 |

FIG. 13 (Cont.)

| DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment | DNA SEQ ID NO | AA SEQ ID NO | Lung 1 Enrichment |
|---|---|---|---|---|---|---|---|---|---|---|---|---|---|---|
| 43835 | 33832 | 1.125 | 43864 | 33861 | 1.114795918 | 43893 | 33890 | 1.104304636 | 43922 | 33919 | 1.095238095 | 43951 | 33948 | 1.086111111 |
| 43836 | 33833 | 1.125 | 43865 | 33862 | 1.114795918 | 43894 | 33891 | 1.103535354 | 43923 | 33920 | 1.095238095 | 43952 | 33949 | 1.086111111 |
| 43837 | 33834 | 1.125 | 43866 | 33863 | 1.1140625 | 43895 | 33892 | 1.103197674 | 43924 | 33921 | 1.09375 | 43953 | 33950 | 1.086111111 |
| 43838 | 33835 | 1.123046875 | 43867 | 33864 | 1.1140625 | 43896 | 33893 | 1.102739726 | 43925 | 33922 | 1.093309859 | 43954 | 33951 | 1.086111111 |
| 43839 | 33836 | 1.12195122 | 43868 | 33865 | 1.113738739 | 43897 | 33894 | 1.102083333 | 43926 | 33923 | 1.093309859 | 43955 | 33952 | 1.086111111 |
| 43840 | 33837 | 1.12195122 | 43869 | 33866 | 1.112903226 | 43898 | 33895 | 1.102083333 | 43927 | 33924 | 1.0925 | 43956 | 33953 | 1.08490566 |
| 43841 | 33838 | 1.12195122 | 43870 | 33867 | 1.112903226 | 43899 | 33896 | 1.102083333 | 43928 | 33925 | 1.092054264 | 43957 | 33954 | 1.08490566 |
| 43842 | 33839 | 1.120762712 | 43871 | 33868 | 1.112903226 | 43900 | 33897 | 1.102083333 | 43929 | 33926 | 1.091772152 | 43958 | 33955 | 1.084016393 |
| 43843 | 33840 | 1.120762712 | 43872 | 33869 | 1.110344828 | 43901 | 33898 | 1.102083333 | 43930 | 33927 | 1.090517241 | 43959 | 33956 | 1.084016393 |
| 43844 | 33841 | 1.120762712 | 43873 | 33870 | 1.109649123 | 43902 | 33899 | 1.10106383 | 43931 | 33928 | 1.090517241 | 43960 | 33957 | 1.083653846 |
| 43845 | 33842 | 1.120762712 | 43874 | 33871 | 1.108928571 | 43903 | 33900 | 1.10106383 | 43932 | 33929 | 1.090517241 | 43961 | 33958 | 1.083333333 |
| 43846 | 33843 | 1.12012987 | 43875 | 33872 | 1.105769231 | 43904 | 33901 | 1.10106383 | 43933 | 33930 | 1.090517241 | 43962 | 33959 | 1.083333333 |
| 43847 | 33844 | 1.119736842 | 43876 | 33873 | 1.105769231 | 43905 | 33902 | 1.10106383 | 43934 | 33931 | 1.090517241 | 43963 | 33960 | 1.083333333 |
| 43848 | 33845 | 1.118055556 | 43877 | 33874 | 1.105769231 | 43906 | 33903 | 1.10106383 | 43935 | 33932 | 1.089473684 | 43964 | 33961 | 1.082792208 |
| 43849 | 33846 | 1.118055556 | 43878 | 33875 | 1.105769231 | 43907 | 33904 | 1.100308642 | 43936 | 33933 | 1.089015152 | 43965 | 33962 | 1.082352941 |
| 43850 | 33847 | 1.118055556 | 43879 | 33876 | 1.105769231 | 43908 | 33905 | 1.099264706 | 43937 | 33934 | 1.089015152 | 43966 | 33963 | 1.081422018 |
| 43851 | 33848 | 1.118055556 | 43880 | 33877 | 1.105769231 | 43909 | 33906 | 1.099264706 | 43938 | 33935 | 1.089015152 | 43967 | 33964 | 1.081422018 |
| 43852 | 33849 | 1.118055556 | 43881 | 33878 | 1.105769231 | 43910 | 33907 | 1.099264706 | 43939 | 33936 | 1.089015152 | 43968 | 33965 | 1.081422018 |
| 43853 | 33850 | 1.118055556 | 43882 | 33879 | 1.105769231 | 43911 | 33908 | 1.099264706 | 43940 | 33937 | 1.089015152 | 43969 | 33966 | 1.078125 |
| 43854 | 33851 | 1.118055556 | 43883 | 33880 | 1.105769231 | 43912 | 33909 | 1.098314607 | 43941 | 33938 | 1.088592233 | 43970 | 33967 | 1.078125 |
| 43855 | 33852 | 1.118055556 | 43884 | 33881 | 1.105769231 | 43913 | 33910 | 1.098090278 | 43942 | 33939 | 1.087837838 | 43971 | 33968 | 1.078125 |
| 43856 | 33853 | 1.118055556 | 43885 | 33882 | 1.105769231 | 43914 | 33911 | 1.097727273 | 43943 | 33940 | 1.087837838 | 43972 | 33969 | 1.078125 |
| 43857 | 33854 | 1.118055556 | 43886 | 33883 | 1.105769231 | 43915 | 33912 | 1.097727273 | 43944 | 33941 | 1.087837838 | 43973 | 33970 | 1.078125 |
| 43858 | 33855 | 1.118055556 | 43887 | 33884 | 1.105769231 | 43916 | 33913 | 1.097039474 | 43945 | 33942 | 1.087837838 | 43974 | 33971 | 1.078125 |
| 43859 | 33856 | 1.118055556 | 43888 | 33885 | 1.105769231 | 43917 | 33914 | 1.096649485 | 43946 | 33943 | 1.087837838 | 43975 | 33972 | 1.078125 |
| 43860 | 33857 | 1.118055556 | 43889 | 33886 | 1.105769231 | 43918 | 33915 | 1.095238095 | 43947 | 33944 | 1.087837838 | 43976 | 33973 | 1.078125 |
| 43861 | 33858 | 1.116735537 | 43890 | 33887 | 1.105769231 | 43919 | 33916 | 1.095238095 | 43948 | 33945 | 1.087837838 | 43977 | 33974 | 1.078125 |
| 43862 | 33859 | 1.114795918 | 43891 | 33888 | 1.105769231 | 43920 | 33917 | 1.095238095 | 43949 | 33946 | 1.086890244 | 43978 | 33975 | 1.078125 |
| 43863 | 33860 | 1.114795918 | 43892 | 33889 | 1.105769231 | 43921 | 33918 | 1.095238095 | 43950 | 33947 | 1.086614173 | 43979 | 33976 | 1.078125 |

FIG. 13 (Cont.)

| DNA SEQ ID NO | AA SEQ ID NO | Lung 1 Enrichment |
|---|---|---|
| 43980 | 33977 | 1.078125 |
| 43981 | 33978 | 1.078125 |
| 43982 | 33979 | 1.078125 |
| 43983 | 33980 | 1.078125 |
| 43984 | 33981 | 1.078125 |
| 43985 | 33982 | 1.078125 |
| 43986 | 33983 | 1.078125 |
| 43987 | 33984 | 1.078125 |
| 43988 | 33985 | 1.073795181 |
| 43989 | 33986 | 1.073795181 |
| 43990 | 33987 | 1.072033898 |
| 43991 | 33988 | 1.072033898 |
| 43992 | 33989 | 1.072033898 |
| 43993 | 33990 | 1.071078431 |
| 43994 | 33991 | 1.071078431 |
| 43995 | 33992 | 1.070478723 |
| 43996 | 33993 | 1.069767442 |
| 43997 | 33994 | 1.069767442 |
| 43998 | 33995 | 1.069767442 |
| 43999 | 33996 | 1.069767442 |
| 44000 | 33997 | 1.068910256 |
| 44001 | 33998 | 1.068584071 |
| 44002 | 33999 | 1.067857143 |
| 44003 | 34000 | 1.067857143 |
| 44004 | 34001 | 1.067857143 |
| 44005 | 34002 | 1.067857143 |
| 44006 | 34003 | 1.067857143 |
| 44007 | 34004 | 1.067857143 |
| 44008 | 34005 | 1.067857143 |

| DNA SEQ ID NO | AA SEQ ID NO | Lung 1 Enrichment |
|---|---|---|
| 44009 | 34006 | 1.067857143 |
| 44010 | 34007 | 1.066532258 |
| 44011 | 34008 | 1.066532258 |
| 44012 | 34009 | 1.066532258 |
| 44013 | 34010 | 1.066532258 |
| 44014 | 34011 | 1.066011236 |
| 44015 | 34012 | 1.065732759 |
| 44016 | 34013 | 1.064814815 |
| 44017 | 34014 | 1.064814815 |
| 44018 | 34015 | 1.064814815 |
| 44019 | 34016 | 1.064814815 |
| 44020 | 34017 | 1.064814815 |
| 44021 | 34018 | 1.064814815 |
| 44022 | 34019 | 1.063356164 |
| 44023 | 34020 | 1.0625 |
| 44024 | 34021 | 1.0625 |
| 44025 | 34022 | 1.0625 |
| 44026 | 34023 | 1.061538462 |
| 44027 | 34024 | 1.06045082 |
| 44028 | 34025 | 1.059210526 |
| 44029 | 34026 | 1.059210526 |
| 44030 | 34027 | 1.059210526 |
| 44031 | 34028 | 1.059210526 |
| 44032 | 34029 | 1.059210526 |
| 44033 | 34030 | 1.059210526 |
| 44034 | 34031 | 1.059210526 |
| 44035 | 34032 | 1.059210526 |
| 44036 | 34033 | 1.059210526 |
| 44037 | 34034 | 1.059210526 |

| DNA SEQ ID NO | AA SEQ ID NO | Lung 1 Enrichment |
|---|---|---|
| 44038 | 34035 | 1.059210526 |
| 44039 | 34036 | 1.059210526 |
| 44040 | 34037 | 1.056985294 |
| 44041 | 34038 | 1.056122449 |
| 44042 | 34039 | 1.056122449 |
| 44043 | 34040 | 1.056122449 |
| 44044 | 34041 | 1.055045872 |
| 44045 | 34042 | 1.054166667 |
| 44046 | 34043 | 1.054166667 |
| 44047 | 34044 | 1.054166667 |
| 44048 | 34045 | 1.054166667 |
| 44049 | 34046 | 1.054166667 |
| 44050 | 34047 | 1.054166667 |
| 44051 | 34048 | 1.054166667 |
| 44052 | 34049 | 1.054166667 |
| 44053 | 34050 | 1.052455357 |
| 44054 | 34051 | 1.051829268 |
| 44055 | 34052 | 1.051829268 |
| 44056 | 34053 | 1.051829268 |
| 44057 | 34054 | 1.051829268 |
| 44058 | 34055 | 1.051829268 |
| 44059 | 34056 | 1.051829268 |
| 44060 | 34057 | 1.050480769 |
| 44061 | 34058 | 1.050480769 |
| 44062 | 34059 | 1.050480769 |
| 44063 | 34060 | 1.050480769 |
| 44064 | 34061 | 1.050480769 |
| 44065 | 34062 | 1.049603175 |
| 44066 | 34063 | 1.048529412 |

| DNA SEQ ID NO | AA SEQ ID NO | Lung 1 Enrichment |
|---|---|---|
| 44067 | 34064 | 1.045454545 |
| 44068 | 34065 | 1.045454545 |
| 44069 | 34066 | 1.045454545 |
| 44070 | 34067 | 1.045454545 |
| 44071 | 34068 | 1.045454545 |
| 44072 | 34069 | 1.045454545 |
| 44073 | 34070 | 1.045454545 |
| 44074 | 34071 | 1.045454545 |
| 44075 | 34072 | 1.045454545 |
| 44076 | 34073 | 1.045454545 |
| 44077 | 34074 | 1.045454545 |
| 44078 | 34075 | 1.045454545 |
| 44079 | 34076 | 1.045454545 |
| 44080 | 34077 | 1.0421875 |
| 44081 | 34078 | 1.0421875 |
| 44082 | 34079 | 1.0421875 |
| 44083 | 34080 | 1.041338583 |
| 44084 | 34081 | 1.040948276 |
| 44085 | 34082 | 1.040948276 |
| 44086 | 34083 | 1.040948276 |
| 44087 | 34084 | 1.039893617 |
| 44088 | 34085 | 1.039893617 |
| 44089 | 34086 | 1.038194444 |
| 44090 | 34087 | 1.037371134 |
| 44091 | 34088 | 1.036337209 |
| 44092 | 34089 | 1.036337209 |
| 44093 | 34090 | 1.036337209 |
| 44094 | 34091 | 1.036337209 |
| 44095 | 34092 | 1.036036036 |

| DNA SEQ ID NO | AA SEQ ID NO | Lung 1 Enrichment |
|---|---|---|
| 44096 | 34093 | 1.035 |
| 44097 | 34094 | 1.035 |
| 44098 | 34095 | 1.035 |
| 44099 | 34096 | 1.035 |
| 44100 | 34097 | 1.035 |
| 44101 | 34098 | 1.035 |
| 44102 | 34099 | 1.033707865 |
| 44103 | 34100 | 1.032458564 |
| 44104 | 34101 | 1.032051282 |
| 44105 | 34102 | 1.032051282 |
| 44106 | 34103 | 1.032051282 |
| 44107 | 34104 | 1.032051282 |
| 44108 | 34105 | 1.03125 |
| 44109 | 34106 | 1.030660377 |
| 44110 | 34107 | 1.030660377 |
| 44111 | 34108 | 1.029850746 |
| 44112 | 34109 | 1.029850746 |
| 44113 | 34110 | 1.029320988 |
| 44114 | 34111 | 1.029320988 |
| 44115 | 34112 | 1.028947368 |
| 44116 | 34113 | 1.028669725 |
| 44117 | 34114 | 1.026785714 |
| 44118 | 34115 | 1.026785714 |
| 44119 | 34116 | 1.026785714 |
| 44120 | 34117 | 1.026785714 |
| 44121 | 34118 | 1.026785714 |
| 44122 | 34119 | 1.026785714 |
| 44123 | 34120 | 1.026785714 |
| 44124 | 34121 | 1.026785714 |

FIG. 13 (Cont.)

| DNA SEQ ID NO | AA SEQ ID NO | Lung 1 Enrichment |
|---|---|---|
| 44125 | 34122 | 1.026785714 |
| 44126 | 34123 | 1.026785714 |
| 44127 | 34124 | 1.026785714 |
| 44128 | 34125 | 1.026785714 |
| 44129 | 34126 | 1.026785714 |
| 44130 | 34127 | 1.026785714 |
| 44131 | 34128 | 1.026785714 |
| 44132 | 34129 | 1.026785714 |
| 44133 | 34130 | 1.02534965 |
| 44134 | 34131 | 1.023972603 |
| 44135 | 34132 | 1.023972603 |
| 44136 | 34133 | 1.023972603 |
| 44137 | 34134 | 1.023305085 |
| 44138 | 34135 | 1.023305085 |
| 44139 | 34136 | 1.023305085 |
| 44140 | 34137 | 1.022222222 |

| DNA SEQ ID NO | AA SEQ ID NO | Lung 1 Enrichment |
|---|---|---|
| 44141 | 34138 | 1.022222222 |
| 44142 | 34139 | 1.022222222 |
| 44143 | 34140 | 1.02016129 |
| 44144 | 34141 | 1.02016129 |
| 44145 | 34142 | 1.02016129 |
| 44146 | 34143 | 1.02016129 |
| 44147 | 34144 | 1.02016129 |
| 44148 | 34145 | 1.02016129 |
| 44149 | 34146 | 1.02016129 |
| 44150 | 34147 | 1.02016129 |
| 44151 | 34148 | 1.018987342 |
| 44152 | 34149 | 1.017307692 |
| 44153 | 34150 | 1.016768293 |
| 44154 | 34151 | 1.016768293 |
| 44155 | 34152 | 1.016768293 |
| 44156 | 34153 | 1.016414141 |

| DNA SEQ ID NO | AA SEQ ID NO | Lung 1 Enrichment |
|---|---|---|
| 44157 | 34154 | 1.014705882 |
| 44158 | 34155 | 1.014705882 |
| 44159 | 34156 | 1.014705882 |
| 44160 | 34157 | 1.014705882 |
| 44161 | 34158 | 1.014705882 |
| 44162 | 34159 | 1.014705882 |
| 44163 | 34160 | 1.014705882 |
| 44164 | 34161 | 1.014705882 |
| 44165 | 34162 | 1.014705882 |
| 44166 | 34163 | 1.014705882 |
| 44167 | 34164 | 1.014705882 |
| 44168 | 34165 | 1.014705882 |
| 44169 | 34166 | 1.012323944 |
| 44170 | 34167 | 1.012323944 |
| 44171 | 34168 | 1.010989011 |
| 44172 | 34169 | 1.010135135 |

| DNA SEQ ID NO | AA SEQ ID NO | Lung 1 Enrichment |
|---|---|---|
| 44173 | 34170 | 1.010135135 |
| 44174 | 34171 | 1.010135135 |
| 44175 | 34172 | 1.009308511 |
| 44176 | 34173 | 1.00877193 |
| 44177 | 34174 | 1.00877193 |
| 44178 | 34175 | 1.008116883 |
| 44179 | 34176 | 1.00729927 |
| 44180 | 34177 | 1.00625 |
| 44181 | 34178 | 1.00625 |
| 44182 | 34179 | 1.00625 |
| 44183 | 34180 | 1.00625 |
| 44184 | 34181 | 1.00625 |
| 44185 | 34182 | 1.00625 |
| 44186 | 34183 | 1.00625 |
| 44187 | 34184 | 1.00625 |
| 44188 | 34185 | 1.00625 |

| DNA SEQ ID NO | AA SEQ ID NO | Lung 1 Enrichment |
|---|---|---|
| 44189 | 34186 | 1.004518072 |
| 44190 | 34187 | 1.004518072 |
| 44191 | 34188 | 1.003968254 |
| 44192 | 34189 | 1.002906977 |
| 44193 | 34190 | 1.002906977 |
| 44194 | 34191 | 1.002906977 |
| 44195 | 34192 | 1.002906977 |
| 44196 | 34193 | 1.002906977 |
| 44197 | 34194 | 1.002293578 |
| 44198 | 34195 | 1.001893939 |
| 44199 | 34196 | 1.001893939 |
| 44200 | 34197 | 1.001893939 |
| 44201 | 34198 | 1.001893939 |

FIG. 14

| DNA SEQ ID NO | AA SEQ ID NO | Adipose 1 Enrichment |
|---|---|---|
| 44202 | 34199 | 1909 |
| 44203 | 34200 | 616.4 |
| 44204 | 34201 | 608.2222222 |
| 44205 | 34202 | 477.25 |
| 44206 | 34203 | 425.5 |
| 44207 | 34204 | 375.2631579 |
| 44208 | 34205 | 346.3529412 |
| 44209 | 34206 | 331.2 |
| 44210 | 34207 | 326 |
| 44211 | 34208 | 324.0909091 |
| 44212 | 34209 | 322 |
| 44213 | 34210 | 316.8888889 |
| 44214 | 34211 | 295.7142857 |
| 44215 | 34212 | 289.2888889 |
| 44216 | 34213 | 282.969697 |
| 44217 | 34214 | 279.9428571 |
| 44218 | 34215 | 276 |
| 44219 | 34216 | 271.6190476 |
| 44220 | 34217 | 266.8 |
| 44221 | 34218 | 261.4736842 |
| 44222 | 34219 | 250.7 |
| 44223 | 34220 | 250.125 |
| 44224 | 34221 | 248.7407407 |
| 44225 | 34222 | 243.3157895 |
| 44226 | 34223 | 239.7575758 |
| 44227 | 34224 | 239.2 |
| 44228 | 34225 | 236.5714286 |

| DNA SEQ ID NO | AA SEQ ID NO | Adipose 1 Enrichment |
|---|---|---|
| 44229 | 34226 | 235.9354839 |
| 44230 | 34227 | 230 |
| 44231 | 34228 | 225.6190476 |
| 44232 | 34229 | 224.4242424 |
| 44233 | 34230 | 224 |
| 44234 | 34231 | 216.5833333 |
| 44235 | 34232 | 215.5185185 |
| 44236 | 34233 | 213.7647059 |
| 44237 | 34234 | 213.5714286 |
| 44238 | 34235 | 212.75 |
| 44239 | 34236 | 211.2592593 |
| 44240 | 34237 | 209.0909091 |
| 44241 | 34238 | 207.92 |
| 44242 | 34239 | 207.5348837 |
| 44243 | 34240 | 203.7142857 |
| 44244 | 34241 | 199.3333333 |
| 44245 | 34242 | 192.3636364 |
| 44246 | 34243 | 191.9615385 |
| 44247 | 34244 | 185.6428571 |
| 44248 | 34245 | 178.8888889 |
| 44249 | 34246 | 178.6923077 |
| 44250 | 34247 | 177.2682927 |
| 44251 | 34248 | 174.8 |
| 44252 | 34249 | 173.902439 |
| 44253 | 34250 | 171.5675676 |
| 44254 | 34251 | 168.6666667 |
| 44255 | 34252 | 164.59375 |

| DNA SEQ ID NO | AA SEQ ID NO | Adipose 1 Enrichment |
|---|---|---|
| 44256 | 34253 | 162 |
| 44257 | 34254 | 160.28125 |
| 44258 | 34255 | 159.9047619 |
| 44259 | 34256 | 159.6470588 |
| 44260 | 34257 | 159.5625 |
| 44261 | 34258 | 159.2307692 |
| 44262 | 34259 | 157.4615385 |
| 44263 | 34260 | 156.6875 |
| 44264 | 34261 | 146.9444444 |
| 44265 | 34262 | 146.9032258 |
| 44266 | 34263 | 146 |
| 44267 | 34264 | 145.8113208 |
| 44268 | 34265 | 142.6 |
| 44269 | 34266 | 141.4074074 |
| 44270 | 34267 | 138.7301587 |
| 44271 | 34268 | 138 |
| 44272 | 34269 | 135.9090909 |
| 44273 | 34270 | 135.6410256 |
| 44274 | 34271 | 135.5135135 |
| 44275 | 34272 | 135.1692308 |
| 44276 | 34273 | 134 |
| 44277 | 34274 | 132.5882353 |
| 44278 | 34275 | 132.48 |
| 44279 | 34276 | 131.8666667 |
| 44280 | 34277 | 131.4285714 |
| 44281 | 34278 | 130.8125 |
| 44282 | 34279 | 130.6818182 |

| DNA SEQ ID NO | AA SEQ ID NO | Adipose 1 Enrichment |
|---|---|---|
| 44283 | 34280 | 130.3333333 |
| 44284 | 34281 | 129.1376147 |
| 44285 | 34282 | 128.5641026 |
| 44286 | 34283 | 128.2424242 |
| 44287 | 34284 | 127.65 |
| 44288 | 34285 | 127.1764706 |
| 44289 | 34286 | 126.5 |
| 44290 | 34287 | 126.2051282 |
| 44291 | 34288 | 126 |
| 44292 | 34289 | 125.7333333 |
| 44293 | 34290 | 124.7111111 |
| 44294 | 34291 | 124.5365854 |
| 44295 | 34292 | 124.5365854 |
| 44296 | 34293 | 123.6721311 |
| 44297 | 34294 | 123.625 |
| 44298 | 34295 | 123.4736842 |
| 44299 | 34296 | 122.6666667 |
| 44300 | 34297 | 122.4594595 |
| 44301 | 34298 | 122.137931 |
| 44302 | 34299 | 122 |
| 44303 | 34300 | 121.9 |
| 44304 | 34301 | 121.7083333 |
| 44305 | 34302 | 121.3888889 |
| 44306 | 34303 | 121.2727273 |
| 44307 | 34304 | 121.1020408 |
| 44308 | 34305 | 121.0526316 |
| 44309 | 34306 | 119.9016393 |

| DNA SEQ ID NO | AA SEQ ID NO | Adipose 1 Enrichment |
|---|---|---|
| 44310 | 34307 | 119.7352941 |
| 44311 | 34308 | 119.6 |
| 44312 | 34309 | 119.6 |
| 44313 | 34310 | 119.2881356 |
| 44314 | 34311 | 118.8333333 |
| 44315 | 34312 | 118.2857143 |
| 44316 | 34313 | 118 |
| 44317 | 34314 | 117.875 |
| 44318 | 34315 | 117.875 |
| 44319 | 34316 | 116.9166667 |
| 44320 | 34317 | 116.8852459 |
| 44321 | 34318 | 116.4081633 |
| 44322 | 34319 | 116.15 |
| 44323 | 34320 | 115 |
| 44324 | 34321 | 115 |
| 44325 | 34322 | 114.5490196 |
| 44326 | 34323 | 114.3428571 |
| 44327 | 34324 | 113.6470588 |
| 44328 | 34325 | 112.8301887 |
| 44329 | 34326 | 112.7 |
| 44330 | 34327 | 112.4444444 |
| 44331 | 34328 | 112.24 |
| 44332 | 34329 | 111.8918919 |
| 44333 | 34330 | 111.5342466 |
| 44334 | 34331 | 111.2363636 |
| 44335 | 34332 | 110.9411765 |
| 44336 | 34333 | 110.7209302 |

FIG. 14 (Cont.)

| DNA SEQ ID NO | AA SEQ ID NO | Adipose 1 Enrichment |
|---|---|---|
| 44337 | 34334 | 110.5483871 |
| 44338 | 34335 | 110.4 |
| 44339 | 34336 | 109.8888889 |
| 44340 | 34337 | 108.8076923 |
| 44341 | 34338 | 108.56 |
| 44342 | 34339 | 108.3555556 |
| 44343 | 34340 | 108.1 |
| 44344 | 34341 | 107.9591837 |
| 44345 | 34342 | 107.8360656 |
| 44346 | 34343 | 106.8135593 |
| 44347 | 34344 | 106.7857143 |
| 44348 | 34345 | 106.72 |
| 44349 | 34346 | 106.6808511 |
| 44350 | 34347 | 106.5263158 |
| 44351 | 34348 | 105.4827586 |
| 44352 | 34349 | 105.0617284 |
| 44353 | 34350 | 104.7777778 |
| 44354 | 34351 | 104.7234043 |
| 44355 | 34352 | 104.6896552 |
| 44356 | 34353 | 104.65 |
| 44357 | 34354 | 104.3214286 |
| 44358 | 34355 | 103.2745098 |
| 44359 | 34356 | 102.8235294 |
| 44360 | 34357 | 102.8235294 |
| 44361 | 34358 | 101.9215686 |
| 44362 | 34359 | 101.787234 |
| 44363 | 34360 | 101.7575758 |
| 44364 | 34361 | 101.34375 |
| 44365 | 34362 | 101.2 |

| DNA SEQ ID NO | AA SEQ ID NO | Adipose 1 Enrichment |
|---|---|---|
| 44366 | 34363 | 101.2 |
| 44367 | 34364 | 100.7027027 |
| 44368 | 34365 | 100.3636364 |
| 44369 | 34366 | 100.031746 |
| 44370 | 34367 | 99.93103448 |
| 44371 | 34368 | 99.93103448 |
| 44372 | 34369 | 99.81132075 |
| 44373 | 34370 | 99.81132075 |
| 44374 | 34371 | 99.55223881 |
| 44375 | 34372 | 99.36 |
| 44376 | 34373 | 99.21568627 |
| 44377 | 34374 | 98.9 |
| 44378 | 34375 | 97.96296296 |
| 44379 | 34376 | 97.84126984 |
| 44380 | 34377 | 97.63265306 |
| 44381 | 34378 | 96.38095238 |
| 44382 | 34379 | 96.24615385 |
| 44383 | 34380 | 96.18181818 |
| 44384 | 34381 | 95.89830508 |
| 44385 | 34382 | 95.83333333 |
| 44386 | 34383 | 95.28571429 |
| 44387 | 34384 | 95.11864407 |
| 44388 | 34385 | 95.06666667 |
| 44389 | 34386 | 95 |
| 44390 | 34387 | 94.875 |
| 44391 | 34388 | 93.80392157 |
| 44392 | 34389 | 93.7037037 |
| 44393 | 34390 | 93.12195122 |
| 44394 | 34391 | 92.8440367 |

| DNA SEQ ID NO | AA SEQ ID NO | Adipose 1 Enrichment |
|---|---|---|
| 44395 | 34392 | 92 |
| 44396 | 34393 | 92 |
| 44397 | 34394 | 92 |
| 44398 | 34395 | 92 |
| 44399 | 34396 | 91.11538462 |
| 44400 | 34397 | 91.08 |
| 44401 | 34398 | 90.93023256 |
| 44402 | 34399 | 90.75675676 |
| 44403 | 34400 | 90.4137931 |
| 44404 | 34401 | 90.35714286 |
| 44405 | 34402 | 90.2962963 |
| 44406 | 34403 | 90.10958904 |
| 44407 | 34404 | 89.78313253 |
| 44408 | 34405 | 89.73770492 |
| 44409 | 34406 | 89.49090909 |
| 44410 | 34407 | 89.25373134 |
| 44411 | 34408 | 89.19512195 |
| 44412 | 34409 | 89 |
| 44413 | 34410 | 88.76056338 |
| 44414 | 34411 | 88.75294118 |
| 44415 | 34412 | 88.46153846 |
| 44416 | 34413 | 88.32 |
| 44417 | 34414 | 88.16666667 |
| 44418 | 34415 | 88.11267606 |
| 44419 | 34416 | 87.89285714 |
| 44420 | 34417 | 87.88059701 |
| 44421 | 34418 | 87.66037736 |
| 44422 | 34419 | 87.28205128 |
| 44423 | 34420 | 86.88888889 |

| DNA SEQ ID NO | AA SEQ ID NO | Adipose 1 Enrichment |
|---|---|---|
| 44424 | 34421 | 86.03703704 |
| 44425 | 34422 | 85.42857143 |
| 44426 | 34423 | 85.06849315 |
| 44427 | 34424 | 85 |
| 44428 | 34425 | 84.92307692 |
| 44429 | 34426 | 84.73684211 |
| 44430 | 34427 | 84.51162791 |
| 44431 | 34428 | 84.33333333 |
| 44432 | 34429 | 83.88235294 |
| 44433 | 34430 | 83.54022989 |
| 44434 | 34431 | 83.375 |
| 44435 | 34432 | 83.20588235 |
| 44436 | 34433 | 83.17808219 |
| 44437 | 34434 | 82.6122449 |
| 44438 | 34435 | 82.26923077 |
| 44439 | 34436 | 82.14285714 |
| 44440 | 34437 | 82.05405405 |
| 44441 | 34438 | 82.03333333 |
| 44442 | 34439 | 81.46987952 |
| 44443 | 34440 | 81.30232558 |
| 44444 | 34441 | 81.17647059 |
| 44445 | 34442 | 81.08474576 |
| 44446 | 34443 | 80.92592593 |
| 44447 | 34444 | 80.84848485 |
| 44448 | 34445 | 80.07407407 |
| 44449 | 34446 | 79.73333333 |
| 44450 | 34447 | 79.54166667 |
| 44451 | 34448 | 78.76712329 |
| 44452 | 34449 | 78.58333333 |

| DNA SEQ ID NO | AA SEQ ID NO | Adipose 1 Enrichment |
|---|---|---|
| 44453 | 34450 | 78.47058824 |
| 44454 | 34451 | 78.47058824 |
| 44455 | 34452 | 78.32432432 |
| 44456 | 34453 | 78.06060606 |
| 44457 | 34454 | 77.79411765 |
| 44458 | 34455 | 77.68888889 |
| 44459 | 34456 | 77.42574257 |
| 44460 | 34457 | 77.33333333 |
| 44461 | 34458 | 77.28 |
| 44462 | 34459 | 77.05 |
| 44463 | 34460 | 76.66666667 |
| 44464 | 34461 | 76.43076923 |
| 44465 | 34462 | 76.37735849 |
| 44466 | 34463 | 76.31818182 |
| 44467 | 34464 | 76.16393443 |
| 44468 | 34465 | 75.30973451 |
| 44469 | 34466 | 75.27272727 |
| 44470 | 34467 | 75.17073171 |
| 44471 | 34468 | 75.13333333 |
| 44472 | 34469 | 75.10204082 |
| 44473 | 34470 | 75.08045977 |
| 44474 | 34471 | 74.91428571 |
| 44475 | 34472 | 74.67532468 |
| 44476 | 34473 | 74.6557377 |
| 44477 | 34474 | 74.5 |
| 44478 | 34475 | 74.30769231 |
| 44479 | 34476 | 74.30769231 |
| 44480 | 34477 | 74.19354839 |
| 44481 | 34478 | 74.16326531 |

FIG. 14 (Cont.)

| DNA SEQ ID NO | AA SEQ ID NO | Adipose 1 Enrichment |
|---|---|---|
| 44482 | 34479 | 74.14925373 |
| 44483 | 34480 | 74.04878049 |
| 44484 | 34481 | 74.02298851 |
| 44485 | 34482 | 74 |
| 44486 | 34483 | 74 |
| 44487 | 34484 | 73.94936709 |
| 44488 | 34485 | 73.28813559 |
| 44489 | 34486 | 73.23684211 |
| 44490 | 34487 | 73.18181818 |
| 44491 | 34488 | 73.12820513 |
| 44492 | 34489 | 73.05882353 |
| 44493 | 34490 | 72.20930233 |
| 44494 | 34491 | 72.10810811 |
| 44495 | 34492 | 72 |
| 44496 | 34493 | 71.93617021 |
| 44497 | 34494 | 71.91549296 |
| 44498 | 34495 | 71.50909091 |
| 44499 | 34496 | 71.37931034 |
| 44500 | 34497 | 71.34693878 |
| 44501 | 34498 | 71.3 |
| 44502 | 34499 | 71.26760563 |
| 44503 | 34500 | 71.22580645 |
| 44504 | 34501 | 71.03797468 |
| 44505 | 34502 | 70.64285714 |
| 44506 | 34503 | 70.57534247 |
| 44507 | 34504 | 70.48387097 |
| 44508 | 34505 | 69.95833333 |
| 44509 | 34506 | 69.8961039 |
| 44510 | 34507 | 69.85185185 |

| DNA SEQ ID NO | AA SEQ ID NO | Adipose 1 Enrichment |
|---|---|---|
| 44511 | 34508 | 69.56097561 |
| 44512 | 34509 | 69 |
| 44513 | 34510 | 69 |
| 44514 | 34511 | 69 |
| 44515 | 34512 | 68.69333333 |
| 44516 | 34513 | 68.66666667 |
| 44517 | 34514 | 68.46511628 |
| 44518 | 34515 | 68.46511628 |
| 44519 | 34516 | 68.425 |
| 44520 | 34517 | 68.38938053 |
| 44521 | 34518 | 68.32352941 |
| 44522 | 34519 | 68.32352941 |
| 44523 | 34520 | 68.26984127 |
| 44524 | 34521 | 68.04166667 |
| 44525 | 34522 | 68 |
| 44526 | 34523 | 67.74545455 |
| 44527 | 34524 | 67.50649351 |
| 44528 | 34525 | 67.39534884 |
| 44529 | 34526 | 67.35714286 |
| 44530 | 34527 | 67.23076923 |
| 44531 | 34528 | 67.19101124 |
| 44532 | 34529 | 67.01234568 |
| 44533 | 34530 | 66.73239437 |
| 44534 | 34531 | 66.62068966 |
| 44535 | 34532 | 66.60416667 |
| 44536 | 34533 | 66.125 |
| 44537 | 34534 | 65.93333333 |
| 44538 | 34535 | 65.42222222 |
| 44539 | 34536 | 65.33333333 |

| DNA SEQ ID NO | AA SEQ ID NO | Adipose 1 Enrichment |
|---|---|---|
| 44540 | 34537 | 65.29032258 |
| 44541 | 34538 | 65.29032258 |
| 44542 | 34539 | 65.23636364 |
| 44543 | 34540 | 65.10769231 |
| 44544 | 34541 | 65.07317073 |
| 44545 | 34542 | 64.975 |
| 44546 | 34543 | 64.91111111 |
| 44547 | 34544 | 64.87179487 |
| 44548 | 34545 | 64.71186441 |
| 44549 | 34546 | 64.59574468 |
| 44550 | 34547 | 64.50574713 |
| 44551 | 34548 | 64.50574713 |
| 44552 | 34549 | 64.4 |
| 44553 | 34550 | 64.29545455 |
| 44554 | 34551 | 64.20833333 |
| 44555 | 34552 | 64.03921569 |
| 44556 | 34553 | 63.95121951 |
| 44557 | 34554 | 63.88888889 |
| 44558 | 34555 | 63.825 |
| 44559 | 34556 | 63.63333333 |
| 44560 | 34557 | 63.56363636 |
| 44561 | 34558 | 63.46296296 |
| 44562 | 34559 | 63.42424242 |
| 44563 | 34560 | 63.1372549 |
| 44564 | 34561 | 63.12765957 |
| 44565 | 34562 | 63.11627907 |
| 44566 | 34563 | 63.08571429 |
| 44567 | 34564 | 63 |
| 44568 | 34565 | 62.82926829 |

| DNA SEQ ID NO | AA SEQ ID NO | Adipose 1 Enrichment |
|---|---|---|
| 44569 | 34566 | 62.8 |
| 44570 | 34567 | 62.72727273 |
| 44571 | 34568 | 62.675 |
| 44572 | 34569 | 62.51282051 |
| 44573 | 34570 | 62.47761194 |
| 44574 | 34571 | 62.45528455 |
| 44575 | 34572 | 62.3364486 |
| 44576 | 34573 | 62.32258065 |
| 44577 | 34574 | 62.07228916 |
| 44578 | 34575 | 61.94059406 |
| 44579 | 34576 | 61.72151899 |
| 44580 | 34577 | 61.65957447 |
| 44581 | 34578 | 61.63106796 |
| 44582 | 34579 | 61.525 |
| 44583 | 34580 | 61.51807229 |
| 44584 | 34581 | 61.453125 |
| 44585 | 34582 | 61.33333333 |
| 44586 | 34583 | 61.20967742 |
| 44587 | 34584 | 60.97674419 |
| 44588 | 34585 | 60.97674419 |
| 44589 | 34586 | 60.74358974 |
| 44590 | 34587 | 60.56666667 |
| 44591 | 34588 | 60.52631579 |
| 44592 | 34589 | 60.52631579 |
| 44593 | 34590 | 60.52631579 |
| 44594 | 34591 | 60.52631579 |
| 44595 | 34592 | 60.5 |
| 44596 | 34593 | 60 |
| 44597 | 34594 | 59.84466019 |

| DNA SEQ ID NO | AA SEQ ID NO | Adipose 1 Enrichment |
|---|---|---|
| 44598 | 34595 | 59.70212766 |
| 44599 | 34596 | 59.65625 |
| 44600 | 34597 | 59.64835165 |
| 44601 | 34598 | 59.52941176 |
| 44602 | 34599 | 59.52941176 |
| 44603 | 34600 | 59.5 |
| 44604 | 34601 | 59.5 |
| 44605 | 34602 | 59.34 |
| 44606 | 34603 | 59.31578947 |
| 44607 | 34604 | 59 |
| 44608 | 34605 | 58.9375 |
| 44609 | 34606 | 58.88 |
| 44610 | 34607 | 58.64122137 |
| 44611 | 34608 | 58.54545455 |
| 44612 | 34609 | 58.17647059 |
| 44613 | 34610 | 58.04761905 |
| 44614 | 34611 | 57.96 |
| 44615 | 34612 | 57.96 |
| 44616 | 34613 | 57.94805195 |
| 44617 | 34614 | 57.84848485 |
| 44618 | 34615 | 57.84158416 |
| 44619 | 34616 | 57.82857143 |
| 44620 | 34617 | 57.80530973 |
| 44621 | 34618 | 57.74468085 |
| 44622 | 34619 | 57.5 |
| 44623 | 34620 | 57.5 |
| 44624 | 34621 | 57.5 |
| 44625 | 34622 | 57.36470588 |
| 44626 | 34623 | 57.07407407 |

FIG. 14 (Cont.)

| DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment |
|---|---|---|---|---|---|---|---|---|---|---|---|---|---|---|
| 44627 | 34624 | 56.96923077 | 44656 | 34653 | 54.21428571 | 44685 | 34682 | 51.64912281 | 44714 | 34711 | 48.83076923 | 44743 | 34740 | 46.68148148 |
| 44628 | 34625 | 56.95238095 | 44657 | 34654 | 54.11764706 | 44686 | 34683 | 51.6097561 | 44715 | 34712 | 48.73513514 | 44744 | 34741 | 46.42990654 |
| 44629 | 34626 | 56.73333333 | 44658 | 34655 | 54.11764706 | 44687 | 34684 | 51.52 | 44716 | 34713 | 48.72592593 | 44745 | 34742 | 46.42201835 |
| 44630 | 34627 | 56.66666667 | 44659 | 34656 | 54.08108108 | 44688 | 34685 | 51.41176471 | 44717 | 34714 | 48.62857143 | 44746 | 34743 | 46.34074074 |
| 44631 | 34628 | 56.61538462 | 44660 | 34657 | 54 | 44689 | 34686 | 51.41176471 | 44718 | 34715 | 48.57943925 | 44747 | 34744 | 46 |
| 44632 | 34629 | 56.54166667 | 44661 | 34658 | 53.82 | 44690 | 34687 | 51.32631579 | 44719 | 34716 | 48.50909091 | 44748 | 34745 | 46 |
| 44633 | 34630 | 56.09756098 | 44662 | 34659 | 53.81132075 | 44691 | 34688 | 51.25714286 | 44720 | 34717 | 48.48648649 | 44749 | 34746 | 46 |
| 44634 | 34631 | 56.03636364 | 44663 | 34660 | 53.66666667 | 44692 | 34689 | 51.00990099 | 44721 | 34718 | 48.46428571 | 44750 | 34747 | 46 |
| 44635 | 34632 | 55.92156863 | 44664 | 34661 | 53.56164384 | 44693 | 34690 | 50.97297297 | 44722 | 34719 | 48.42105263 | 44751 | 34748 | 46 |
| 44636 | 34633 | 55.7962963 | 44665 | 34662 | 53.56164384 | 44694 | 34691 | 50.87058824 | 44723 | 34720 | 48.42105263 | 44752 | 34749 | 46 |
| 44637 | 34634 | 55.68421053 | 44666 | 34663 | 53.31818182 | 44695 | 34692 | 50.84210526 | 44724 | 34721 | 48.38961039 | 44753 | 34750 | 46 |
| 44638 | 34635 | 55.58333333 | 44667 | 34664 | 53.07692308 | 44696 | 34693 | 50.80597015 | 44725 | 34722 | 48.38961039 | 44754 | 34751 | 46 |
| 44639 | 34636 | 55.56435644 | 44668 | 34665 | 53.07692308 | 44697 | 34694 | 50.80597015 | 44726 | 34723 | 48.33898305 | 44755 | 34752 | 46 |
| 44640 | 34637 | 55.51724138 | 44669 | 34666 | 52.73170732 | 44698 | 34695 | 50.75862069 | 44727 | 34724 | 48.3 | 44756 | 34753 | 46 |
| 44641 | 34638 | 55.2 | 44670 | 34667 | 52.70833333 | 44699 | 34696 | 50.6 | 44728 | 34725 | 48.27722772 | 44757 | 34754 | 45.64885496 |
| 44642 | 34639 | 55.2 | 44671 | 34668 | 52.65060241 | 44700 | 34697 | 50.6 | 44729 | 34726 | 48.19047619 | 44758 | 34755 | 45.43902439 |
| 44643 | 34640 | 55.04918033 | 44672 | 34669 | 52.63461538 | 44701 | 34698 | 50.50980392 | 44730 | 34727 | 48.04444444 | 44759 | 34756 | 45.41025641 |
| 44644 | 34641 | 55.03571429 | 44673 | 34670 | 52.48717949 | 44702 | 34699 | 50.47222222 | 44731 | 34728 | 48 | 44760 | 34757 | 45.38666667 |
| 44645 | 34642 | 54.90322581 | 44674 | 34671 | 52.34482759 | 44703 | 34700 | 50.38095238 | 44732 | 34729 | 47.89041096 | 44761 | 34758 | 45.09803922 |
| 44646 | 34643 | 54.87719298 | 44675 | 34672 | 52.27272727 | 44704 | 34701 | 50.08064516 | 44733 | 34730 | 47.76923077 | 44762 | 34759 | 45.09803922 |
| 44647 | 34644 | 54.77456647 | 44676 | 34673 | 52.22916667 | 44705 | 34702 | 49.96551724 | 44734 | 34731 | 47.7037037 | 44763 | 34760 | 44.93023256 |
| 44648 | 34645 | 54.44897959 | 44677 | 34674 | 52.19230769 | 44706 | 34703 | 49.94285714 | 44735 | 34732 | 47.64285714 | 44764 | 34761 | 44.82051282 |
| 44649 | 34646 | 54.30555556 | 44678 | 34675 | 52.13333333 | 44707 | 34704 | 49.61797753 | 44736 | 34733 | 47.55932203 | 44765 | 34762 | 44.82051282 |
| 44650 | 34647 | 54.30555556 | 44679 | 34676 | 51.91428571 | 44708 | 34705 | 49.61797753 | 44737 | 34734 | 47.37313433 | 44766 | 34763 | 44.58461538 |
| 44651 | 34648 | 54.29508197 | 44680 | 34677 | 51.87234043 | 44709 | 34706 | 49.48484848 | 44738 | 34735 | 47.29577465 | 44767 | 34764 | 44.49180328 |
| 44652 | 34649 | 54.28828829 | 44681 | 34678 | 51.75 | 44710 | 34707 | 49.17241379 | 44739 | 34736 | 47.04545455 | 44768 | 34765 | 44.2962963 |
| 44653 | 34650 | 54.25641026 | 44682 | 34679 | 51.75 | 44711 | 34708 | 48.92727273 | 44740 | 34737 | 46.83636364 | 44769 | 34766 | 44.26415094 |
| 44654 | 34651 | 54.23880597 | 44683 | 34680 | 51.75 | 44712 | 34709 | 48.875 | 44741 | 34738 | 46.82142857 | 44770 | 34767 | 44.23076923 |
| 44655 | 34652 | 54.21428571 | 44684 | 34681 | 51.68539326 | 44713 | 34710 | 48.83076923 | 44742 | 34739 | 46.68148148 | 44771 | 34768 | 44.19607843 |

FIG. 14 (Cont.)

| DNA SEQ ID NO | AA SEQ ID NO | Adipose 1 Enrichment |
|---|---|---|
| 44772 | 34769 | 43.80952381 |
| 44773 | 34770 | 43.73770492 |
| 44774 | 34771 | 43.7 |
| 44775 | 34772 | 43.61038961 |
| 44776 | 34773 | 43.57894737 |
| 44777 | 34774 | 43.51351351 |
| 44778 | 34775 | 43.47945205 |
| 44779 | 34776 | 43.37142857 |
| 44780 | 34777 | 43.34615385 |
| 44781 | 34778 | 43.33884298 |
| 44782 | 34779 | 43.18367347 |
| 44783 | 34780 | 43.16923077 |
| 44784 | 34781 | 43.08860759 |
| 44785 | 34782 | 43.06382979 |
| 44786 | 34783 | 42.98360656 |
| 44787 | 34784 | 42.93333333 |
| 44788 | 34785 | 42.93333333 |
| 44789 | 34786 | 42.71428571 |
| 44790 | 34787 | 42.61764706 |
| 44791 | 34788 | 42.51515152 |
| 44792 | 34789 | 42.5 |
| 44793 | 34790 | 42.46153846 |
| 44794 | 34791 | 42.38202247 |
| 44795 | 34792 | 42.32 |
| 44796 | 34793 | 42.32 |
| 44797 | 34794 | 42.29032258 |
| 44798 | 34795 | 42.24489796 |
| 44799 | 34796 | 42.20618557 |
| 44800 | 34797 | 42.05714286 |
| 44801 | 34798 | 42 |
| 44802 | 34799 | 41.952 |
| 44803 | 34800 | 41.88617886 |
| 44804 | 34801 | 41.88059701 |
| 44805 | 34802 | 41.81818182 |
| 44806 | 34803 | 41.74074074 |
| 44807 | 34804 | 41.57692308 |
| 44808 | 34805 | 41.57692308 |
| 44809 | 34806 | 41.47540984 |
| 44810 | 34807 | 41.4 |
| 44811 | 34808 | 41.4 |
| 44812 | 34809 | 41.34831461 |
| 44813 | 34810 | 41.33333333 |
| 44814 | 34811 | 41.19402985 |
| 44815 | 34812 | 41.05376344 |
| 44816 | 34813 | 41.04615385 |
| 44817 | 34814 | 40.98181818 |
| 44818 | 34815 | 40.79245283 |
| 44819 | 34816 | 40.66666667 |
| 44820 | 34817 | 40.65116279 |
| 44821 | 34818 | 40.58823529 |
| 44822 | 34819 | 40.50746269 |
| 44823 | 34820 | 40.46616541 |
| 44824 | 34821 | 40.37777778 |
| 44825 | 34822 | 40.36734694 |
| 44826 | 34823 | 40.33497537 |
| 44827 | 34824 | 40.25 |
| 44828 | 34825 | 40.1025641 |
| 44829 | 34826 | 40.08571429 |
| 44830 | 34827 | 39.97619048 |
| 44831 | 34828 | 39.86666667 |
| 44832 | 34829 | 39.72727273 |
| 44833 | 34830 | 39.66666667 |
| 44834 | 34831 | 39.63076923 |
| 44835 | 34832 | 39.58787879 |
| 44836 | 34833 | 39.53125 |
| 44837 | 34834 | 39.51282051 |
| 44838 | 34835 | 39.4751773 |
| 44839 | 34836 | 39.42857143 |
| 44840 | 34837 | 39.42857143 |
| 44841 | 34838 | 39.42857143 |
| 44842 | 34839 | 39.32258065 |
| 44843 | 34840 | 39.31623932 |
| 44844 | 34841 | 39.30909091 |
| 44845 | 34842 | 39.29166667 |
| 44846 | 34843 | 39.28648649 |
| 44847 | 34844 | 39.2 |
| 44848 | 34845 | 39.16831683 |
| 44849 | 34846 | 39.06849315 |
| 44850 | 34847 | 38.86206897 |
| 44851 | 34848 | 38.83116883 |
| 44852 | 34849 | 38.83116883 |
| 44853 | 34850 | 38.78431373 |
| 44854 | 34851 | 38.77142857 |
| 44855 | 34852 | 38.6984127 |
| 44856 | 34853 | 38.66666667 |
| 44857 | 34854 | 38.60714286 |
| 44858 | 34855 | 38.58064516 |
| 44859 | 34856 | 38.58064516 |
| 44860 | 34857 | 38.33333333 |
| 44861 | 34858 | 38.33333333 |
| 44862 | 34859 | 38.24719101 |
| 44863 | 34860 | 38.21538462 |
| 44864 | 34861 | 38.17021277 |
| 44865 | 34862 | 38.01652893 |
| 44866 | 34863 | 37.96825397 |
| 44867 | 34864 | 37.78571429 |
| 44868 | 34865 | 37.76842105 |
| 44869 | 34866 | 37.75722543 |
| 44870 | 34867 | 37.74358974 |
| 44871 | 34868 | 37.63636364 |
| 44872 | 34869 | 37.55102041 |
| 44873 | 34870 | 37.45714286 |
| 44874 | 34871 | 37.44871795 |
| 44875 | 34872 | 37.375 |
| 44876 | 34873 | 37.20588235 |
| 44877 | 34874 | 37.13541667 |
| 44878 | 34875 | 37.09677419 |
| 44879 | 34876 | 37.03896104 |
| 44880 | 34877 | 37.02439024 |
| 44881 | 34878 | 36.90697674 |
| 44882 | 34879 | 36.56410256 |
| 44883 | 34880 | 36.55357143 |
| 44884 | 34881 | 36.52941176 |
| 44885 | 34882 | 36.44155844 |
| 44886 | 34883 | 36.3880597 |
| 44887 | 34884 | 36.37209302 |
| 44888 | 34885 | 36.26923077 |
| 44889 | 34886 | 36.17094017 |
| 44890 | 34887 | 35.9375 |
| 44891 | 34888 | 35.77777778 |
| 44892 | 34889 | 35.77777778 |
| 44893 | 34890 | 35.77777778 |
| 44894 | 34891 | 35.71052632 |
| 44895 | 34892 | 35.66292135 |
| 44896 | 34893 | 35.65 |
| 44897 | 34894 | 35.58490566 |
| 44898 | 34895 | 35.58490566 |
| 44899 | 34896 | 35.54545455 |
| 44900 | 34897 | 35.48571429 |
| 44901 | 34898 | 35.30232558 |
| 44902 | 34899 | 35.21875 |
| 44903 | 34900 | 35.21875 |
| 44904 | 34901 | 35.02752294 |
| 44905 | 34902 | 35.01492537 |
| 44906 | 34903 | 34.96 |
| 44907 | 34904 | 34.96 |
| 44908 | 34905 | 34.92592593 |
| 44909 | 34906 | 34.7804878 |
| 44910 | 34907 | 34.7804878 |
| 44911 | 34908 | 34.7804878 |
| 44912 | 34909 | 34.7804878 |
| 44913 | 34910 | 34.66666667 |
| 44914 | 34911 | 34.66666667 |
| 44915 | 34912 | 34.6185567 |
| 44916 | 34913 | 34.61386139 |

FIG. 14 (Cont.)

| DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment |
|---|---|---|---|---|---|---|---|---|---|---|---|---|---|---|
| 44917 | 34914 | 34.5 | 44946 | 34943 | 32.63513514 | 44975 | 34972 | 30.66666667 | 45004 | 35001 | 28.75 | 45033 | 35030 | 26.63157895 |
| 44918 | 34915 | 34.32307692 | 44947 | 34944 | 32.60194175 | 44976 | 34973 | 30.66666667 | 45005 | 35002 | 28.64150943 | 45034 | 35031 | 26.63157895 |
| 44919 | 34916 | 34.25531915 | 44948 | 34945 | 32.5 | 44977 | 34974 | 30.66666667 | 45006 | 35003 | 28.62222222 | 45035 | 35032 | 26.60240964 |
| 44920 | 34917 | 34.23255814 | 44949 | 34946 | 32.47058824 | 44978 | 34975 | 30.66666667 | 45007 | 35004 | 28.57575758 | 45036 | 35033 | 26.53846154 |
| 44921 | 34918 | 34.2195122 | 44950 | 34947 | 32.37037037 | 44979 | 34976 | 30.53448276 | 45008 | 35005 | 28.54216867 | 45037 | 35034 | 26.48484848 |
| 44922 | 34919 | 34.04 | 44951 | 34948 | 32.33142857 | 44980 | 34977 | 30.43076923 | 45009 | 35006 | 28.5 | 45038 | 35035 | 26.41584158 |
| 44923 | 34920 | 33.925 | 44952 | 34949 | 32.32432432 | 44981 | 34978 | 30.24657534 | 45010 | 35007 | 28.5 | 45039 | 35036 | 26.28571429 |
| 44924 | 34921 | 33.925 | 44953 | 34950 | 32.28070175 | 44982 | 34979 | 30.1875 | 45011 | 35008 | 28.42696629 | 45040 | 35037 | 26.28571429 |
| 44925 | 34922 | 33.78761062 | 44954 | 34951 | 32.26865672 | 44983 | 34980 | 30.13793103 | 45012 | 35009 | 28.24561404 | 45041 | 35038 | 26.28571429 |
| 44926 | 34923 | 33.73333333 | 44955 | 34952 | 32.2 | 44984 | 34981 | 30.13793103 | 45013 | 35010 | 28.21333333 | 45042 | 35039 | 26.13636364 |
| 44927 | 34924 | 33.67010309 | 44956 | 34953 | 31.88636364 | 44985 | 34982 | 30.11904762 | 45014 | 35011 | 28.19354839 | 45043 | 35040 | 25.8245614 |
| 44928 | 34925 | 33.65853659 | 44957 | 34954 | 31.88118812 | 44986 | 34983 | 30.10909091 | 45015 | 35012 | 28.06779661 | 45044 | 35041 | 25.80487805 |
| 44929 | 34926 | 33.65853659 | 44958 | 34955 | 31.68888889 | 44987 | 34984 | 30.0483871 | 45016 | 35013 | 28.04878049 | 45045 | 35042 | 25.78021978 |
| 44930 | 34927 | 33.56756757 | 44959 | 34956 | 31.58208955 | 44988 | 34985 | 29.8028169 | 45017 | 35014 | 28.04878049 | 45046 | 35043 | 25.74626866 |
| 44931 | 34928 | 33.56756757 | 44960 | 34957 | 31.43333333 | 44989 | 34986 | 29.79545455 | 45018 | 35015 | 27.94936709 | 45047 | 35044 | 25.55555556 |
| 44932 | 34929 | 33.55294118 | 44961 | 34958 | 31.3968254 | 44990 | 34987 | 29.67741935 | 45019 | 35016 | 27.6 | 45048 | 35045 | 25.55555556 |
| 44933 | 34930 | 33.488 | 44962 | 34959 | 31.13846154 | 44991 | 34988 | 29.65789474 | 45020 | 35017 | 27.51401869 | 45049 | 35046 | 25.37931034 |
| 44934 | 34931 | 33.45454545 | 44963 | 34960 | 31.06493506 | 44992 | 34989 | 29.65789474 | 45021 | 35018 | 27.48780488 | 45050 | 35047 | 25.33333333 |
| 44935 | 34932 | 33.45454545 | 44964 | 34961 | 30.98947368 | 44993 | 34990 | 29.62121212 | 45022 | 35019 | 27.40425532 | 45051 | 35048 | 25.3258427 |
| 44936 | 34933 | 33.39726027 | 44965 | 34962 | 30.96732026 | 44994 | 34991 | 29.54966887 | 45023 | 35020 | 27.39325843 | 45052 | 35049 | 25.24390244 |
| 44937 | 34934 | 33.38709677 | 44966 | 34963 | 30.96153846 | 44995 | 34992 | 29.5308642 | 45024 | 35021 | 27.33333333 | 45053 | 35050 | 25.22580645 |
| 44938 | 34935 | 33.36263736 | 44967 | 34964 | 30.94545455 | 44996 | 34993 | 29.50943396 | 45025 | 35022 | 27.3125 | 45054 | 35051 | 25.20547945 |
| 44939 | 34936 | 33.22222222 | 44968 | 34965 | 30.88571429 | 44997 | 34994 | 29.39849624 | 45026 | 35023 | 27.23684211 | 45055 | 35052 | 25.2 |
| 44940 | 34937 | 33.22222222 | 44969 | 34966 | 30.87671233 | 44998 | 34995 | 29.23364486 | 45027 | 35024 | 27.2244898 | 45056 | 35053 | 24.97142857 |
| 44941 | 34938 | 33.1627907 | 44970 | 34967 | 30.86842105 | 44999 | 34996 | 29.22352941 | 45028 | 35025 | 27.20430108 | 45057 | 35054 | 24.86486486 |
| 44942 | 34939 | 33.09756098 | 44971 | 34968 | 30.86075949 | 45000 | 34997 | 29.03278689 | 45029 | 35026 | 27.14754098 | 45058 | 35055 | 24.76923077 |
| 44943 | 34940 | 32.85714286 | 44972 | 34969 | 30.81553398 | 45001 | 34998 | 29.00900901 | 45030 | 35027 | 27.08888889 | 45059 | 35056 | 24.61971831 |
| 44944 | 34941 | 32.85714286 | 44973 | 34970 | 30.80357143 | 45002 | 34999 | 28.88372093 | 45031 | 35028 | 27.03092784 | 45060 | 35057 | 24.55932203 |
| 44945 | 34942 | 32.85714286 | 44974 | 34971 | 30.66666667 | 45003 | 35000 | 28.8627451 | 45032 | 35029 | 26.78481013 | 45061 | 35058 | 24.35294118 |

FIG. 14 (Cont.)

| DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment |
|---|---|---|---|---|---|---|---|---|---|---|---|---|---|---|
| 45062 | 35059 | 24.35294118 | 45091 | 35088 | 22.83916084 | 45120 | 35117 | 20.39175258 | 45149 | 35146 | 18.28915663 | 45178 | 35175 | 16.01785714 |
| 45063 | 35060 | 24.35294118 | 45092 | 35089 | 22.81889764 | 45121 | 35118 | 20.39175258 | 45150 | 35147 | 18.26950355 | 45179 | 35176 | 16 |
| 45064 | 35061 | 24.35294118 | 45093 | 35090 | 22.73563218 | 45122 | 35119 | 20.31168831 | 45151 | 35148 | 18.20833333 | 45180 | 35177 | 15.65957447 |
| 45065 | 35062 | 24.32692308 | 45094 | 35091 | 22.67605634 | 45123 | 35120 | 20.19512195 | 45152 | 35149 | 18.18604651 | 45181 | 35178 | 15.64948454 |
| 45066 | 35063 | 24.31428571 | 45095 | 35092 | 22.61016949 | 45124 | 35121 | 20.18367347 | 45153 | 35150 | 18.07142857 | 45182 | 35179 | 15.53246753 |
| 45067 | 35064 | 24.31428571 | 45096 | 35093 | 22.42016807 | 45125 | 35122 | 20.16438356 | 45154 | 35151 | 18.03921569 | 45183 | 35180 | 15.53246753 |
| 45068 | 35065 | 24.23655914 | 45097 | 35094 | 22.4 | 45126 | 35123 | 20.125 | 45155 | 35152 | 17.64383562 | 45184 | 35181 | 15.525 |
| 45069 | 35066 | 24.21052632 | 45098 | 35095 | 22.37837838 | 45127 | 35124 | 20.10084034 | 45156 | 35153 | 17.63333333 | 45185 | 35182 | 15.51162791 |
| 45070 | 35067 | 24.21052632 | 45099 | 35096 | 22.3030303 | 45128 | 35125 | 19.89189189 | 45157 | 35154 | 17.46296296 | 45186 | 35183 | 15.453125 |
| 45071 | 35068 | 24.16161616 | 45100 | 35097 | 22.25806452 | 45129 | 35126 | 19.71428571 | 45158 | 35155 | 17.44827586 | 45187 | 35184 | 15.33333333 |
| 45072 | 35069 | 24.15 | 45101 | 35098 | 22.16363636 | 45130 | 35127 | 19.71428571 | 45159 | 35156 | 17.44827586 | 45188 | 35185 | 15.33333333 |
| 45073 | 35070 | 24.12195122 | 45102 | 35099 | 22.02816901 | 45131 | 35128 | 19.66896552 | 45160 | 35157 | 17.42424242 | 45189 | 35186 | 15.33333333 |
| 45074 | 35071 | 24.0952381 | 45103 | 35100 | 22.0212766 | 45132 | 35129 | 19.51515152 | 45161 | 35158 | 17.37234043 | 45190 | 35187 | 15.33333333 |
| 45075 | 35072 | 24 | 45104 | 35101 | 21.78947368 | 45133 | 35130 | 19.51515152 | 45162 | 35159 | 17.33333333 | 45191 | 35188 | 15.16483516 |
| 45076 | 35073 | 23.95833333 | 45105 | 35102 | 21.74545455 | 45134 | 35131 | 19.49668874 | 45163 | 35160 | 17.25 | 45192 | 35189 | 15.088 |
| 45077 | 35074 | 23.88461538 | 45106 | 35103 | 21.64705882 | 45135 | 35132 | 19.44329897 | 45164 | 35161 | 17.01369863 | 45193 | 35190 | 15.05454545 |
| 45078 | 35075 | 23.85185185 | 45107 | 35104 | 21.32727273 | 45136 | 35133 | 19.33333333 | 45165 | 35162 | 16.94736842 | 45194 | 35191 | 15.01388889 |
| 45079 | 35076 | 23.82142857 | 45108 | 35105 | 21.26415094 | 45137 | 35134 | 19.32 | 45166 | 35163 | 16.9245283 | 45195 | 35192 | 14.91034483 |
| 45080 | 35077 | 23.74193548 | 45109 | 35106 | 20.90909091 | 45138 | 35135 | 19.13868613 | 45167 | 35164 | 16.86666667 | 45196 | 35193 | 14.86153846 |
| 45081 | 35078 | 23.74193548 | 45110 | 35107 | 20.90909091 | 45139 | 35136 | 19.05714286 | 45168 | 35165 | 16.78378378 | 45197 | 35194 | 14.8045977 |
| 45082 | 35079 | 23.39655172 | 45111 | 35108 | 20.84375 | 45140 | 35137 | 19.01333333 | 45169 | 35166 | 16.69354839 | 45198 | 35195 | 14.58536585 |
| 45083 | 35080 | 23.26436782 | 45112 | 35109 | 20.77419355 | 45141 | 35138 | 19 | 45170 | 35167 | 16.56 | 45199 | 35196 | 14.58536585 |
| 45084 | 35081 | 23.26436782 | 45113 | 35110 | 20.73239437 | 45142 | 35139 | 18.975 | 45171 | 35168 | 16.42857143 | 45200 | 35197 | 14.52631579 |
| 45085 | 35082 | 23.26436782 | 45114 | 35111 | 20.71755725 | 45143 | 35140 | 18.84337349 | 45172 | 35169 | 16.29166667 | 45201 | 35198 | 14.52631579 |
| 45086 | 35083 | 23.20720721 | 45115 | 35112 | 20.71755725 | 45144 | 35141 | 18.81818182 | 45173 | 35170 | 16.26262626 | 45202 | 35199 | 14.5045045 |
| 45087 | 35084 | 23.20353982 | 45116 | 35113 | 20.65306122 | 45145 | 35142 | 18.59574468 | 45174 | 35171 | 16.18518519 | 45203 | 35200 | 14.45714286 |
| 45088 | 35085 | 23.1965812 | 45117 | 35114 | 20.56060606 | 45146 | 35143 | 18.5483871 | 45175 | 35172 | 16.1 | 45204 | 35201 | 14.375 |
| 45089 | 35086 | 23 | 45118 | 35115 | 20.55319149 | 45147 | 35144 | 18.4 | 45176 | 35173 | 16.06349206 | 45205 | 35202 | 14.352 |
| 45090 | 35087 | 23 | 45119 | 35116 | 20.4 | 45148 | 35145 | 18.4 | 45177 | 35174 | 16.04651163 | 45206 | 35203 | 14.34117647 |

FIG. 14 (Cont.)

| DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment |
|---|---|---|---|---|---|---|---|---|---|---|---|---|---|---|
| 45207 | 35204 | 14.31111111 | 45236 | 35233 | 11.3034188 | 45265 | 35262 | 9.397849462 | 45294 | 35291 | 7.419354839 | 45323 | 35320 | 5.111111111 |
| 45208 | 35205 | 14.23809524 | 45237 | 35234 | 11.23255814 | 45266 | 35263 | 9.2 | 45295 | 35292 | 7.263157895 | 45324 | 35321 | 5.04109589 |
| 45209 | 35206 | 14.13253012 | 45238 | 35235 | 11.02083333 | 45267 | 35264 | 9.2 | 45296 | 35293 | 7.263157895 | 45325 | 35322 | 5 |
| 45210 | 35207 | 14.11881188 | 45239 | 35236 | 11 | 45268 | 35265 | 9.2 | 45297 | 35294 | 7.040816327 | 45326 | 35323 | 4.928571429 |
| 45211 | 35208 | 14 | 45240 | 35237 | 10.98507463 | 45269 | 35266 | 9.139072848 | 45298 | 35295 | 6.85106383 | 45327 | 35324 | 4.912621359 |
| 45212 | 35209 | 13.85897436 | 45241 | 35238 | 10.97727273 | 45270 | 35267 | 9.117117117 | 45299 | 35296 | 6.731707317 | 45328 | 35325 | 4.791666667 |
| 45213 | 35210 | 13.66336634 | 45242 | 35239 | 10.79591837 | 45271 | 35268 | 8.877192982 | 45300 | 35297 | 6.571428571 | 45329 | 35326 | 4.75862069 |
| 45214 | 35211 | 13.5 | 45243 | 35240 | 10.51428571 | 45272 | 35269 | 8.761904762 | 45301 | 35298 | 6.571428571 | 45330 | 35327 | 4.75862069 |
| 45215 | 35212 | 13.4015748 | 45244 | 35241 | 10.47524752 | 45273 | 35270 | 8.715789474 | 45302 | 35299 | 6.478873239 | 45331 | 35328 | 4.75 |
| 45216 | 35213 | 13.34 | 45245 | 35242 | 10.45454545 | 45274 | 35271 | 8.576271186 | 45303 | 35300 | 6.405063291 | 45332 | 35329 | 4.735294118 |
| 45217 | 35214 | 13.25423729 | 45246 | 35243 | 10.38709677 | 45275 | 35272 | 8.363636364 | 45304 | 35301 | 6.388888889 | 45333 | 35330 | 4.717948718 |
| 45218 | 35215 | 13.14285714 | 45247 | 35244 | 10.35 | 45276 | 35273 | 8.363636364 | 45305 | 35302 | 6.325 | 45334 | 35331 | 4.677966102 |
| 45219 | 35216 | 13.04477612 | 45248 | 35245 | 10.22222222 | 45277 | 35274 | 8.363636364 | 45306 | 35303 | 6.301369863 | 45335 | 35332 | 4.666666667 |
| 45220 | 35217 | 13.01010101 | 45249 | 35246 | 10.15172414 | 45278 | 35275 | 8.30075188 | 45307 | 35304 | 6.272727273 | 45336 | 35333 | 4.658227848 |
| 45221 | 35218 | 12.85294118 | 45250 | 35247 | 10.12 | 45279 | 35276 | 8.117647059 | 45308 | 35305 | 6.272727273 | 45337 | 35334 | 4.624338624 |
| 45222 | 35219 | 12.77777778 | 45251 | 35248 | 10.03636364 | 45280 | 35277 | 8.05 | 45309 | 35306 | 6.2 | 45338 | 35335 | 4.487804878 |
| 45223 | 35220 | 12.65 | 45252 | 35249 | 10.01612903 | 45281 | 35278 | 8 | 45310 | 35307 | 6.075471698 | 45339 | 35336 | 4.380952381 |
| 45224 | 35221 | 12.26666667 | 45253 | 35250 | 9.966666667 | 45282 | 35279 | 8 | 45311 | 35308 | 6.069444444 | 45340 | 35337 | 4.380952381 |
| 45225 | 35222 | 12.21875 | 45254 | 35251 | 9.966666667 | 45283 | 35280 | 8 | 45312 | 35309 | 6.023809524 | 45341 | 35338 | 4.339622642 |
| 45226 | 35223 | 12.03076923 | 45255 | 35252 | 9.931818182 | 45284 | 35281 | 7.931034483 | 45313 | 35310 | 5.75 | 45342 | 35339 | 4.181818182 |
| 45227 | 35224 | 12.01801802 | 45256 | 35253 | 9.796296296 | 45285 | 35282 | 7.90625 | 45314 | 35311 | 5.75 | 45343 | 35340 | 4.181818182 |
| 45228 | 35225 | 11.94230769 | 45257 | 35254 | 9.779527559 | 45286 | 35283 | 7.853658537 | 45315 | 35312 | 5.75 | 45344 | 35341 | 3.956989247 |
| 45229 | 35226 | 11.9389313 | 45258 | 35255 | 9.757575758 | 45287 | 35284 | 7.790322581 | 45316 | 35313 | 5.609756098 | 45345 | 35342 | 3.942857143 |
| 45230 | 35227 | 11.92592593 | 45259 | 35256 | 9.706422018 | 45288 | 35285 | 7.666666667 | 45317 | 35314 | 5.411764706 | 45346 | 35343 | 3.898305085 |
| 45231 | 35228 | 11.9020979 | 45260 | 35257 | 9.654320988 | 45289 | 35286 | 7.666666667 | 45318 | 35315 | 5.411764706 | 45347 | 35344 | 3.833333333 |
| 45232 | 35229 | 11.87096774 | 45261 | 35258 | 9.583333333 | 45290 | 35287 | 7.666666667 | 45319 | 35316 | 5.348837209 | 45348 | 35345 | 3.833333333 |
| 45233 | 35230 | 11.69491525 | 45262 | 35259 | 9.558441558 | 45291 | 35288 | 7.666666667 | 45320 | 35317 | 5.111111111 | 45349 | 35346 | 3.833333333 |
| 45234 | 35231 | 11.61616162 | 45263 | 35260 | 9.492063492 | 45292 | 35289 | 7.666666667 | 45321 | 35318 | 5.111111111 | 45350 | 35347 | 3.833333333 |
| 45235 | 35232 | 11.5 | 45264 | 35261 | 9.470588235 | 45293 | 35290 | 7.419354839 | 45322 | 35319 | 5.111111111 | 45351 | 35348 | 3.793814433 |

FIG. 14 (Cont.)

| DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment | DNA SEQ ID NO | AA SEQ ID NO | Adipose 1 Enrichment |
|---|---|---|---|---|---|---|---|---|---|---|---|---|---|---|
| 45352 | 35349 | 3.744186047 | 45377 | 35374 | 2.76 | 45402 | 35399 | 2.059701493 | 45427 | 35424 | 1.550561798 | 45452 | 35449 | 1.210526316 |
| 45353 | 35350 | 3.72972973 | 45378 | 35375 | 2.705882353 | 45403 | 35400 | 2.059701493 | 45428 | 35425 | 1.550561798 | 45453 | 35450 | 1.210526316 |
| 45354 | 35351 | 3.72972973 | 45379 | 35376 | 2.639344262 | 45404 | 35401 | 2 | 45429 | 35426 | 1.533333333 | 45454 | 35451 | 1.194805195 |
| 45355 | 35352 | 3.68 | 45380 | 35377 | 2.628571429 | 45405 | 35402 | 2 | 45430 | 35427 | 1.533333333 | 45455 | 35452 | 1.179487179 |
| 45356 | 35353 | 3.631578947 | 45381 | 35378 | 2.555555556 | 45406 | 35403 | 2 | 45431 | 35428 | 1.533333333 | 45456 | 35453 | 1.179487179 |
| 45357 | 35354 | 3.607843137 | 45382 | 35379 | 2.555555556 | 45407 | 35404 | 1.971428571 | 45432 | 35429 | 1.46031746 | 45457 | 35454 | 1.164556962 |
| 45358 | 35355 | 3.59375 | 45383 | 35380 | 2.555555556 | 45408 | 35405 | 1.890410959 | 45433 | 35430 | 1.452631579 | 45458 | 35455 | 1.15 |
| 45359 | 35356 | 3.577777778 | 45384 | 35381 | 2.555555556 | 45409 | 35406 | 1.87755102 | 45434 | 35431 | 1.4375 | 45459 | 35456 | 1.15 |
| 45360 | 35357 | 3.538461538 | 45385 | 35382 | 2.509090909 | 45410 | 35407 | 1.87755102 | 45435 | 35432 | 1.4375 | 45460 | 35457 | 1.15 |
| 45361 | 35358 | 3.538461538 | 45386 | 35383 | 2.509090909 | 45411 | 35408 | 1.858585859 | 45436 | 35433 | 1.4375 | 45461 | 35458 | 1.135802469 |
| 45362 | 35359 | 3.484848485 | 45387 | 35384 | 2.486486486 | 45412 | 35409 | 1.84 | 45437 | 35434 | 1.4375 | 45462 | 35459 | 1.12195122 |
| 45363 | 35360 | 3.45 | 45388 | 35385 | 2.464285714 | 45413 | 35410 | 1.803921569 | 45438 | 35435 | 1.415384615 | 45463 | 35460 | 1.108433735 |
| 45364 | 35361 | 3.421487603 | 45389 | 35386 | 2.442477876 | 45414 | 35411 | 1.769230769 | 45439 | 35436 | 1.38 | 45464 | 35461 | 1.095238095 |
| 45365 | 35362 | 3.345454545 | 45390 | 35387 | 2.421052632 | 45415 | 35412 | 1.769230769 | 45440 | 35437 | 1.352941176 | 45465 | 35462 | 1.095238095 |
| 45366 | 35363 | 3.285714286 | 45391 | 35388 | 2.38961039 | 45416 | 35413 | 1.769230769 | 45441 | 35438 | 1.333333333 | 45466 | 35463 | 1.095238095 |
| 45367 | 35364 | 3.228070175 | 45392 | 35389 | 2.262295082 | 45417 | 35414 | 1.703703704 | 45442 | 35439 | 1.314285714 | 45467 | 35464 | 1.078125 |
| 45368 | 35365 | 3.136363636 | 45393 | 35390 | 2.243902439 | 45418 | 35415 | 1.703703704 | 45443 | 35440 | 1.314285714 | 45468 | 35465 | 1.069767442 |
| 45369 | 35366 | 3.066666667 | 45394 | 35391 | 2.225806452 | 45419 | 35416 | 1.703703704 | 45444 | 35441 | 1.295774648 | 45469 | 35466 | 1.069767442 |
| 45370 | 35367 | 3.066666667 | 45395 | 35392 | 2.19047619 | 45420 | 35417 | 1.703703704 | 45445 | 35442 | 1.277777778 | 45470 | 35467 | 1.069767442 |
| 45371 | 35368 | 3.066666667 | 45396 | 35393 | 2.15625 | 45421 | 35418 | 1.703703704 | 45446 | 35443 | 1.277777778 | 45471 | 35468 | 1.069767442 |
| 45372 | 35369 | 3.016393443 | 45397 | 35394 | 2.123076923 | 45422 | 35419 | 1.642857143 | 45447 | 35444 | 1.243243243 | 45472 | 35469 | 1.057471264 |
| 45373 | 35370 | 2.967741935 | 45398 | 35395 | 2.090909091 | 45423 | 35420 | 1.642857143 | 45448 | 35445 | 1.210526316 | 45473 | 35470 | 1.045454545 |
| 45374 | 35371 | 2.875 | 45399 | 35396 | 2.090909091 | 45424 | 35421 | 1.586206897 | 45449 | 35446 | 1.210526316 | 45474 | 35471 | 1.022222222 |
| 45375 | 35372 | 2.816326531 | 45400 | 35397 | 2.090909091 | 45425 | 35422 | 1.559322034 | 45450 | 35447 | 1.210526316 | | | |
| 45376 | 35373 | 2.787878788 | 45401 | 35398 | 2.07518797 | 45426 | 35423 | 1.550561798 | 45451 | 35448 | 1.210526316 | | | |

FIG. 17A

Presence in viral library

| AA | # | A | C | D | E | F | G | H | I | K | L | M | N | P | Q | R | S | T | V | W | Y |
|---|---|---|---|---|---|---|---|---|---|---|---|---|---|---|---|---|---|---|---|---|---|
| 452 | - | + | o | + | + | - | + | + | - | o | o | o | + | - | + | o | + | + | o | - | - |
| 453 | - | + | - | o | o | - | ++ | + | o | + | o | o | + | + | + | o | + | + | o | - | - |
| 454 | - | + | - | + | + | - | + | + | o | + | - | o | + | + | + | o | + | + | o | - | - |
| 455 | - | + | - | + | + | - | ++ | + | - | ++ | - | - | + | + | + | o | + | + | o | - | - |
| 456 | - | + | - | + | o | - | + | + | - | ++ | - | - | o | + | + | o | + | + | o | - | - |
| 457 | - | + | - | + | o | - | + | + | o | + | o | + | + | + | o | o | + | + | o | - | - |
| 458 | - | + | o | o | + | - | ++ | o | - | + | o | + | o | o | + | + | + | + | + | - | - |

Prevalence: ++ + o - -- (high to low)

FIG. 17B

| SEQ ID NO | Variant | 450-451 | 452-458 7AA Sub | 459-560 |
|---|---|---|---|---|
| 1 | AAV9 | TI | NGSGQNQ | QT |
| 5 | PHP.eB | TI | NGSGQNQ | QT |
| 2933 | AAV.CAP-B1 | TI | LQTSPG | QT |
| 79 | AAV.CAP-B2 | TI | QQGKQSV | QT |
| 45475 | AAV.CAP-B4 | TI | SINTKTN | QT |
| 442 | AAV.CAP-B7 | TI | SNGTKQT | QT |
| 88 | AAV.CAP-B8 | TI | GSGKTAA | QT |
| 2466 | AAV.CAP-B9 | TI | MGDKPTR | QT |
| 3943 | AAV.CAP-B10 | TI | DGAATKN | QT |
| 2672 | AAV.CAP-B11 | TI | QPSGGNT | QT |
| 5192 | AAV.CAP-B14 | TI | ERGANTK | QT |
| 2743 | AAV.CAP-B16 | TI | TTGGHSS | QT |
| 3064 | AAV.CAP-B17 | TI | GTTKTSE | QT |
| 11958 | AAV.CAP-B18 | TI | GTGTSVL | QT |
| 780 | AAV.CAP-B19 | TI | NQSGTKG | QT |
| 2764 | AAV.CAP-B22 | TI | DGQSSKS | QT |
| 45476 | AAV.CAP-B23 | TI | KGPGQMG | QT |
| 2741 | AAV.CAP-B25 | TI | GTPSKAG | QT |

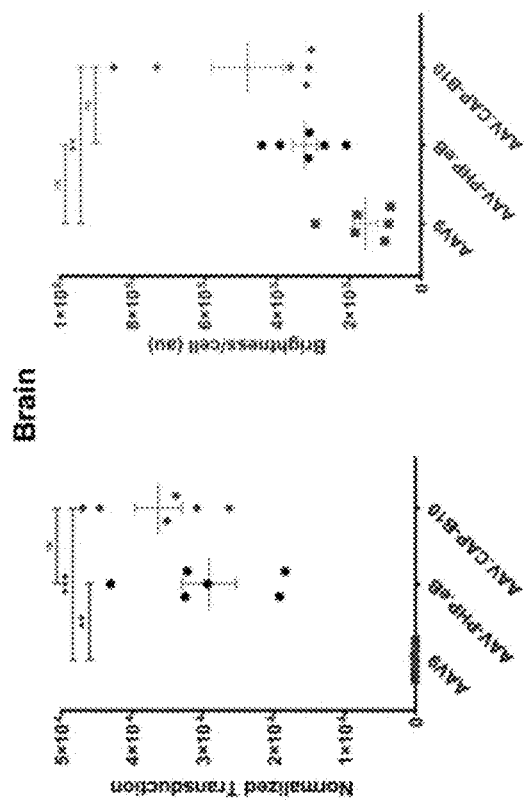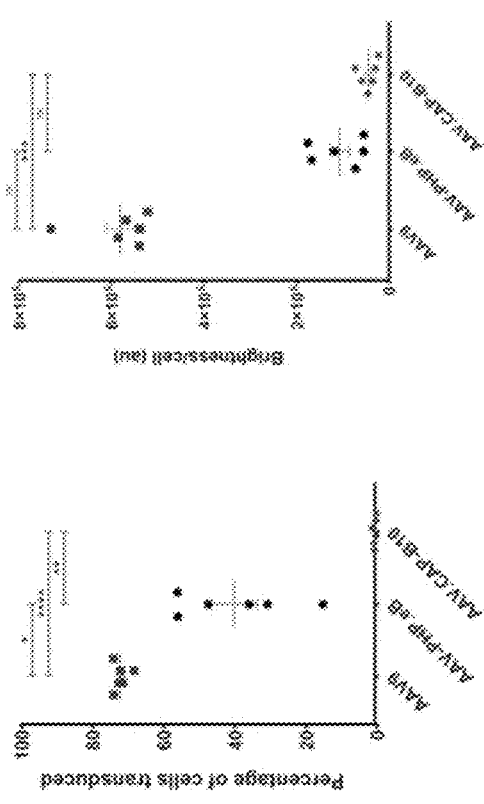
FIG. 18C Brain
FIG. 18D Liver

FIG. 20A

Enriched in brain

| AA | A | C | D | E | F | G | H | I | K | L | M | N | P | Q | R | S | T | V | W | Y |
|---|---|---|---|---|---|---|---|---|---|---|---|---|---|---|---|---|---|---|---|---|
| 452 | o | - | +++ | +++ | - | + | o | - | - | - | o | ++ | - | ++ | - | o | o | o | - | - |
| 453 | o | o | o | o | - | + | o | o | o | - | o | ++ | - | ++ | - | o | o | o | - | - |
| 454 | o | - | + | + | - | + | o | o | o | - | - | + | - | + | - | o | o | o | - | - |
| 455 | o | - | + | + | - | o | o | - | +++ | - | - | + | - | ++ | - | o | o | - | - | - |
| 456 | o | - | + | + | - | o | o | - | +++ | - | - | + | - | + | - | o | o | - | - | - |
| 457 | + | - | + | o | - | o | - | o | o | - | o | +++ | + | + | - | o | o | - | - | - |
| 458 | o | - | + | ++ | - | + | + | + | ++ | - | o | + | - | + | - | - | + | o | - | - | z-score

| +++ | 3 |
| ++ | 2 |
| + | 1 |
| o | 0 |
| - | -1 |
| -- | -2 |

De-targeted from liver

| AA | A | C | D | E | F | G | H | I | K | L | M | N | P | Q | R | S | T | V | W | Y |
|---|---|---|---|---|---|---|---|---|---|---|---|---|---|---|---|---|---|---|---|---|
| 452 | 0 | 0 | +++ | + | - | 0 | ++ | - | 0 | - | + | + | - | + | - | - | + | 0 | - | - |
| 453 | 0 | -- | + | 0 | - | - | + | + | 0 | - | + | +++ | 0 | +++ | - | - | + | 0 | - | - |
| 454 | 0 | -- | + | 0 | -- | - | + | + | + | - | 0 | + | - | + | - | - | + | - | -- | -- |
| 455 | 0 | -- | + | + | -- | - | + | + | + | - | 0 | + | 0 | + | - | - | + | - | -- | -- |
| 456 | 0 | -- | + | 0 | -- | - | + | - | + | - | -- | + | + | + | - | - | 0 | - | -- | -- |
| 457 | 0 | -- | 0 | - | - | - | ++ | + | 0 | - | 0 | + | + | + | - | - | + | + | -- | - |
| 458 | 0 | 0 | + | - | - | - | ++ | + | + | - | + | + | - | ++ | - | - | + | + | -- | - | z-score

Enriched in brain and de-targeted from liver

| AA  | A | C | D  | E  | F | G | H | I | K  | L | M | N  | P | Q | R | S | T | V | W | Y |
|-----|---|---|----|----|---|---|---|---|----|---|---|----|---|---|---|---|---|---|---|---|
| 452 | 0 | - | ++ | ++ | 0 | 0 | + | + | +  | - | + | +  | - | - | - | - | 0 | - | - | - |
| 453 | 0 | - | ++ | +  | - | 0 | + | + | +  | - | + | +  | - | + | - | - | 0 | - | - | - |
| 454 | 0 | - | ++ | ++ | - | 0 | + | + | +  | - | 0 | +  | - | + | - | - | 0 | - | - | - |
| 455 | 0 | - | ++ | ++ | - | 0 | 0 | - | +  | - | - | +  | - | + | - | - | 0 | - | - | - |
| 456 | 0 | - | +  | +  | - | 0 | + | + | +  | - | - | +  | - | + | - | - | 0 | - | - | - |
| 457 | 0 | - | +  | +  | - | 0 | + | + | +  | - | + | ++ | 0 | 0 | - | - | 0 | - | - | - |
| 458 | 0 | - | +  | +  | 0 | 0 | + | + | ++ | - | + | +  | - | + | - | - | 0 | 0 | - | - | z-score

| +++ | ++ | + | 0 | - | -- |
|-----|----|----|---|---|----|
| 3   | 2  | 1  | 0 | -1| -2 |

FIG. 23A
FIG. 23B
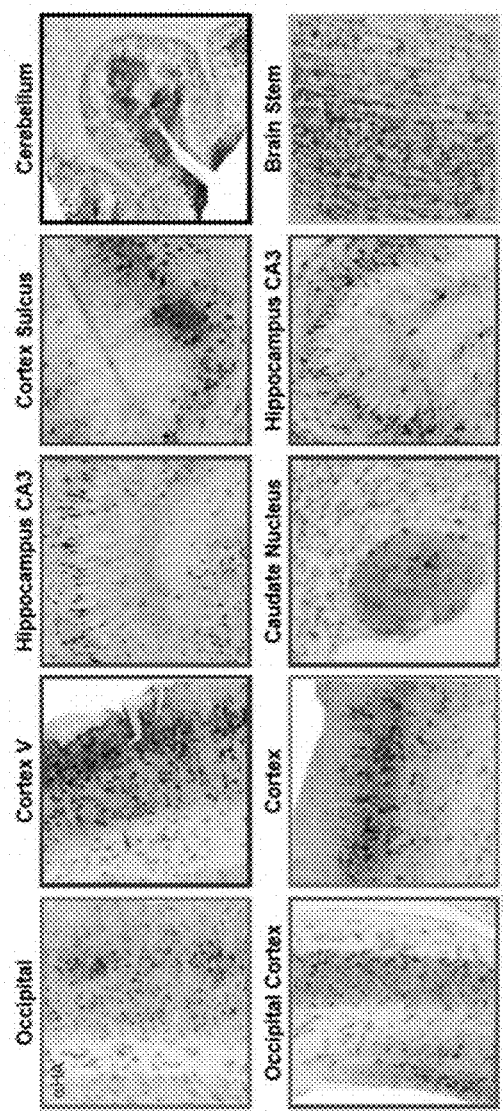
FIG. 23C
FIG. 23D

ADENO-ASSOCIATED VIRUS COMPOSITIONS FOR TARGETED GENE THERAPY

CROSS-REFERENCE

This application claims the benefit of U.S. Provisional Application Ser. No. 62/736,904, filed Sep. 26, 2018, and U.S. Provisional Application Ser. No. 62/832,812, filed Apr. 11, 2019, both of which are incorporate herein by reference in their entirety.

STATEMENT REGARDING FEDERALLY SPONSORED RESEARCH OR DEVELOPMENT

This invention was made with government support under Grant No. NS087949 awarded by the National Institutes of Health and under grant No. W911NF-17-2-0036 awarded by DARPA. The government has certain rights in the invention.

SEQUENCE LISTING

The instant application contains a Sequence Listing which has been submitted electronically in ASCII format and is hereby incorporated by reference in its entirety. Said ASCII copy, created on Sep. 20, 2019, is named 38075-733_201_SL.txt and is 10,656,833 bytes in size.

BACKGROUND

Recombinant adeno-associated viruses (rAAVs) are increasingly used for gene delivery in basic scientific research and therapeutic applications because of their ability to transduce both dividing and non-dividing cells, their long-term persistence as episomal DNA in infected cells, and their low immunogenicity. These characteristics make them appealing for applications in both basic science and in clinics, such as gene therapy. Current gene therapy approaches for many disorders have focused on direct delivery to increase transduction efficiency and restrict expression only to the cell types affected. However, this administrative route has led to limited success across many clinical trials and diseases due to the limited coverage of localized delivery.

Intravenous administration addresses these limitations and allows for broad and efficient access to tissues and organs throughout the body in a non-invasive manner. Unfortunately, the naturally occurring serotypes have limited transduction of certain cell types and organs, and non-specific, overlapping tropisms in others. This leads to several complications in gene therapy applications, including but not limited to off-target effects due to transduction of unimpacted organs and cell types (in particular, the liver), and the necessity for a larger viral load to achieve sufficient therapeutic levels in the tissue or organ of interest. In addition, even with systemic delivery, current rAAV-mediated gene therapies lack the specificity to cross the blood brain barrier (BBB) or the epithelium, limiting their reach as therapeutic interventions for disease and conditions of the brain or organs (e.g., the lung).

Thus, there is a need for rAAVs capable of achieving high specificity to target specific cell types or organs and low specificity for unimpacted (off-target) organs and cell types in a subject when delivered to the subject systemically (e.g., intravenously, intranasally).

SUMMARY

Disclosed herein are recombinant AAVs (rAAVs) comprising capsids with specificity engineered into the capsid structure through iterative rounds of positive and negative selection. This engineering yields rAAV variants with altered specificity for certain tissues or organs relative to the unmodified parental capsid from which they were derived. In some embodiments, the rAAV variant comprises an AAV capsid protein having a 7-mer peptide substitution at the residues corresponding to amino acids 452-458 of the AAV9 capsid protein VP1. In certain embodiments, the substitution is of amino acids 452-458 of AAV9 VP1. In certain other embodiments, the substitution is of amino acids 452-458 of AAV-PHP.B VP1. In yet other embodiments, the substitution is of amino acids 452-458 of AAV-PHP.eB VP1. In some embodiments, the substitution reduces the tropism of the rAAV capsid for a cell or tissue, enabling the rAAV variant to reduce the off-target effects of therapeutic viral transduction, thereby obviating a need for larger viral dosage amounts. In some embodiments, the substitution increases the tropism of the rAAV capsid for a cell or tissue, enabling the rAAV variant to achieve widespread transduction to a target environment (e.g., target cell types or tissues) in a subject upon systemic delivery (e.g., intravenous injection). Typically, the 7-mer peptide substitution is not ILGTGTS (SEQ ID NO: 45479), QSSQTPR (SEQ ID NO: 45480), or TLAVPFK (SEQ ID NO: 45477). The rAAVs described herein are identified using a modified version of the Cre recombination-based AAV targeted evolution (CREATE) method. The Multiplexed-CREATE (M-CREATE) method generates enhanced transduction efficiency and/or specificity by introducing variations in the capsid protein sequence, unbiased in vivo selection and recovery of only those variants that travel to defined cell populations, cross the cell membrane, travel to the nucleus, and unpackage and express their genetic payload. Variant capsids exhibiting the most desirable tropism (e.g., enhanced efficiency and specificity for a particular in vivo environment) are recovered and identified by deep sequencing. Strategies for unbiased selection and analysis include determining variants' enrichment score (by normalizing the target tissue library to starting virus library) and unbiased propagation between rounds of selections through a synthetic library construction (where each variant is represented equally). The detailed characterizations of the resultant libraries from sequencing data is also described herein, which provide useful insights on the selection of variants towards a target.

Also disclosed herein are AAV capsid libraries comprising AAV capsid proteins having 7-mer peptide substitutions at the residues corresponding to amino acids 452-458 of AAV9 VP1. In some embodiments, the library is a library of capsids comprising 7-mer peptide substitutions at amino acids 452-458 of the AAV9 variant AAV-PHP.eB or AAV-PHP.B. Such libraries find particular use in in vivo positive selections across different brain cell types (e.g., endothelial cells, neurons, and astrocytes) and negative selections across the liver, such libraries having been shown herein to yield a large pool of AAV9 variants with enhanced ability to cross the BBB, broadly transduce the central nervous system (CNS), and de-target off-target in vivo environments, e.g., the liver. In other embodiments, the library is an AAV capsid library comprising AAV capsid proteins having 7-mer peptide substitutions at amino acids 452-458 of AAV9. Such libraries find particular use in in vivo selections across different organs, such as the spinal cord, brain, a liver, a stomach, an intestine, a lung, a heart, teste, spleen, adipose (fat), and muscle.

Also disclosed herein are methods and kits for producing therapeutic recombinant AAV (rAAV) particles, as well as methods and pharmaceutical compositions or formulations comprising the rAAV particles for the treatment of a disease or condition affecting, for e.g., the CNS, PNS, or target in vivo environment in a subject in need thereof (e.g., lung).

Aspects disclosed herein provide recombinant AAV (rAAVs), the rAAV comprising: (a) a variant AAV capsid comprising a variant AAV capsid protein comprising an amino acid substitution of three or more amino acids within a 7-mer peptide sequence at a 3-fold axis of symmetry of a corresponding parental AAV capsid protein, wherein the 7-mer peptide sequence is at an amino acid position that corresponds to amino acid residues 452-458 of AAV9 VP1 (SEQ ID NO:1), and wherein the amino acid substitution is not ILGTGTS (SEQ ID NO: 45479), QSSQTPR (SEQ ID NO: 45480), or TLAVPFK (SEQ ID NO: 45477); and (b) a heterologous polynucleotide comprising a nucleotide sequence encoding a gene product. In some embodiments, the variant AAV capsid has an increased tropism for a target tissue or a target cell, when measured in a subject, relative to a tropism of the corresponding parental AAV capsid. In some embodiments, the target tissue or the target cell comprises a tissue or a cell of a central nervous system (CNS) or a peripheral nervous system (PNS), or a combination thereof. In some embodiments, the variant AAV capsid has a decreased tropism for an off-target tissue comprising liver tissue or an off-target cell comprising a liver cell, when measured in a subject, relative to the tropism of the corresponding parental AAV capsid. In some embodiments, the three or more amino acids comprise three contiguous amino acids, each amino acid independently selected from the group consisting of A, D, E, G, K, H, M, N, P, L Q, S, T, and V at amino acid positions in the parental AAV capsid protein corresponding to amino acid residues 452-454, 453-455, 454-456, 455-457, or 456-458 of AAV9 VP1 (SEQ ID NO: 1). In some embodiments, the three or more amino acids comprise four contiguous amino acids, each amino acid independently selected from the group consisting of A, D, E, G, K, H, M, N, P, L Q, S, T, and V at amino acid positions in the parental AAV capsid protein corresponding to amino acid residues 452-455, 453-456, 454-457, or 455-458 of AAV9 VP1 (SEQ ID NO: 1). In some embodiments, three or more amino acids comprise at least five contiguous amino acids, each amino acid independently selected from the group consisting of A, D, E, G, K, H, M, N, P, L Q, S, T, and V at amino acid positions in the parental AAV capsid protein corresponding to amino acid residues 452-456, 453-457, or 454-458 of AAV9 VP1 (SEQ ID NO: 1). In some embodiments, the three or more amino acids comprise three or more of: (a) A, D, E, G, H, M, N, Q, S, T, or V substituted at an amino acid position corresponding to amino acid residue 452 of AAV9 VP1 (SEQ ID NO: 1); (b) A, D, E, G, K, N, Q, S, T, or V substituted at an amino acid position corresponding to amino acid residue 453 of AAV9 VP1 (SEQ ID NO: 1); (c) A, D, E, G, K, N, Q, S, T, or V substituted at amino acid position corresponding to amino acid residue 454 of AAV9 VP1 (SEQ ID NO: 1); (d) A, D, E, G, K, N, P, Q, S, or T substituted at an amino acid position corresponding to amino acid residue 455 of AAV9 VP1 (SEQ ID NO: 1); (e) A, D, E, G, H, K, N, P, Q, S, or T substituted at an amino acid position corresponding to amino acid residue 456 of AAV9 VP1 (SEQ ID NO: 1); (f) A, D, E, G, K, N, P, S, T, or V substituted at an amino acid position corresponding to amino acid residue 457 of AAV9 VP1 (SEQ ID NO: 1); and (g) A, E, G, H, K, L, N, Q, S, T, or V substituted at amino acid position corresponding to amino acid residue 458 of AAV9 VP1 (SEQ ID NO: 1). In some embodiments, the three or more amino acids comprise three or more of: (a) A, D, E, G, H, K, L, M, N, Q, S, T, or V substituted at an amino acid position corresponding to amino acid residue 452 of AAV9 VP1 (SEQ ID NO: 1); (b) A, D, G, H, M, N, P, Q, S, T, or V substituted at an amino acid position corresponding to amino acid residue 453 of AAV9 VP1 (SEQ ID NO: 1); (c) A, D, E, G, K, N, Q, S, T, or V substituted at amino acid position corresponding to amino acid residue 454 of AAV9 VP1 (SEQ ID NO: 1); (d) A, D, E, G, K, N, P, Q, S, or T substituted at an amino acid position corresponding to amino acid residue 455 of AAV9 VP1 (SEQ ID NO: 1); (e) A, D, G, K, N, P, Q, S, or T substituted at an amino acid position corresponding to amino acid residue 456 of AAV9 VP1 (SEQ ID NO: 1); (f) A, G, H, L, M, N, P, Q, S, T, or V substituted at an amino acid position corresponding to amino acid residue 457 of AAV9 VP1 (SEQ ID NO: 1); and (g) A, D, E, G, H, I, K, L, N, Q, R, S, T, or V substituted at amino acid position corresponding to amino acid residue 458 of AAV9 VP1 (SEQ ID NO: 1). In some embodiments, the amino acid substitution comprises an amino acid sequence selected from DGAATKN (SEQ ID NO: 3943), and DGQSSKS (SEQ ID NO: 2764). In some embodiments, the three or more amino acids comprises three or more of: (a) A, D, G, L, N, Q, S, or T substituted at an amino acid at a position corresponding to amino acid residue 452 of AAV9 VP1 (SEQ ID NO: 1); (b) A, G, N, P, Q, R, S, or substituted at an amino acid at a position corresponding to amino acid residue 453 of AAV9 VP1 (SEQ ID NO: 1); (c) A, D, G, N, S, or T substituted at an amino acid at a position corresponding to amino acid residue 454 of AAV9 VP1 (SEQ ID NO: 1); (d) A, D, G, K, N, P, Q, S, or T substituted at an amino acid at a position corresponding to amino acid residue 455 of AAV9 VP1 (SEQ ID NO: 1); (e) A, G, K, N, P, R, S, or T substituted at an amino acid at a position corresponding to amino acid residue 456 of AAV9 VP (SEQ ID NO: 1); (f) A, G, K, N, P, R, S, T, or V substituted at an amino acid at a position corresponding to amino acid residue 457 of AAV9 VP1 (SEQ ID NO: 1); and (g) A, G, K, L, R, S, T, or V substituted at an amino acid at a position corresponding to amino acid residue 458 of AAV9 VP1 (SEQ ID NO: 1). In some embodiments, the amino acid substitution comprises an amino acid sequence selected from the group consisting of LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), KGPGQMG (SEQ ID NO: 45476), and GTPSKAG (SEQ ID NO: 2741). In some embodiments, the target tissue or the target cell in the tissue is selected from the group consisting of lung, intestine, kidney, heart, and stomach. In some embodiments, the three or more amino acids comprise three contiguous amino acids at an amino acid position corresponding to amino acid residues 452-454, 453-455, 454-456, 455-457, or 456-458 of AAV9 VP1, wherein: (a) 452 is selected from the group consisting of N, K, R, and T; (b) 453 is selected from the group consisting of L, N, P, and S; (c) 454 is selected from the group consisting of A, D, G, N, S, and T; (d) 455 is selected from the group consisting of L, P, S, and T; (e) 456 is selected from the group consisting of P, R, and S; (f) 457 is selected from the group consisting of G, N, S, and T; and (g) 458 is selected from the group consisting of I, L, and R. In some embodiments, the three or more amino acids comprise: (a) four contiguous amino acids at an amino acid position corresponding to amino acid residues 452-455, 453-456, 454-457, or 455-458 of AAV9 VP1 (SEQ ID NO:

1); (b) five contiguous amino acids at an amino acid position corresponding to amino acid residues 452-456, 453-457, or 453-458 of AAV9 VP1 (SEQ ID NO: 1); (c) six contiguous amino acids at an amino acid position corresponding to amino acid residues 452-457 or 453-458 of AAV9 VP1 (SEQ ID NO: 1); and (d) seven contiguous amino acids at an amino acid position corresponding to amino acid residues 452-458 of AAV9 VP1 (SEQ ID NO: 1). In some embodiments, the target tissue is lung, and the three or more amino acids are provided in an amino acid sequence comprising KDNTPGR (SEQ ID NO: 32538), NNLPRNL (SEQ ID NO: 32867), or any amino acid sequence provided in FIG. 13. In some embodiments, the target tissue is intestine, and the three or more amino acids are provided in an amino acid sequence comprising RESSPSL (SEQ ID NO: 26474), KDNTPGR (SEQ ID NO: 26584), or any amino acid sequence provided in FIG. 5. In some embodiments, the tissue is kidney, and the three or more amino acids are provided in an amino acid sequence comprising RVPLSTI (SEQ ID NO: 26933), NNLPRNL (SEQ ID NO: 27530), KDNTPGR (SEQ ID NO: 28509), or any amino acid sequence provided in FIG. 6. In some embodiments, the tissue is heart, and the three or more amino acids are provided in an amino acid sequence comprising KDNTPGR (SEQ ID NO: 25633), or any amino acid sequence provided in FIG. 4. In some embodiments, the tissue is stomach, and the three or more amino acids are provided in an amino acid sequence comprising RESSPSL (SEQ ID NO: 31904) or any amino acid sequence of FIG. 12. In some embodiments, the corresponding parental AAV capsid protein is AAV9 VP1 or a variant thereof. In some embodiments, the AAV9 VP1 variant has a sequences identity of 90% or more to SEQ ID NO:1. In some embodiments, the AAV9 VP1 variant has a sequences identity of 95% or more to SEQ ID NO:1. In some embodiments, the corresponding parental AAV capsid protein further comprises an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), at an amino acid position corresponding to 588_589 of the AAV9 VP1 (SEQ ID NO: 1), wherein X is any amino acid other than V. In some embodiments, the parental AAV capsid protein is from AAV-PHP.B or AAV-PHP.eB. In some embodiments, the rAAV is isolated and purified.

Aspects disclosed herein provide pharmaceutical formulations comprising the rAAV of the present disclosure and a pharmaceutical excipient. In some embodiments, the pharmaceutical formulation is formulated for intravenous, intraarterial, intranasal, intrathecal, intracisternae magna, or subcutaneous injection.

Aspects disclosed herein provide methods of treating a disease or condition in a subject, the method comprising administering to the subject a therapeutically effective amount the rAAV of the present disclosure, or the pharmaceutical formulation of the present disclosure, wherein the gene product is a therapeutic gene product. In some embodiments, the administering is by intravenous, intraarterial, intranasal, intrathecal, intracisternae magna, or subcutaneous injection. In some embodiments, the disease or the condition is selected from the group consisting of pulmonary fibrosis, surfactant protein disorders, peroxisome biogenesis disorders, or COPD. In some embodiments, the disease of the condition is a central nervous system (CNS) peripheral nervous system (PNS) disorder.

A method of manufacturing an rAAV of the present disclosure, the method comprising: (a) introducing into a cell a nucleic acid comprising: (i) a first nucleic acid sequence encoding a therapeutic gene expression product enclosed by a 5' and a 3' inverted terminal repeat (ITR) sequence; (ii) a second nucleic acid sequence encoding a viral genome comprising a 5' ITR sequence, a Replication (Rep) gene, Capsid (Cap) gene, and a 3' ITR, wherein the Cap gene encodes a rAAV capsid protein; and (iii) a third nucleic acid sequence encoding a first helper virus protein selected from the group consisting of E4orf6, E2a, and VA RNA, and optionally, a second helper virus protein comprising E1a or E1b55k; (b) expressing in the cell the AAV capsid protein; (c) assembling the rAAV of the present disclosure; and (d) packaging the first nucleic acid sequence in the rAAV. Aspects disclosed herein provide variant adeno-associated virus (AAV) capsids comprising: (a) at least one of a decreased specificity and a decreased transduction efficiency, as measured in a liver of a primate subject when delivered to the primate subject intravenously, relative to a corresponding parental AAV capsid with an AAV capsid protein of SEQ ID NO: 1; and (b) at least one of an increased specificity and an increased transduction efficiency, as measured in a central nervous system (CNS) of the primate subject when delivered to the primate subject intravenously, relative to the corresponding parental AAV capsid. In some embodiments, the variant AAV capsids further comprising a variant AAV capsid protein comprising an amino acid substitution of three or more amino acids within a 7-mer peptide sequence at an amino acid position that corresponds to amino acid residues 452-458 of AAV9 VP1 (SEQ ID NO:1). In some embodiments, the three or more amino acids comprise three contiguous amino acids, each amino acid independently selected from the group consisting of A, D, E, G, K, H, M, N, P, L Q, S, T, and V at amino acid positions in the parental AAV capsid protein corresponding to amino acid residues 452-454, 453-455, 454-456, 455-457, or 456-458 of AAV9 VP1 (SEQ ID NO: 1). In some embodiments, the 7-mer peptide sequence is DGAATKN (SEQ ID NO: 3943). In some embodiments, the variant AAV capsid protein further comprises an amino acid sequence that is at least 96% identical to an amino acid sequence between amino acid 217 to amino acid 736 of SEQ ID NO: 1. In some embodiments, the amino acid substitution is not ILGTGTS (SEQ ID NO: 45479), QSSQTPR (SEQ ID NO: 45480), or TLAVPFK (SEQ ID NO: 45477). In some embodiments, the variant AAV capsid protein further comprises an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), at an amino acid position corresponding to 588_589 of the AAV9 VP1 (SEQ ID NO: 1), wherein X is any amino acid other than V. Aspects disclosed herein provide variant adeno-associated virus (AAV) capsids comprising: (a) a variant AAV capsid protein comprising an amino acid sequence with an amino acid substitution of three or more amino acids within a 7-mer peptide sequence at an amino acid position that corresponds to amino acid residues 452-458 of AAV9 VP1 (SEQ ID NO: 1); and (b) at least one of an increased specificity and increased transduction efficiency in a target tissue as measured in the target tissue of a subject when delivered to the subject intranasally or intravenously, relative to a corresponding parental AAV capsid protein of SEQ ID NO: 1 or SEQ ID NO: 2, wherein the target tissue is selected from the group consisting of lung, intestine, kidney, heart, and stomach. In some embodiments, the three or more amino acids comprise three contiguous amino acids at an amino acid position corresponding to amino acid residues 452-454, 453-455, 454-456, 455-457, or 456-458 of AAV9 VP1, wherein: (a) 452 is selected from the group consisting of N, K, R, and T; (b) 453 is selected from the group consisting of L, N, P, and S; (c) 454 is selected from the group consisting of A, D, G, N, S, and T; (d) 455 is selected from the group consisting of L, P, S, and T; (e) 456 is selected from the group consisting of P, R, and S; (f) 457 is selected from the group consisting of G, N, S, and T; and (g) 458 is selected from the group consisting of I, L, and R. In some embodiments, the target tissue is the lung, and the three or more amino acids are provided in an amino acid sequence comprising KDNTPGR (SEQ ID NO: 32538), NNLPRNL (SEQ ID NO: 32867), or any amino acid sequence provided in FIG. 13. In some embodiments, the target tissue is the intestine, and the three or more amino acids are provided in an amino acid sequence comprising RESSPSL (SEQ ID NO: 26474), KDNTPGR (SEQ ID NO: 26584), or any amino acid sequence provided in FIG. 5. In some embodiments, the tissue is the kidney, and the three or more amino acids are provided in an amino acid sequence comprising RVPLSTI (SEQ ID NO: 26933), NNLPRNL (SEQ ID NO: 27530), KDNTPGR (SEQ ID NO: 28509), or any amino acid sequence provided in FIG. 6. In some embodiments, the tissue is the heart, and the three or more amino acids are provided in an amino acid sequence comprising KDNTPGR (SEQ ID NO: 25633), or any amino acid sequence provided in FIG. 4. In some embodiments, the tissue is the stomach, and the three or more amino acids are provided in an amino acid sequence comprising RESSPSL (SEQ ID NO: 31904) or any amino acid sequence of FIG. 12. In some embodiments, the variant AAV capsid protein further comprises an amino acid sequence that is at least 96% identical to an amino acid sequence between amino acid 217 to amino acid 736 of SEQ ID NO: 1. In some embodiments, the variant AAV capsid of the present disclosure is isolated and purified. In some embodiments, the variant AAV capsid of the present disclosure is formulated as a pharmaceutical formulation further comprising a pharmaceutically acceptable carrier. In some embodiments, the pharmaceutical formulation is formulated for intranasal or intravenous administration.

Aspects disclosed provide methods of treating a disease or condition in a subject, the method comprising administering to the subject a therapeutically effective amount the rAAV of the present disclosure or the pharmaceutical formulation of the present disclosure. In some embodiments, the disease or the condition is selected from the group consisting of pulmonary fibrosis, surfactant protein disorders, peroxisome biogenesis disorders, chronic obstructive pulmonary disease (COPD), a CNS disease or condition, and a PNS disease or condition.

Aspects disclosed herein provide recombinant adeno-associated virus (rAAV) capsids comprising variant AAV capsid proteins, the rAAV capsids having at least one of an increased specificity and an increased transduction efficiency when measured in a target tissue in a primate subject relative to the corresponding parental AAV capsid, and at least one of a decreased specificity and a decreased transduction efficiency when measured in an off-target tissue in the primate subject relative to the corresponding parental AAV capsid. In some instances, the specificity or the transduction efficiency is measured following administration of the rAAV capsid to the subject intravenously, intraarterially, intrathecally, or subcutaneously. In some instances, the rAAV capsid is chimeric. In some instances, the rAAV, or variant AAV protein comprises therein, confer an increase in a localization of the rAAV within the target tissue, as compared to the parental AAV capsid or capsid protein.

In some instances, the variant AAV capsid protein (and rAAV capsid) comprises an amino acid substitution to an amino acid selected from the group consisting of A, D, E, G, K, H, M, N, P, L Q, S, T, and V at one or more amino acid positions corresponding to one or more of residues 452-458 in an amino acid sequence of the AAV9 VP1 capsid protein provided in SEQ ID NO: 1. In some instances, the amino acid sequence of the AAV9 capsid protein is provided in amino acid 217-736 within SEQ ID NO: 1. In some instances, the target tissue is the central nervous system (CNS). In some instances, the CNS comprises a region selected from the neocortex, the basal ganglia, the hippocampus, the thalamus, the cerebellum, the brain stem, and the spinal cord. In some embodiments, the target tissue is the peripheral nervous system (PNS). In some instances, the PNS comprises a ganglion. In some instances, the ganglion comprises a trigeminal or dorsal root ganglion. In some instances, the target tissue is a non-dividing cell. In some instances, the non-dividing cell is selected from the group consisting of a neuron, an astrocyte, a microglial cell, an oligodendrocyte, and a Schwann cell. In some instances, the off-target tissue is a liver. In some instances, VP1, VP2, and VP3 of the AAV capsid comprise the amino acid substitution. In some instances, the amino acid substitution is at a three (3)-fold axis of symmetry of a corresponding parental AAV capsid protein. In some instances, the amino acid substitution comprises at least three contiguous amino acids, each amino acid independently selected from the group consisting of A, D, E, G, K, H, M, N, P, L Q, S, T, and V at amino acid positions corresponding to residues 452-454, 453-455, 454-456, 455-457, or 456-458 of the amino acid sequence of the AAV9 VP1 capsid protein. In some instances, the amino acid substitution comprises at least four contiguous amino acids, each amino acid independently selected from the group consisting of A, D, E, G, K, H, M, N, P, L Q, S, T, and V at amino acid positions corresponding to residues 452-455, 453-456, 454-457, or 455-458 of the amino acid sequence of the AAV9 VP1 capsid protein. In some instances, the amino acid substitution comprises at least five contiguous amino acids, each amino acid independently selected from the group consisting of A, D, E, G, K, H, M, N, P, L Q, S, T, and V at amino acid positions corresponding to residues 452-456, 453-457, or 454-458 of the amino acid sequence the AAV9 VP1 capsid protein. In some instances, the corresponding parental AAV capsid (or AAV capsid protein) is a native AAV9 capsid. In some instances, the corresponding parental AAV capsid is a variant of AAV9 comprising an amino acid sequence provided in any one of SEQ ID NOS: 3-6.

In some instances, the amino acid substitution at the amino acid position corresponding to residue 452 in AAV9 VP1 is selected from the group consisting of N452A, N452D, N452E, N452G, N452H, N452M, N452N, N452Q, N452S, N452T, and N452V. In some instances, the amino acid substitution at the amino acid position corresponding to residue 453 in AAV9 VP1 is selected from the group consisting of G453A, G453D, G453E, G453G, G453K, G453N, G453Q, G453S, G453T, and G453V. In some instances, the amino acid substitution at the amino acid position corresponding to residue 454 in AAV9 VP1 is selected from the group consisting of S454A, S454D, S454E, S454G, S454K, S454N, S454Q, S454S, S454T, and S454V. In some instances, the amino acid substitution at the amino acid position corresponding to residue 455 in AAV9 VP1 is selected from the group consisting of G455A, G455D, G455E, G455G, G455K, G455N, G455P, G455Q, G455S, and G455T. In some instances, the amino acid substitution at the amino acid position corresponding to residue 456 in AAV9 VP1 is selected from the group consisting Q456A, Q456D, Q456E, Q456G, Q456H, Q456K, Q456N, Q456P, Q456Q, Q456S, and Q456T. In some instances, the amino acid substitution at the amino acid position corresponding to residue 457 in AAV9 VP1 is selected from the group consisting N457A, N457D, N457E, N457G, N457K, N457N, N457P, N457S, N457T, and N457V. In some instances, the amino acid substitution at the amino acid position corresponding to residue 458 in AAV9 VP1 is selected from the group consisting Q458A, Q458E, Q458G, Q458H, Q458K, Q458L, Q458N, Q458Q, Q458S, Q458T, and Q458V. In some instances, the amino acid substitution at amino acid positions corresponding to residues 452-458 in AAV9 VP1 is DGAATKN (SEQ ID NO: 3943). In some instances, the amino acid substitution comprises an amino acid sequence selected from FIG. 3 or Table 1, or a combination thereof.

In some instances, the variant AAV capsid protein further comprises an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), following the amino acid at the position corresponding to residue 588 in the amino acid sequence of the AAV9 VP1, wherein X is any amino acid other than V. In some instances, the substitution comprises an amino acid sequence provided in FIG. 3.

In some instances, the target tissue is a brain, and the rAAV capsids, or variant AAV capsid proteins comprised therein, have the increased specificity for the brain, as compared to the parental AAV capsid or capsid protein (e.g., AAV9). In some instances, the off-target tissue is a liver, and the rAAV capsids, or variant AVV capsid proteins, have a decreased specificity for the liver, as compared to the parental AAV capsid or capsid protein (e.g., AAV9). In some instances, the target tissue is a central nervous system (CNS), and the rAAV capsid s, or variant AVV capsid proteins, have an increased efficiency of viral transduction of at least 12-fold in the central nervous system (CNS), as compared to the corresponding parental AAV capsid or capsid protein (e.g., AAV9). In some instances, the target tissue is a spinal cord, and the rAAV capsid s, or variant AVV capsid proteins, have an increased efficiency of viral transduction of at least 20-fold in the spinal cord, as compared to the corresponding parental AAV capsid or capsid protein. In some instances, the target tissue is a neuron, and the rAAV capsid s, or variant AVV capsid proteins, have an increased specificity for the neuron, as compared to the corresponding parental AAV capsid or capsid protein. In some instances, the off-target tissue is a liver, and the rAAV capsid s, or variant AVV capsid proteins, have a decreased efficiency of viral transduction of at least 50-fold in the liver, as compared to the corresponding parental AAV capsid or capsid protein. In some instances, the off-target tissue is a Purkinje cell, and the rAAV capsid s, or variant AVV capsid proteins, have a decreased efficiency of viral transduction of at least 4-fold in the Purkinje cell, as compared to the corresponding parental AAV capsid or capsid protein. In some instances, the off-target tissue is a liver, and the rAAV capsid s, or variant AVV capsid proteins, have a decreased efficiency of viral transduction of at least 100-fold in the liver, as compared to the corresponding parental AAV capsid or capsid protein. In some instances, the AAV further comprises a heterologous nucleic acid encoding a therapeutic gene expression product. In some instances, the AAV capsid is isolated and purified. In some instances, the AAV capsids described herein are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient. In some instances, the pharmaceutical formulation is formulated for intravenous, intraarterial, intrathecal, or subcutaneous administration to treat a disease or a condition of the CNS or PNS.

Aspects disclosed herein provide rAAV capsids comprising variant AAV capsid proteins with an amino acid substitution to an amino acid selected from the group consisting of A, D, E, G, K, H, M, N, P, L Q, S, T, and V, at an amino acid position corresponding to residues selected from 452-458 within an amino acid sequence of the AAV9 VP1, the rAAV capsids, and variant AAV capsids proteins, having at least one of a decreased specificity and a decreased transduction efficiency for an off-target tissue in a subject, relative to a corresponding parental AAV capsid or capsid protein, and at least one of an increased specificity and an increased transduction efficiency for a target tissue in a subject, relative to the corresponding parental AAV capsid or capsid protein. In some instances, the rAAV capsid is chimeric. In some instances, the amino acid substitution is at a three (3)-fold axis of symmetry of the rAAV capsid. In some instances, the rAAV, or variant AAV protein comprises therein, confer an increase in a localization of the rAAV within the target tissue, as compared to the corresponding parental AAV capsid or capsid protein.

In some instances, the target tissue is the central nervous system (CNS) or the peripheral nervous system (PNS). In some instances, the CNS comprises a region selected from the neocortex, the basal ganglia, the hippocampus, the thalamus, the cerebellum, the brain stem, and the spinal cord. In some instances, the PNS comprises a ganglion. In some instances, the ganglion comprises a trigeminal or dorsal root ganglion. In some instances, the target tissue is a non-dividing cell. In some instances, the CNS comprises a cell selected from the group consisting of a neuron, a spinal cord, an astrocyte, an oligodendrocyte, and Schwann cell. In some instances, the off-target tissue is a liver.

In some instances, the amino acid substitution comprises at least three contiguous amino acids, each amino acid independently selected from the group consisting of A, D, E, G, K, H, M, N, P, L Q, S, T, and V at amino acid positions corresponding to residues 452-454, 453-455, 454-456, 455-457, or 456-458, in the amino acid sequence of the AAV9 capsid protein. In some instances, the amino acid substitution comprises at least four contiguous amino acids, each amino acid independently selected from the group consisting of A, D, E, G, K, H, M, N, P, L Q, S, T, and V at amino acid positions corresponding to residues 452-455, 453-456, 454-457, or 455-458, in the amino acid sequence of the AAV9 capsid protein. In some instances, the amino acid substitution comprises at least five contiguous amino acids, each amino acid independently selected from the group consisting of A, D, E, G, K, H, M, N, P, L Q, S, T, and V at amino acid positions corresponding to residues 452-456, 453-457, or 454-458, in the amino acid sequence of the AAV9 capsid protein. In some instances, the AAV capsid protein is an AAV9 capsid protein.

In some instances, the amino acid substitution at the amino acid position corresponding to residue 452 in AAV9 VP1 is selected from the group consisting of N452A, N452D, N452E, N452G, N452H, N452M, N452N, N452Q, N452S, N452T, and N452V. In some instances, the amino acid substitution at the amino acid position corresponding to residue 453 in AAV9 VP1 is selected from the group consisting of G453A, G453D, G453E, G453G, G453K, G453N, G453Q, G453S, G453T, and G453V. In some instances, the amino acid substitution at the amino acid position corresponding to residue 454 in AAV9 VP1 is selected from the group consisting of S454A, S454D, S454E, S454G, S454K, S454N, S454Q, S454S, S454T, and S454V. In some instances, the amino acid substitution at the amino acid position corresponding to residue 455 in AAV9 VP1 is selected from the group consisting of G455A, G455D, G455E, G455G, G455K, G455N, G455P, G455Q, G455S, and G455T. In some instances, the amino acid substitution at the amino acid position corresponding to residue 456 in AAV9 VP1 is selected from the group consisting Q456A, Q456D, Q456E, Q456H, Q456H, Q456K, Q456N, Q456P, Q456Q, Q456S, and Q456T. In some instances, the amino acid substitution at the amino acid position corresponding to residue 457 in AAV9 VP1 is selected from the group consisting N457A, N457D, N457E, N457G, N457K, N457N, N457P, N457S, N457T, and N457V. In some instances, the amino acid substitution at the amino acid position corresponding to residue 458 in AAV9 VP1 is selected from the group consisting Q458A, Q458E, Q458G, Q458H, Q458K, Q458L, Q458N, Q458Q, Q458S, Q458T, and Q458V. In some instances, the amino acid substitution comprises at least three contiguous amino acids in an amino acid sequence selected from the group consisting of DGAATKN (SEQ ID NO: 3943), DGQSSKS (SEQ ID NO: 2764), and an amino acid sequence provided in Table 1. In some instances, an amino acid sequence of the AAV9 VP1 is provided in SEQ ID NO: 1. In some instances, the amino acid sequence of the AAV9 VP1 is provided in amino acid 217-736 within SEQ ID NO: 1. In some instances, VP1, VP2, and VP3 of the AAV capsid protein comprise the amino acid substitution. In some instances, the corresponding parental AAV capsid or capsid protein is a native AAV9 VP1 capsid. In some instances, the native AAV capsid protein comprises an amino acid sequence provided in SEQ ID NO: 1. In some instances, the corresponding parental AAV capsid or capsid protein is a variant of AAV9 comprising an amino acid sequence provided in any one of SEQ ID NOS: 3-6.

In some instances, the rAAV capsids, or variant AAV capsid proteins, further comprise an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), at an amino acid position 588_589 within an amino acid sequence of the AAV capsid protein, wherein X is any amino acid other than V.

In some instances, the target tissue is a brain, and the rAAV capsids, or variant AVV capsid proteins, have the increased specificity for the brain, as compared to the corresponding parental AAV capsid or capsid protein. In some instances, the off-target tissue is a liver, and the rAAV capsid s, or variant AVV capsid proteins, have a decreased specificity for the liver, as compared to the corresponding parental AAV capsid or capsid protein. In some instances, the target tissue is a central nervous system (CNS), and the rAAV capsid s, or variant AVV capsid proteins, have an increased efficiency of viral transduction of at least 12-fold in the CNS, as compared to the corresponding parental AAV capsid or capsid protein. In some instances, the target tissue is a spinal cord, and the rAAV capsid s, or variant AVV capsid proteins, have an increased efficiency of viral transduction of at least 20-fold in the spinal cord, as compared to the corresponding parental AAV capsid or capsid protein. In some instances, the target tissue is a neuron, and the rAAV capsid s, or variant AVV capsid proteins, have an increased specificity for the neuron, as compared to the corresponding parental AAV capsid or capsid protein. In some instances, the off-target tissue is a liver, and the rAAV capsid s, or variant AVV capsid proteins, have a decreased efficiency of viral transduction of at least 50-fold in the liver, as compared to the corresponding parental AAV capsid or capsid protein. In some instances, the off-target tissue is a Purkinje cell, and the rAAV capsid s, or variant AVV capsid proteins, have a decreased efficiency of viral transduction of at least 4-fold in the Purkinje cell, as compared to the r corresponding parental AAV capsid or capsid protein. In some instances, the off-target tissue is a liver, and the rAAV capsid s, or variant AVV capsid proteins, have a decreased efficiency of viral transduction of at least 100-fold in the liver, as compared to the corresponding parental AAV capsid or capsid protein. In some instances, the rAAV capsids, or variant AVV capsid proteins, have described herein are isolated and purified. In some instances, the rAAV capsids or variant capsid proteins described herein are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient. In some instances, the pharmaceutical formulation is formulated for intravenous, intraarterial, intrathecal, or subcutaneous administration to treat a disease or a condition of the CNS or PNS.

Aspects disclosed herein provide recombinant AAV (rAAV) capsids comprising an variant AAV capsid proteins comprising at least four contiguous amino acids at amino acid positions corresponding to residues selected from the group consisting of 452-455, 453-456, 454-457, and 455-458 of an amino acid sequence of the AAV9 capsid protein according to VP1 numbering, conferring at least one of an increased specificity and an increased transduction efficiency for a target tissue in a subject, wherein: (a) an amino acid at amino acid position corresponding to residue 452 is selected from the group consisting of A, D, G, L, N, Q, S, and T; (b) an amino acid at amino acid position corresponding to residue 453 is selected from the group consisting of A, G, N, P, Q, R, S, and T; (c) an amino acid at amino acid position corresponding to residue 454 is selected from the group consisting of A, D, G, N, S, and T; (d) an amino acid at amino acid position corresponding to residue 455 is selected from the group consisting of A, D, G, K, N, P, Q, S, and T; (e) an amino acid at amino acid position corresponding to residue 456 is selected from the group consisting of A, G, K, N, P, R, S, and T; (f) an amino acid at amino acid position corresponding to residue 457 is selected from the group consisting of A, G, K, N, P, R, S, T, and V; and (g) an amino acid at amino acid position corresponding to residue 458 is selected from the group consisting of A, G, K, L, R, S, T, and V. In some instances, the AAV capsid protein does not contain at amino acid positions corresponding to residues selected from the group consisting of 452-455, 453-456, 454-457, and 455-458 of AAV9 VP1 an amino acid sequence ILGTGTS (SEQ ID NO: 45479), QSSQTPR (SEQ ID NO: 45480), or TLAVPFK (SEQ ID NO: 45477). In some instances, the amino acid substitution is at a three (3)-fold axis of symmetry of the rAAV capsid. In some instances, the specificity or the transduction efficiency is measured following systemically administration of the rAAV capsid to the subject. In some instances, systemic administration comprises intraarterial, intravenous, or subcutaneous, administration. In some instances, the rAAV capsid, or variant AAV capsid protein therein, is from AAV9. In some instances, the rAAV, or variant AAV protein comprises therein, confer an increase in a localization of the rAAV within the target tissue, as compared to the corresponding parental AAV capsid or capsid protein.

In some instances, the substitution comprises an amino acid sequence provided in FIG. 3. In some such instances, the at least four contiguous amino acids are provided in an amino acid sequence selected from the group consisting of LQTSSPG (SEQ ID NO: 2933), SINTKTN (SEQ ID NO: 45475), ERGANTK (SEQ ID NO: 5192), TTGGHSS (SEQ ID NO: 2743), GTTKTSE (SEQ ID NO: 3064), GTGTSVL (SEQ ID NO: 11958), and GTPSKAG (SEQ ID NO: 2741). In some instances, the substitution comprises an amino acid sequence provided in FIG. 2. In some such instances the at least four contiguous amino acids are provided in an amino acid sequence selected from the group consisting of QQGKQSV (SEQ ID NO: 79), SNGTKQT (SEQ ID NO: 442), GSGKTAA (SEQ ID NO: 88), MGDKPTR (SEQ ID NO: 2466), QPSGGNT (SEQ ID NO: 2672), and NQSGTKG (SEQ ID NO: 780). In some instances, the at least four contiguous amino acids are provided in an amino acid sequence selected from the group consisting of LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), and GTPSKAG (SEQ ID NO: 2741). In some instances, the at least four contiguous amino acids are provided in an amino acid sequence provided in Table 2. In some instances, the target tissue is a central nervous system (CNS). In some instances, the CNS comprises a region selected from the neocortex, the basal ganglia, the hippocampus, the thalamus, the cerebellum, the brain stem, and the spinal cord. In some embodiments, the target tissue is the peripheral nervous system (PNS). In some instances, the PNS comprises a ganglion. In some instances, the ganglion is a trigeminal or dorsal root ganglion. In some instances, the target tissue is a non-dividing cell. In some instances, the CNS comprises a cell selected from the group consisting of a neuron, an astrocyte, a microglial cell, an oligodendrocyte, and a Schwann cell. In some instances, the target tissue is a CNS, and the AAV capsid has an increased efficiency of viral transduction of at least 12-fold in the CNS, as compared to the parental AAV capsid or AAV capsid protein. In some instances, the target tissue is a brain, and the AAV capsid has the increased specificity for the brain, as compared to the parental AAV capsid or AAV capsid protein. In some instances, the target tissue is a spinal cord, and the AAV capsid has an increased efficiency of viral transduction of at least 20-fold in the spinal cord, as compared to the parental AAV capsid or AAV capsid protein. In some instances, the target tissue is a neuron, and the AAV capsid has an increased specificity for the neuron, as compared to the parental AAV capsid or AAV capsid protein. In some instances, the rAAV capsids, or variant AAV capsid proteins, described herein are isolated and purified. In some instances, the rAAV capsids, or variant AAV proteins, described herein are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient. In some instances, the pharmaceutical formulation is formulated for intravenous, intraarterial, intrathecal, or subcutaneous administration to treat a disease or a condition of the CNS or PNS.

Aspects disclosed herein provide rAAV capsids comprising AAV capsid proteins comprising at least four contiguous amino acids from an amino acid sequence provided in FIG. 2 or Table 2 at an amino acid position corresponding to residues selected from the group consisting of 452-455, 453-456, 454-457, and 455-458 of AAV9 VP1 conferring at least one of an increased specificity and an increased transduction efficiency when measured in a target tissue in a subject, as compared to a parental AAV capsid or capsid protein. In some instances, the at least four contiguous amino acids are at a three (3)-fold axis of symmetry of the rAAV capsid. In some instances, the AAV capsid protein does not contain at amino acid positions corresponding to residues selected from the group consisting of 452-455, 453-456, 454-457, and 455-458 of AAV9 VP1 an amino acid sequence ILGTGTS (SEQ ID NO: 45479), QSSQTPR (SEQ ID NO: 45480), or TLAVPFK (SEQ ID NO: 45477). In some instances, the specificity or the transduction efficiency is measured following systemically administration of the AAV capsid to the subject. In some instances, the rAAV capsid is chimeric. In some instances, the rAAV, or variant AAV protein comprises therein, confer an increase in a localization of the rAAV within the target tissue, as compared to the parental AAV capsid or capsid protein.

In some instances, the at least four contiguous amino acids comprise at least four, five, six, or seven contiguous amino acids in an amino acid sequence selected from the group consisting of LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), and GTPSKAG (SEQ ID NO: 2741)

In some instances, the target tissue is a central nervous system (CNS). In some instances, the CNS comprises a region selected from the neocortex, the basal ganglia, the hippocampus, the thalamus, the cerebellum, the brain stem, and the spinal cord. In some embodiments, the target tissue is the peripheral nervous system (PNS). In some instances, the PNS comprises a ganglion. In some instances, the ganglion is a trigeminal or dorsal root ganglion. In some instances, the target tissue is a non-dividing cell. In some instances, the CNS comprises a cell selected from the group consisting of a neuron, an astrocyte, a microglial cell, an oligodendrocyte, and a Schwann cell.

In some instances, the rAAV capsid, or variant AAV capsid protein comprised therein, further comprises an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), at an amino acid position corresponding to residues 588_589 in the amino acid sequence of AAV9 VP1, wherein X is any amino acid other than V. In some instances, the parental AAV capsid or capsid protein is AAV9. In some instances, the amino acid sequence of a AAV9 capsid protein is provided in SEQ ID NO: 1. In some instances, the amino acid sequence of the AAV9 capsid protein is provided in amino acid 217-736 within SEQ ID NO: 1

In some instances, the target tissue is a brain, and the rAAV capsid, or variant AAV capsid protein, has the increased specificity for the brain, as compared to the parental AAV capsid or capsid protein. In some instances, the target tissue is the CNS, and the rAAV capsid, or variant AAV capsid protein, has an increased efficiency of viral transduction of at least 12-fold in the CNS, as compared to the parental AAV capsid or capsid protein. In some instances, the target tissue is a spinal cord, and the rAAV capsid, or variant AAV capsid protein, has an increased efficiency of viral transduction of at least 20-fold in the spinal cord, as compared to the parental AAV capsid or capsid protein. In some instances, the target tissue is a neuron, and the rAAV capsid, or variant AAV capsid protein, has an increased specificity for the neuron, as compared to the parental AAV capsid or capsid protein. In some instances, the rAAV capsids, or variant AAV capsid proteins, described herein are isolated and purified. In some instances, the rAAV capsids, or variant AAV capsid proteins, described herein are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient.

Aspects provided herein provide rAAV capsids comprising variant AAV capsid proteins, the rAAV capsids having at least one of an increased specificity and increased transduction efficiency when measured in a target tissue of a subject relative to a corresponding parental AAV capsid or capsid protein, the AAV capsid protein comprising three amino acids (X1-X2-X3) at an amino acid position corresponding to residues selected from the group consisting of 452-454, 453-455, 454-456, 455-457, and 456-458 in AAV9 VP1, wherein: (a) X1 is selected from the group consisting of N, K, R, L, and T; (b) X2 is selected from the group consisting of N, S, L, E, D, and P; and (c) X3 is selected from the group consisting of N, S, A, D, G, L, and T. In some instances, the target tissue is selected from the group consisting of a lung, a heart, an intestine, a kidney, and a stomach. In some instances, the target tissue is a non-dividing cell. In some instances, the tissue is the lung and the amino acid sequence is KDNTPGR (SEQ ID NO: 32538), or any amino acid sequence provided in FIG. 13. In some instances, the tissue is the lung and the amino acid sequence is NNLPRNL (SEQ ID NO: 32867), or any amino acid sequence provided in FIG. 13. In some instances, the tissue is an intestine and the amino acid sequence is RESSPSL (SEQ ID NO: 29065), or any amino acid sequence provided in FIG. 5. In some instances, the tissue is the kidney and the amino acid sequence is RVPLSTI (SEQ ID NO: 26933), or any amino acid sequence provided in FIG. 6. In some instances, the AAV capsid protein is an AAV9 capsid protein. In some instances, the AAV9 capsid protein is provided in SEQ ID NO: 1. In some instances, the AAV capsid protein further comprises four amino acids at an amino acid position selected from the group consisting of 452-455, 453-456, 454-457, and 455-458, wherein X4 is selected from the group consisting of T, S, P, and L. In some instances, the AAV capsid protein further comprises five amino acids at an amino acid position selected from the group consisting of 452-456, 453-457, and 453-458, wherein X5 is selected from the group consisting of P, R, and S. In some instances, the AAV capsid protein further comprises six amino acids at an amino acid position 452-457 or 453-458, wherein X6 is selected from the group consisting of N, G, S, and T. In some instances, the AAV capsid protein further comprises seven amino acids at an amino acid position 452-458, wherein X7 is selected from the group consisting of R, L, and I. In some instances, VP1, VP2, and VP3 of the AAV capsid protein comprise the amino acid sequence. In some instances, the corresponding parental AAV capsid is a native AAV9 capsid. In some instances, an amino acid sequence of the VP1 protein of the native AAV9 capsid is provided in SEQ ID NO: 1. In some instances, the corresponding parental AAV is a native AAV5 capsid. In some instances, an amino acid sequence of the VP1 protein of the native AAV5 capsid is provided in SEQ ID NO: 2.

In some instances, the rAAV, or variant AAV capsid proteins described herein, have at least one of the increased specificity and increased transduction efficiency for a target tissue when measured in a subject as compared to the corresponding parental AAV capsid or capsid protein. In some instances, the target tissue is a lung cell-type that is an alveolar type II epithelial (ATII) cell, and the rAAV capsid, or variant AAV capsid, has an increased efficiency of viral transduction of at least 60-fold in the ATII cell, as compared to a parental AAV capsid or capsid protein. In some instances, the target tissue is a lung cell-type that is an ATII cell, and the rAAV capsid, or variant AAV capsid, has an increased efficiency of viral transduction of at least 60-fold in the ATII cell, as compared to the parental AAV capsid or capsid protein. In some instances, the rAAV capsid, or variant AAV capsid, has an increased efficiency of viral transduction of at least 15-fold in the lung, as compared to the parental AAV capsid or capsid protein. In some instances, the rAAV capsid, or variant AAV capsid, has an increased efficiency of viral transduction of at least 30-fold in the lung, as compared to the parental AAV capsid or capsid protein. Also envisioned are AAV capsids comprising these AAV capsid proteins. In some instances, the rAAV capsids, or variant AAV capsids, described herein are isolated and purified. In some instances, the rAAV capsids, or variant AAV capsids, described herein are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient. In some instances, the pharmaceutical formulation is formulated for intravenous, intraarterial, subcutaneous, or intranasal administration to treat a disease or a condition of the target tissue.

Aspects disclosed herein provide rAAV capsids comprising variant AAV capsid proteins comprising three amino acids at an amino acid position corresponding to residues selected from the group consisting of 452-454, 453-455, 454-456, 455-457, and 456-458 in AAV9 VP1, wherein the three amino acids are provided in an amino acid sequence is provided in one or more of FIG. 4-FIG. 14. In some instances, the rAAV capsid or variant AAV capsid proteins, have at least one of an increased specificity and increased transduction efficiency when measured in a target tissue in a subject. In some instances, the target tissue is selected from the group consisting of a lung, an intestine, a liver, a stomach, a heart, a muscle, an adipose tissue, a spleen, a kidney, or reproductive organs (e.g., testis, ovaries). In some instances, the target tissue is a non-dividing cell. In some instances, the amino acid sequence is provided in FIG. 4. In some instances, the amino acid sequence is provided in FIG. 5. In some instances, the amino acid sequence is provided in FIG. 6. In some instances, the amino acid sequence is provided in FIG. 7. In some instances, the amino acid sequence is provided in FIG. 8. In some instances, the amino acid sequence is provided in FIG. 9. In some instances, the amino acid sequence is provided in FIG. 10. In some instances, the amino acid sequence is provided in FIG. 11. In some instances, the amino acid sequence is provided in FIG. 12. In some instances, the amino acid sequence is provided in FIG. 13. In some instances, the amino acid sequence is provided in FIG. 14. In some instances, the rAAV, or variant AAV protein comprises therein, confer an increase in a localization of the rAAV within the target tissue, as compared to the parental AAV capsid or capsid protein.

In some instances, the parental AAV capsid a native AAV9. In some instances, an amino acid sequence of a VP1 protein of the native AAV9 capsid protein is provided in SEQ ID NO: 1.

In some instances, the three amino acids further comprises four amino acids at an amino acid position corresponding to residues selected from the group consisting of 452-455, 453-456, 454-457, and 455-458 of AAV9 VP1, wherein the amino acid sequence is provided in one or more of FIG. 4-FIG. 14. In some instances, the three amino acids comprises five amino acids at an amino acid position corresponding to residues selected from the group consisting of 452-456, 453-457, and 453-458 of AAV9 VP1, wherein the amino acid sequence is provided in one or more of FIG. 4-FIG. 14. In some instances, the three amino acids further comprises six amino acids at an amino acid position corresponding to residues 452-457 or 453-458, wherein the amino acid sequence is provided in one or more of FIG. 4-FIG. 14. In some instances, the three amino acids further comprises seven amino acids at an amino acid position corresponding to residues 452-458, wherein the amino acid sequence is provided in one or more of FIG. 4-FIG. 14. In some instances, VP1, VP2, and VP3 of the rAAV capsid comprise the amino acid sequence. In some instances, the rAAV capsid, or variant AAV capsid proteins, described herein are isolated and purified. In some instances, the AAV capsids, or variant AAV capsid proteins described herein, are formulated as a pharmaceutical formulation further comprising a pharmaceutically acceptable carrier. In some instances, the pharmaceutical formulation further comprises a heterologous nucleic acid encoding a therapeutic gene expression product. In some instances, the pharmaceutical formulation further comprises a pharmaceutical excipient. In some instances, the pharmaceutical formulation is formulated for intravenous, intraarterial, subcutaneous, or intranasal administration to treat a disease or a condition of the target tissue.

Aspects disclosed herein provide methods of treating a disease or condition in a subject comprising administering to the subject a therapeutically effective amount of a composition comprising the rAAV capsids disclosed herein, the rAAV capsid encapsidating a nucleic acid sequence encoding a therapeutic gene expression product. In some instances, the mammalian subject is a primate. In some instances, the mammalian subject is a non-human primate. In some instances, the mammalian subject is a human. In some instances, the therapeutic gene expression product is a protein. In other instances, the therapeutic gene expression product is an RNA, e.g. a small interfering RNA (siRNA), a short hairpin RNA (shRNA), or a microRNA (miRNA). In some instances, the administering comprises intravenous or intranasal administration. In some instances, the disease or condition is a disease or condition of the central nervous system or peripheral nervous system. In some instances, the disease or condition is a disease or condition of the CNS or PNS. In some instances, the disease or condition is selected from the group consisting of Adrenoleukodystrophy, Alzheimer's disease, Amyotrophic lateral sclerosis, Angelman syndrome, Ataxia telangiectasia, Charcot-Marie-Tooth syndrome, classical rhizomelic chondrodysplasia punctata (RCDP), Cockayne syndrome, Deafness, Dravet Syndrome, Duchenne muscular dystrophy, Epilepsy, Essential tremor, Fragile X syndrome, Friedreich's ataxia, Frontotemporal dementia (FTD), Gaucher disease, glioblastoma, Huntington disease, infantile Refsum disease (IRD), Lesch-Nyhan syndrome, Maple syrup urine disease, Menkes syndrome, Myotonic dystrophy, Narcolepsy, Neurofibromatosis, Niemann-Pick disease, Parkinson disease, Phenylketonuria, Prader-Willi syndrome, Refsum disease, Rett syndrome, Spinal muscular atrophy, Spinocerebellar ataxia, Tangier disease, Tay-Sachs disease, Tuberous sclerosis, Von Hippel-Lindau syndrome, Williams syndrome, Wilson's disease, and Zellweger syndrome. In some instances, the therapeutic gene expression product is effective to modulate an activity or an expression of a target gene or gene expression product selected from the group consisting of Sarcoglycan Alpha (SGCA), glutamic acid decarboxylase 65 (GAD65), glutamic acid decarboxylase 67 (GAD67), CLN2, Nerve Growth Factor (NGF), Survival Of Motor Neuron 1, Telomeric (SMN1), Factor X (FIX), Retinoid Isomerohydrolase (RPE65), sarco/endoplasmic reticulum Ca2+-ATPase (SERCA2a), β-Glucocerebrosidase (GCase), Frataxin (FXN), Huntingtin (HTN), methyl-CpG binding protein 2 (MECP2), a peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and a NLRP3 inflammasome. In some instances, the therapeutic gene expression product comprises gene editing components. In some instances, the gene editing components are selected from the group consisting of, an artificial site-specific RNA endonuclease (ASRE), a zinc finger endonuclease (ZFN), a transcription factor like effector nuclease (TALEN), a clustered regularly interspaced short palindromic repeats (CRISPR)/Cas enzyme, and a CRISPR)/Cas guide RNA.

Aspects disclosed herein comprise plasmid vectors comprising a nucleic acid sequence encoding the AAV capsids described herein. In some instances, the plasmid vector is bacterial. In some instances, the plasmid vector is derived from *Escherichia coli*. In some instances, the nucleic acid sequence comprises, in a 5' to 3' direction: (1) a 5' inverted terminal repeat (ITR) sequence, (2) a Replication (Rep) gene, (3) a Capsid (Cap) gene, and (4) a 3' ITR, wherein the Cap gene encodes the AAV capsid protein described herein. In some instances, the plasmid vector encodes a pseudotyped AAV capsid protein. In some instances, the Cap gene is derived from the deoxyribose nucleic acid (DNA) provided in any one of SEQ ID NOs: 6-10. In some instances, the nucleic acid sequence comprising the Cap gene is at least 90%, 91%, 92%, 93%, 94%, 95%, 96%, 97%, 98%, 99%, or 100% identical to any one of the DNA sequences provided in SEQ ID NOS: 46364-46383. In some instances, the 5' ITR and the 3' ITR are derived from an AAV2 serotype. In some instances, the 5' ITR and the 3' ITR are derived from an AAV5 serotype. In some instances, the 5' ITR and the 3' ITR are derived from an AAV9 serotype.

Aspects disclosed herein provide methods of manufacturing comprising: (a) introducing into a cell a nucleic acid comprising: (i) a first nucleic acid sequence encoding a therapeutic gene expression product, flanked by at its 5' and 3' ends by inverted terminal repeat (ITR) sequences; (ii) a second nucleic acid sequence encoding a viral genome comprising a 5' ITR sequence, a Replication (Rep) gene, Capsid (Cap) gene, and a 3' ITR, wherein the Cap gene encodes the AAV capsid protein described herein; and (iii) a third nucleic acid sequence encoding a first helper virus protein selected from the group consisting of E4orf6, E2a, and VA RNA, and optionally, a second helper virus protein comprising E1a or E1b55k; (b) expressing in the cell the AAV capsid protein described herein; (c) assembling an AAV particle comprising the AAV capsid proteins disclosed herein; and (d) packaging the first nucleic acid sequence in the AAV particle. In some instances, the nucleic acid is comprised by a plasmid and the cell is mammalian. In some instances, the cell is immortalized. In some instances, the immortalized cell is an embryonic stem cell. In some instances, the embryonic stem cell is a human embryonic stem cell. In certain instances, the human embryonic stem cell is a human embryonic kidney 293 (HEK-293) cell. In other instances, the nucleic acid is comprised by a virus, e.g. a baculovirus. In some such instances, the cell is an insect cell. In certain such instances, the cell is an SF9 cell. In some instances, the Cap gene is derived from the deoxyribose nucleic acid (DNA) provided in any one of SEQ ID NOs: 6-10. In some instances, the nucleic acid sequence comprising the Cap gene is at least 90%, 91%, 92%, 93%, 94%, 95%, 96%, 97%, 98%, 99%, or 100% identical to any one of the DNA sequences provided in SEQ ID NOS: 46364-46383. In some instances, the 5' ITR and the 3' ITR are derived from an AAV2 serotype. In some instances, the 5' ITR and the 3' ITR are derived from an AAV5 serotype. In some instances, the 5' ITR and the 3' ITR are derived from an AAV9 serotype. In some instances, the first nucleic acid sequence (encoding a therapeutic gene expression product) and the second nucleic acid sequence (encoding the cap gene) are in trans. In some instances, the first nucleic acid sequence and the second nucleic acid sequence are in cis. In some instances, the first nucleic acid sequence, the second nucleic acid sequence and the third nucleic acid sequence (encoding the helper virus), are in trans.

Aspects disclosed herein provide kits comprising: (a) a first vector comprising a first nucleic acid sequence encoding a viral genome comprising in a 5' to 3' direction: (i) a 5' inverted terminal repeat (ITR) sequence; (ii) a Replication (Rep) gene; (iii) a Capsid (Cap) gene encoding the AAV capsid proteins described herein, and (iv) a 3' ITR; and (b) optionally, a second vector comprising a second nucleic acid sequence encoding a helper virus protein comprising at least one of E4orf6, E2a, VA RNA, E1a and E1b55k. In some instances, the kit further comprises a cell. In some instances, the cell is mammalian. In some instances, the cell is immortalized. In some instances, the immortalized cell is an embryonic stem cell. In some instances, the embryonic stem cell is a human embryonic stem cell. In some instances, the human embryonic stem cell is a human embryonic kidney 293 (HEK-293) cell. In some instances, the kit further comprises a vector comprising a heterologous nucleic acid encoding a therapeutic gene expression product. In some instances, the vector is an episome.

INCORPORATE BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE FIGURES

The embodiments are set forth with particularity in the appended claims. A better understanding of the features and advantages of the present invention will be obtained by reference to the following detailed description that sets forth illustrative embodiments, in which the principles of the invention are utilized, and the accompanying drawings. It is emphasized that, according to common practice, the various features of the drawings are not to-scale. On the contrary, the dimensions of the various features are arbitrarily expanded or reduced for clarity. Included in the drawings are the following figures:

FIG. 1A shows a surface model of three monomers comprising the 3-fold symmetry of AAV9 (circled), illustrating the location of the 7 amino acid substitution introduced in this library at amino acids 452-458, and the 2 amino acid substitution and 7 amino acid insertion introduced by AAV-PHP.eB previously at amino acids 588-589. FIG. 1B shows the position of the two loops within a single AAV9 monomer, indicating the proximity of the loops and their relation to the capsid surface (AAV interior is down, exterior is up). FIG. 1C shows the spike created by the 588 (left) and 455 (right) loops of one AAV9 monomer interacting with the 495 (middle) loop of a second monomer. FIG. 1D shows a schematic of the engineering process ("TATT NNKNNK . . . NNKNNK CAAC" disclosed as SEQ ID NOS 45492-45493 and "TATT AACGGT . . . AATCAA CAAC" disclosed as SEQ ID NOS 45494-45495). Using PCR, diversity is introduced in the form of a 9-amino acid substitution/insertion (AAV-PHP.eB) and/or substitution (AA 452-458) in the rAAV9 genome, which harbors a Cre inducible switch surrounding the polyadenylation sequence. The DNA capsid library is transfected into HEK-293T cells, and diverse viral capsid libraries are harvested 60 hours later. The viral library is systemically injected into a panel of Cre-transgenic animals Following three weeks of expression, tissue is harvested, and DNA extracted from all organs. Using PCR, sequences are selectively recovered from only those capsids which transduced Cre+ cells, flipping their polyadenylation sequence. The recovered sequences are subsequently prepared for next generation sequencing (NGS) by PCR, adding dual-index barcodes unique to each specific Cre− tissue combination. Following NGS, the data is mined using positive and negative selection for enrichment (increased prevalence within a specific tissue compared to other sequences, normalized to their presence in the injected viral library) and specificity (increased prevalence within a specific tissue or cell type compared to other tissues or cell types). After one to two rounds of selection, individual variants are tested based on their enrichment and specificity scores. Sequence in italics represents AAV9, which is highly enriched in liver (right) but not in brain (left).

FIG. 2 shows 7-mer variant AAV capsid amino acid sequences and DNA sequences encoding the 7-mer variant AAV capsid amino acid sequences positively enriched in the central nervous system (CNS) after two rounds of in vivo selection.

FIG. 3 shows 7-mer variant AAV capsid amino acid sequences and DNA sequences encoding the 7-mer variant AAV capsid amino acid sequences with a tropism specific to the CNS, and that detarget the liver, after two rounds of in vivo selection. "Enrichment" is the prevalence of a given variant in the tissue compared to its prevalence in the viral library that was administered to the transgenic animal. An enrichment score of above 1 indicates a positive enrichment; and an enrichment score below 0 indicates negative enrichment. An enrichment score of 0 indicates that the variant could not be detected in the tissue.

FIG. 4 shows 7-mer variant AAV capsid amino acid sequences and DNA sequences encoding the 7-mer variant AAV capsid amino acid sequences with a tropism specific to the heart after two rounds of in vivo selection.

FIG. 5 shows 7-mer variant AAV capsid amino acid sequences and DNA sequences encoding the 7-mer variant AAV capsid amino acid sequences with a tropism specific to the intestine after two rounds of in vivo selection.

FIG. 6 shows 7-mer variant AAV capsid amino acid sequences and DNA sequences encoding the 7-mer variant AAV capsid amino acid sequences with a tropism specific to the kidney after two rounds of in vivo selection.

FIG. 7 shows 7-mer variant AAV capsid amino acid sequences and DNA sequences encoding the 7-mer variant AAV capsid amino acid sequences with a tropism specific to the liver after two rounds of in vivo selection.

FIG. 8 shows 7-mer variant AAV capsid amino acid sequences and DNA sequences encoding the 7-mer variant AAV capsid amino acid sequences with a tropism specific to muscle after two rounds of in vivo selection.

FIG. 9 shows 7-mer variant AAV capsid amino acid sequences and DNA sequences encoding the 7-mer variant AAV capsid amino acid sequences with a tropism specific to the pancreas after two rounds of in vivo selection.

FIG. 10 shows 7-mer variant AAV capsid amino acid sequences and DNA sequences encoding the 7-mer variant AAV capsid amino acid sequences with a tropism specific to the spleen after two rounds of in vivo selection.

FIG. 11 shows 7-mer variant AAV capsid amino acid sequences and DNA sequences encoding the 7-mer variant AAV capsid amino acid sequences with a tropism specific to the stomach after two rounds of in vivo selection.

FIG. 12 shows 7-mer variant AAV capsid amino acid sequences and DNA sequences encoding the 7-mer variant AAV capsid amino acid sequences with a tropism specific to the testicle after two rounds of in vivo selection.

FIG. 13 shows 7-mer variant AAV capsid amino acid sequences and DNA sequences encoding the 7-mer variant AAV capsid amino acid sequences with a tropism specific to lung after two rounds of in vivo selection.

FIG. 14 shows 7-mer variant AAV capsid amino acid sequences and DNA sequences encoding the 7-mer variant AAV capsid amino acid sequences with a tropism specific to adipose tissue after two rounds of in vivo selection.

FIG. 15A shows the relative abundance in log enrichment of two candidate variants, AAV.CAP-A4 and AAV.CAP-A14, and a randomly chosen variant. The NGS data shows significant enrichment of AAV.CAP-A4 in the lung, with negative enrichment in several peripheral organs. Conversely, AAV.CAP-A14 is enriched in neurons within the stomach and intestine, and negatively enriched in other organs like the lung. FIG. 15B shows In vivo transduction 2 weeks after systemic administration of $5\times10^{11}$ vg of rAAV: CAG-mNeonGreen confirms the NGS data from in 2A, with AAV.CAP-A4 strongly transducing the lung when compared to AAV9, and AAV.CAP-A14 more strongly transducing neurons in the stomach and intestine. For the avoidance of doubt, AAV.CAP-A4 is KDNTPGR, which is provided in SEQ ID NO: 32538 (enrichment in the lung), SEQ ID NO: 25633 (enrichment in the heart), SEQ ID NO: 26584 (enrichment in the intestine), and SEQ ID NO: 28509 (enrichment in the kidney). AAV.CAP-A14 is RESSPSL, which is provided in SEQ ID NO: 26474 (enrichment in the intestine), SEQ ID NO: 29065 (enrichment in the kidney), and SEQ ID NO: 31904 (enrichment in the stomach).

FIG. 16A provides a comparison of the total number of cells transduced by AAV.CAP-A4, compared to its parents capsid AAV9. FIG. 16B shows overall transduction, as assessed by EGFP expression, is increased 15-30 fold compared to AAV5 and AAV9. FIG. 16C provides a cell-type specific quantification, as assessed by colocalization of EGFP signal with antibody staining and shows that AAV.CAP-A4 transduction of ATII cells is increased 30-60 fold compared to AAV5 and AAV9 (respectively). A significant number of the cells transduced by AAV.CAP-A4 are alveolar type II pneumocytes. FIG. 16D shows quantification of cell-type specificity with 60% of cells transduced in the lung identified as ATII cells. For quantification: n=3 mice per group for AAV9, AAV5 and AAV.CAP-A4, mean±SE, one-way ANOVA (*P≤0.05; n.s., P≥0.05). Scale bars are 50 µm.

FIG. 17A-17E show the characterization of the 7 amino acid (AA) substitution library in AAV-PHP.eB. FIG. 17A shows the distribution across the 7 amino acid substitution in AAV-PHP.eB, showing a relatively uniform distribution (with a few notable exceptions) a low prevalence of stop codons, and no bias towards the wildtype (WT) AAV9 sequence (NGSGQNQ (SEQ ID NO: 545)) following PCR generation of the DNA library and packaging of the viral capsid library. FIG. 17B shows a subset of the top performing variants (SEQ ID NOS: 45496-45513), respectively, in order of appearance) obtained from two rounds of positive and negative selection, showing a strong divergence from the WT AAV9 sequence. TI: threonine and isoleucine residues present at positions 450-451; QT: glutamine and threonine residues present at positions 459-460. FIG. 17C shows a heat map plotting the log-enrichment scores of a subset of the top performers, demonstrating specificity for, and enrichment in, neuronal populations, a target for which AAV-PHP.eB is already biased towards. FIG. 17D shows ssAAV9:CAG-mNeonGreen, ssAAV-PHP.eB:CAG-mNeonGreen, ssAAV.CAP-B1:CAG-mNeonGreen (LQTSSPG; SEQ ID NO: 2933), ssAAV.CAP-B2:CAG-mNeonGreen (QQGKQSV; SEQ ID NO: 79), ssAAV.CAP-B4:CAG-mNeonGreen (SINTKTN; SEQ ID NO: 45475), and ssAAV.CAP-B7:CAG-mNeonGreen (SNGTKQT; SEQ ID NO: 442) was intravenously injected into male adult mice at $5\times10^{11}$ vg/mouse and mNeonGreen fluorescence assessed after two weeks. FIG. 17E shows ssAAV.CAP-B8: CAG-mNeonGreen (GSGKTAA; SEQ ID NO: 88), ssAAV.CAP-B9:CAG-mNeonGreen (MGDKPTR; SEQ ID NO: 2466), ssAAV.CAP-B10:CAG-mNeonGreen (DGAATKN; SEQ ID NO: 3943), ssAAV.CAP-B11:CAG-mNeonGreen (QPSGGNT; SEQ ID NO: 2672), ssAAV.CAP-B14:CAG-mNeonGreen (ERGANTK; SEQ ID NO: 5192), ssAAV.CAP-B16:CAG-mNeonGreen (TTGGHSS; SEQ ID NO: 2743), ssAAV.CAP-B17:CAG-mNeonGreen (GTTKTSE; SEQ ID NO: 3064), ssAAV.CAP-B18:CAG-mNeonGreen (GTGTSVL; SEQ ID NO: 11958), ssAAV.CAP-B19:CAG-mNeonGreen (NQSGTKG; SEQ ID NO: 780), ssAAV.CAP-B22:CAG-mNeonGreen (DGQSSKS; SEQ ID NO: 2764), ssAAV.CAP-B23:CAG-mNeonGreen (KGPGQMG; SEQ ID NO: 45476), or ssAAV.CAP-B25:CAG-mNeonGreen (GTPSKAG; SEQ ID NO: 2741) was intravenously injected into male adult mice at $5 \times 10^{11}$ vg/mouse and mNeonGreen fluorescence assessed after two weeks. In FIG. 17D and FIG. 17E, direct comparison of the transduction profiles of the top performing variants shows a strong correlation between validated tropisms, and those predicted by the NGS data. Scale bars are 2 mm.

FIG. 18A-18D shows the tropism of AAV.CAP-B10 is strongly biased towards the brain, with significant liver detargeting. ssAAV9:CAG-NLSx2-EGFP, ssAAV-PHP.eB:CAG-NLSx2-EGFP or ssAAV.CAP-B10:CAG-NLSx2-EGFP was intravenously injected into male adult mice at $1 \times 10^{11}$ vg/mouse. GFP fluorescence was assessed after three weeks of expression. FIG. 18A shows a comparison of BBB crossing and brain transduction in AAV9, AAV-PHP.eB, and AAV.CAP-B10, showing a progressive increase in transduction efficiency in the brain following iterative engineering of the WT capsid. FIG. 18B shows the same comparison in the livers, showing a progressive decrease in transduction efficiency. FIG. 18C provides quantification of the total number of cells transduced in the brain, and shows a non-significant increase in total transduction for AAV.CAP-B10 compared to AAV-PHP.eB, both of which are significantly increased compared to AAV9. Comparison of the average brightness per cell shows a significant increase of AAV.CAP-B10 over AAV9 but not over AAV-PHP.eB. FIG. 18D provides quantification of the total number of cells transduced in the liver, and shows a significant decrease comparing AAV.CAP-B10 to both AAV9 and AAV-PHP.eB. Brightness per cell is also significant decreased when comparing AAV.CAP-B10 and AAV9, with no significant difference observed with AAV-PHP.eB. For quantification: n=6 mice per group, mean±SE, Brown-Forsythe and Welch ANOVA tests for transduction and Kruskal-Wallis test for brightness (*$P \leq 0.05$; n.s., $P \geq 0.05$). Scale bars are 1 mm.

FIG. 19A-19B shows that across multiple brain regions, AAV.CAP-B10 showed non-significant increases in the total number of neurons transduced compared to AAV-PHP.eB. FIG. 19C-19D shows that AAV.CAP-B10 shows significantly reduced transduction of astrocytes across all brain regions quantified compared to AAV-PHP.eB. FIG. 19E-19F shows that AAV.CAP-B10 shows significantly reduced transduction of oligodendrocytes across all brain regions quantified compared to AAV-PHP.eB. For quantification: n=6 mice per group, mean±SE, Mann-Whitney test (*$P \leq 0.05$; n.s., $P \geq 0.05$). Scale bars are 200 μm.

FIG. 20A-20C shows the amino-acid contribution across the 7-mer substitution to variants enriched in the brain and detargeted from the liver. FIG. 20A shows the amino acid contribution across the 7-mer substitution to variants enriched in the brain. FIG. 20B shows the amino acid contribution across the 7-mer substitution to variants negatively enriched (de-targeted) from the liver. FIG. 20C shows the amino acid contribution across the 7-mer substitution to variants enriched in the brain and negatively enriched (de-targeted) from the liver. The 1000 variants with highest enrichment in the brain of hSyn-Cre animals, the 1000 variants with lowest enrichment in the liver of Tek-Cre animals, and all variants with positive enrichment in the brain and negative enrichment in the liver were analyzed. Plotted is the z-score of all amino acids at each position.

FIG. 22A shows immunofluorescence in cerebellum sections. FIG. 22B shows quantification of purkinje cell transduction in the cerebellum, and shows significantly fewer purkinje cells transduced by AAV.CAP-B10 when compared to AAV-PHP.eB. For quantification: n=6 mice per group, mean±SE, Mann-Whitney test (*$P \leq 0.05$; n.s., $P \geq 0.05$). Scale bar is 200 μm.

FIG. 23A-23F shows the characterization of pooled expression in non-human primates. FIG. 23A shows the experimental paradigm for pooled injection of the novel variants AAV.CAP-B1, AAV.CAP-B2, AAV.CAP-B8, AAV.CAP-B10, AAV.CAP-B18 and AAV.CAP-B22 and controls AAV9 and AAV-PHP.eB. Human FXN fused to an HA tag is packaged in each variant under control of the ubiquitous CAG promoter, with a unique 12 bp RNA barcode in the 5' UTR differentiating each variant. Two marmosets were injected at a dose of 1.2×10^14 vg/kg, of which ⅛ was contributed by each variant in the pool. FIG. 23B shows six sections distributed through the anterior-posterior axis and cerebellum of the marmoset brain. Counter-staining for the HA tag on the FXN transgene show robust expression distributed throughout the brain following IV administration of the pool of variants. FIG. 23C shows NGS quantification of RNA barcode expression from two marmosets for each of the 8 variants in the pool, showing a dramatic increase for several variants, including >12-fold increase in RNA levels of AAV.CAP-B22 and >5-fold increase for AAV.CAP-B10 compared to AAV9. FIG. 23D shows zoomed-in frames from a variety of cortical and sub-cortical regions shows significant and broad transduction across most brain regions, including cortex, hippocampus, and cerebellum. FIG. 23E shows counter-staining for the HA tag in the liver, revealing low overall transduction from the viral pool. NGS quantification shows relative detargeting from the liver, with AAV.CAP-B22 contributing similar RNA levels to AAV9, and AAV.CAP-B10 contributing >5-fold less. FIG. 23F shows that transduction of the heart is increased from AAV9 for several of the variants with AAV.CAP-B22 contributing almost 5-fold more RNA in comparison. Transduction of the adrenal cortex by the variants was varied in comparison with AAV9. RNA was collected from two animals for analysis of liver transduction, and one animal for heart and adrenal transduction.

DETAILED DESCRIPTION OF THE DISCLOSURE

Figure 1B:
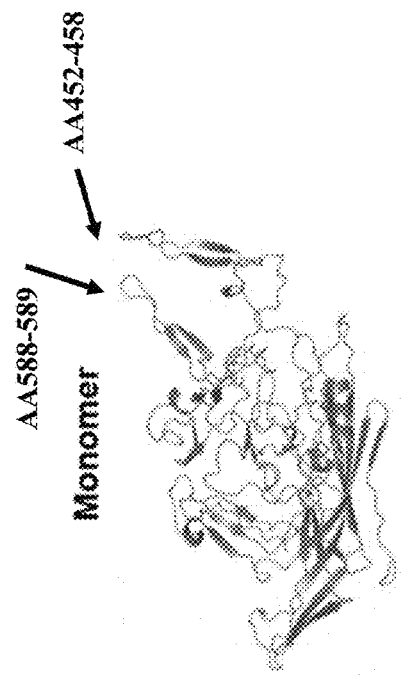
FIG. 1A-1D show a viral engineering overview according to the present embodiments.
Figure 1A:
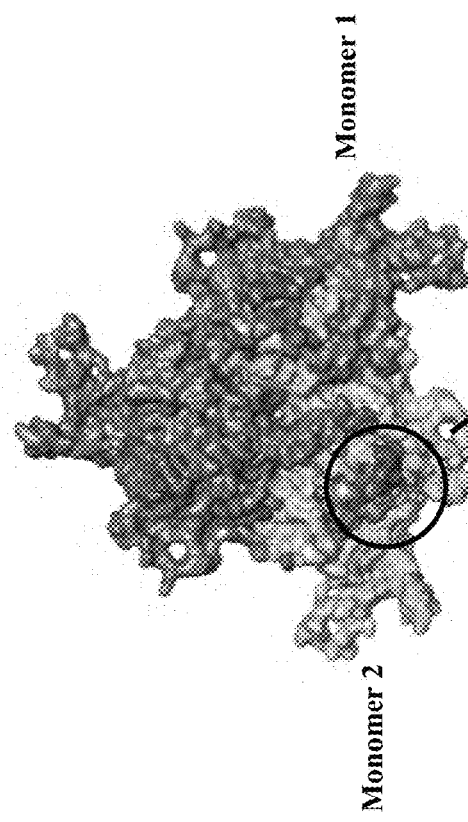
Figure 1C:
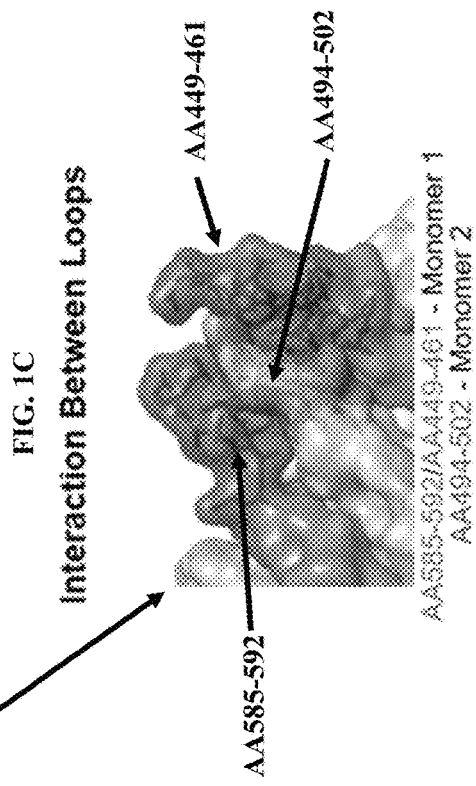
Figure 1D:
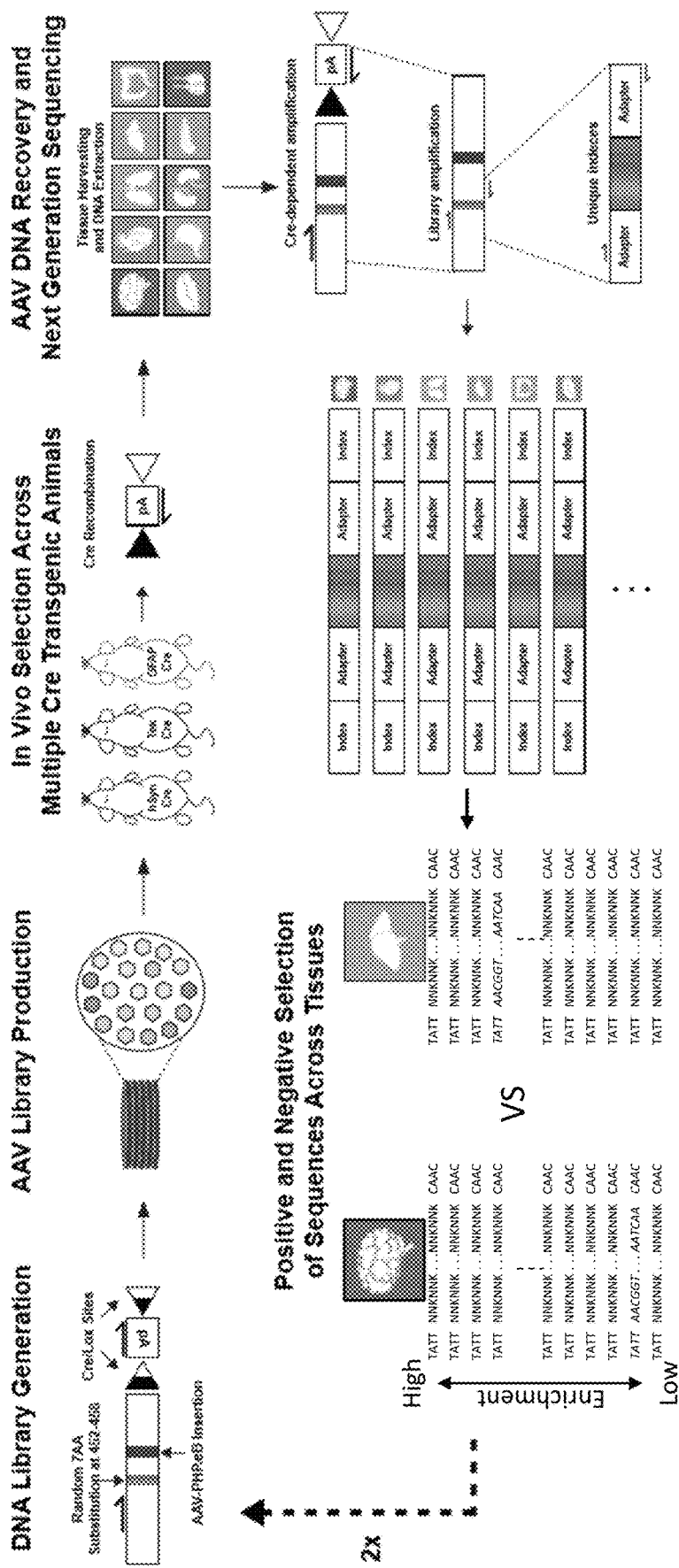

Provided herein are modified adeno-associated (AAV) virus capsid protein compositions useful for integrating a transgene into a target cell or environment (e.g., a cell-type or tissue) in a subject when they are administered to the subject. The modified AAV capsid proteins of the present disclosure comprise at least one insertion or substitution of an amino acid in a corresponding parental AAV capsid protein that confers a desired tropism such as an increased or decreased specificity as compared to a reference AAV capsid protein, e.g. the corresponding unmodified parental capsid protein, or increased or decreased transgene transduction efficiency as compared to a reference AAV capsid protein, e.g. the corresponding unmodified parental capsid protein.

The most commonly manipulated loop in AAVs is the 588 loop, due to it being the site of heparan sulfate binding of AAV2 and amenable to peptide display. The only known receptor for AAV9 is N-linked terminal galactose, but many indications point toward there being others. Although modifications to AAV9 588 loop have been shown to confer an increased specificity and transgene transduction efficiency in target in vivo environments as compared to a correspond parental AAV capsid protein in rodent models, these desired tropisms do not translate in non-human primate models, rendering them of limited value to treat human disease. Non-limiting examples of modified AAV capsid proteins include AAV-PHP.B, AAV-PHP.eB, AAV-PHP.S, and AAV-PHP.

Disclosed herein are modified AAV capsid proteins with desired tropisms observed in both rodent and non-human primate models of human disease that comprise an insertion or a substitution of at least one amino acid relative to the corresponding parental AAV capsid protein, that insertion or substitution residing in the loop corresponding to the amino acid 455 loop (AA455 loop) of AAV9. The AA455 loop is the furthest protruding from the surface of the capsid and has been implicated in neutralizing antibody binding. The AA455 loop is believed to play a significant role in cell-surface receptor binding, either on its own or by interaction with the 588 loop. In some cases, the parental AAV capsid protein is AAV5, AAV9, or a previously modified AAV5 or AAV9 (e.g., AAV-PHP.eB, AAV-PHP.B, and the like).

The most common method of AAV-mediated transgene delivery is by direct injection to the target in vivo environment, which is disadvantageous for many reasons, including risk of injury or death, pain, and higher cost, as compared to less invasive methods. Previous AAV-mediated delivery by intravenous administration avoids a need for a direct injection, but suffers from reduced specificity and transduction efficiency for the target in vivo environment resulting in off-target transduction events and necessitating a larger viral load to achieve sufficient therapeutic levels in the target in vivo environment. This is especially evident when the AAV must cross the blood brain barrier (BBB) or the epithelial lining to reach the target in vivo environment, such as to treat a disease or condition of the central nervous system (CNS) and the lung.

Disclosed herein are methods comprising systemically administering a modified AAV capsid of the present disclosure encapsidating a viral vector comprising a transgene (e.g., therapeutic nucleic acid) with an increased specificity and an increased transduction efficiency, as compared to a reference AAV capsid protein, e.g. the corresponding parental capsid protein. The modified AAV capsid proteins of the present disclosure are capable of crossing the BBB, and transducing a transgene in a particular target cell-type (e.g., neuron) in both rodent and non-human primate models. In addition, the modified AAV capsid proteins of the present disclosure are capable of targeting a cell-type of the lung (e.g., a type II epithelial (ATII) cell) with in some cases a 60-fold increase in transgene transduction efficiency as compared to a reference AAV capsid protein, e.g. the corresponding parental capsid protein. The modified AAV capsid proteins of the present disclosure are capable of detargeting off-target in vivo environments, such as the liver by, in some cases, a 100-fold decrease in transgene transduction efficiency relative to a reference AAV capsid protein, e.g. the corresponding parental capsid protein. Accordingly, the modified AAV capsid proteins of the present disclosure are suitable for transgene therapy to treat human disease.

Disclosed herein are transgenes contained in a recombinant AAV (rAAV) vector and encapsidated by the modified AAV capsid proteins of the present disclosure. The transgenes disclosed herein are delivered to a subject for a variety of purposes, e.g., to treat a disease or condition in the subject. The transgene can be gene editing components that modulate the activity or expression of a target gene or gene expression product. Alternatively, the transgene is a gene encoding a therapeutic gene expression product that is effective to modulate the activity or expression of itself, of another target gene or gene expression product.

Methods of producing recombinant AAV (rAAV) virions, or rAAV particles, comprising AAV capsids comprising the modified AAV capsid proteins and heterologous polynucleotide encoding a therapeutic nucleic acid are also provided. The modified capsid proteins are produced by introducing to a cell (e.g., immortalized stem cell) a heterologous polynucleotide encoding the transgene (e.g., containing the therapeutic nucleic acid), a first plasmid vector encoding the AAV genome with a modified AAV capsid protein, and a second plasmid vector encoding helper virus proteins, required for assembly of the modified capsid structure and packaging of the transgene in the modified capsid. The assembled rAAV particle can be isolated and purified from the cell using suitable methods known in the art.

The vectors comprising a nucleic acid sequence encoding the modified AAV capsid proteins of the present disclosure are also provided herein. For example, the vectors of the present disclosure comprise a nucleic acid sequence encoding the two AAV viral genes, Rep (Replication), Cap (Capsid), wherein the Cap gene, encoding viral capsid proteins VP1, VP2, and VP3 is modified to produce the modified AAV capsid proteins of the present disclosure. The vector can comprise the viral genome from one or more AAV serotype (e.g., AAV5, AAV9), or a variant AAV serotype (e.g., AAV-PHP.eB, AAV-PHP.B, and the like).

Overview

Recombinant AAV (rAAV) mediated gene delivery leverages the AAV mechanism of viral transduction for nuclear expression of an episomal heterologous nucleic acid (e.g., a transgene, therapeutic nucleic acid). Upon delivery to a host in vivo environment, a rAAV will (1) bind or attach to cellular surface receptors on the target cell, (2) endocytose, (3) traffic to the nucleus, (4) uncoat the virus to release the encapsidated heterologous nucleic acid, (5) convert of the heterologous nucleic acid from single-stranded to double-stranded DNA as a template for transcription in the nucleus, and (6) transcribe of the episomal heterologous nucleic acid in the nucleus of the host cell ("transduction"). rAAVs engineered to have an increased specificity (binding to cellular surface receptors on the target cell) and transduction efficiency (transcription of the episomal heterologous nucleic acid in the host cell) are desirable for gene therapy applications.

The AAV capsid is made up of three capsid protein monomers, VP1, VP2, and VP3. Sixty copies of these three VP proteins interact in a 1:1:10 ratio to form the viral capsid. VP1 covers the whole of VP2 protein in addition to a ~137 amino acid N-terminal region (VP1u), VP2 covers the whole of VP3 in addition to ~65 amino acid N-terminal region (VP1/2 common region). The three capsid proteins share a conserved amino acid sequence of VP3, which in some cases is the region beginning at amino acid position 217 (e.g., AA 217-736).

The AAV VP3 structure contains highly conserved regions that are common to all serotypes, a core eight-stranded β-barrel motif (βB-βI) and a small α-helix (αA). The loop regions inserted between the β-strands consist of the distinctive HI loop between β-strands H and I, the DE loop between β-strands D and E, and nine variable regions (VRs), which form the top of the loops. These VRs are found on the capsid surface and can be associated with specific functional roles in the AAV life cycle including receptor binding, transduction and antigenic specificity. For example, the AA455 loop is the furthest protruding from the surface of the capsid, has been implicated in neutralizing antibody binding, and is believed to play a significant role in cell-surface receptor binding, either on its own or by interaction with the 588 loop.

Disclosed herein are recombinant adeno-associated viruses (rAAVs) with AAV capsids comprising modified AAV capsid proteins at the AA455 loop that confer a desired tropism characterized by a higher efficiency and specificity for transduction in specific cell-types, e.g., brain cell types. In particular, the modified AAV capsids disclosed herein enable rAAV-mediated transduction of a heterologous gene (e.g., transgene), while de-targeting others, thereby preventing off-target transduction events in peripheral organs, such as the liver. Also Disclosed herein are rAAVs with AAV capsids comprising modified AAV capsid proteins that confer a tropism characterized by a higher efficiency and specificity for transduction in particular organs or environments, e.g., the lungs, intestine, stomach, heart, muscle, adipose tissue, spleen, kidney, or reproductive organs (e.g., testis, ovaries). The rAAVs described herein are useful for a wide range of applications, including but not limited to the treatment of disease.

Compositions rAAV Capsids and Variant AAV Capsid Proteins

Disclosed herein are recombinant AAV (rAAV) with variant capsid proteins (e.g., rAAV capsid proteins) that are engineered with a modified capsid protein (e.g., VP1, VP2, VP3). In some embodiments, the rAAV capsid proteins of the present disclosure are generated using the methods disclosed herein (e.g., M-CREATE). In some embodiments, the AAV capsid proteins are used in the methods of delivering a therapeutic nucleic acid (e.g., a transgene) to a subject. In some instances, the rAAV capsid proteins have desired AAV tropisms rendering them particularly suitable for certain therapeutic applications, e.g., the treatment of a disease or disorder in a subject such as those disclosed herein.

The rAAV capsid proteins are engineered for optimized entry into and through the blood brain barrier (BBB) of a subject upon systemic administration of the rAAV to the subject, such as those provided in Tables 3-4. Prior methods of AAV-mediated delivery of a therapeutic transgene to the brain required intracranial injection. Intracranial injection is an invasive procedure that causes a subject discomfort, and in some cases, pain. For example, intracranial injection can cause hemorrhaging of the brain. Additionally, intracranial delivery has limited spread and is highly heterogeneous. The rAAV capsid proteins provided in Tables 3-4 are engineered to have tropisms that eliminate the need for intracranial injection, while also achieving widespread and efficient transduction of an encapsidated transgene. In particular, the tropisms comprise at least one of an increased specificity and efficiency (e.g., of viral transduction) in the central nervous system (CNS) of a subject, and/or peripheral nervous system (PNS) of a subject, as compared to a corresponding parental AAV or a reference AAV. The rAAVs disclosed herein may also de-target certain peripheral organs (e.g., the liver), thereby avoiding off-target viral transduction, such as those provided in Table 1.

Also disclosed herein are rAAVs with engineered capsid proteins that are optimized for targeting specific organ or tissue within a subject. In some embodiments, the organ is the heart. In some embodiments, the organ is the lung. In some embodiments, the organ is the liver. In some embodiments, the organ is the intestine. In some embodiments, the organ is the stomach. In some embodiments, the organ is the spleen. In some embodiments, the organ is the kidney. In some embodiments, the tissue is the fat (adipose). In some embodiments, the tissue is the muscle. The muscle may be cardiac muscle. The muscle may be skeletal muscle. In some embodiments, the organ is the pancreas. In some embodiments, the organ is the reproductive organ, such as a testicle or ovary. In further embodiments, the rAAVs disclosed herein may also de-target certain peripheral organs, thereby reducing or avoiding off-target viral transduction. In a non-limiting example, the rAAVs of the present embodiment, Table 1 have increased specificity and transduction in the brain (e.g., target environment), and very low transduction efficiency and no specificity in the liver (e.g., off-target environment), as compared to a reference AAV (e.g., AAV9).

The engineered AAV capsid proteins described herein have, in some cases, an insertion or substitution of an amino acid that is heterologous to the parental AAV capsid protein at the amino acid position of the insertion or substitution. In some embodiments, the amino acid is not endogenous to the parental AAV capsid protein at the amino acid position of the insertion or substitution. The amino acid may be a naturally occurring amino acid in the same or equivalent amino acid position as the insertion of the substitution in a different AAV capsid protein.

Generally, the insertion or substitution comprises a five-, six-, or seven-amino acid polymer (5-mer, 6-mer, or 7-mer, respectively) that is inserted or substituted at the 455 loop in a parental AAV capsid protein. The 7-mers described herein were advantageously generated using polymerase chain reaction (PCR) with degenerate primers, where each of the seven amino acids is encoded by a deoxyribose nucleic acid (DNA) sequence N-N-K. "N" is any of the four DNA nucleotides and K is guanine (G) or thymine (T). This method of generating random 7-mer amino acid sequences enables 1.28 billion possible combinations at the protein level. Since the 7-mers developed are random, some amino acids in the 7-mer may be naturally occurring in the AAC capsid protein at that amino acid position, while other amino acids may differ.

Recombinant AAVs (rAAVs) were generated, each with a unique 7-mer at the 455 loop and each encapsidating a reporter gene that, when administered systemically in multiple transgenic animals, enabled the selective amplification and recovery of sequences that effectively transduced the reporter gene in a target in vivo environment of the transgenic animal. 7-mers that were found to be positively enriched in the target in vivo environment (e.g., central nervous system, lung), and negatively enriched in off-target in vivo environments (e.g., the liver), are provided herein. "Enrichment" is the prevalence of a given 7-mer in the tissue of the in vivo environment compared to its prevalence in the viral library that was administered to the transgenic animal. An enrichment score above 0 indicates a positive enrichment. An enrichment score below 0 indicates a negative enrichment. An enrichment score of 0 indicates that the variant is not present in the tissue. A subset of the rAAVs with desired enrichment profiles were tested individually in vivo to determine exact systemic expression (e.g., specificity and transduction efficiency). rAAVs from this subset exhibiting a desired tropism comprising increased specificity, and in some cases, transduction efficiency are considered to be uniquely suited for targeted rAAV-mediated transgene delivery useful for a wide variety of purposes (e.g., therapeutic, diagnostic, scientific discovery).

The rAAV particles with the 7-mer insertion or substitutions described herein have an increased transduction efficiency in a target in vivo environment (e.g., tissue or cell type). In some instances, the increased transduction efficiency comprises a 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold increase, or more, relative to a reference AAV, e.g. the corresponding parental capsid protein. In some instances, the increased transduction efficiency is at least 30-fold. In some instances, the increased transduction efficiency is at least 40-fold. In some instances, the increased transduction efficiency is at least 50-fold. In some instances, the increased transduction efficiency is at least 60-fold. In some instances, the increased transduction efficiency is at least 80-fold. In some instances, the increased transduction efficiency is at least 90-fold. In some instances, the increased transduction efficiency is at least 100-fold.

The rAAV particles with the 7-mer insertion or substitutions described herein have decreased transduction efficiency in an off-target in vivo environment (e.g., tissue or cell type). In some instances, the off-target gene transfer is reduced by 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold, or more, relative to a reference AAV, e.g. the corresponding parental capsid protein. In some instances, the off-target gene transfer is reduced by at least 20-fold. In some instances, the off-target gene transfer is reduced by at least 30-fold. In some instances, the off-target gene transfer is reduced by at least 40-fold. In some instances, the off-target gene transfer is reduced by at least 50-fold. In some instances, the off-target gene transfer is reduced by at least 60-fold. In some instances, the off-target gene transfer is reduced by at least 80-fold. In some instances, the off-target gene transfer is reduced by at least 90-fold. In some instances, the off-target gene transfer is reduced by at least 100-fold.

The rAAV particles with the 7-mer insertion or substitutions described herein have an increased or decreased specificity in a target in vivo environment (e.g., tissue or cell type), as compared to a reference AAV, e.g. the corresponding parental capsid protein. Detecting whether a rAAV possesses more or less specificity for a target in vivo environment than a reference AAV, includes measuring a level of gene expression product (e.g., RNA or protein) expressed from the heterologous nucleic acid encapsidated by the rAAV in a tissue sample obtained from the target in vivo environment in a subject; and comparing the measured level to a control level (e.g., the gene expression product expressed from a heterologous nucleic acid encapsidated by a reference AAV (e.g., AAV9). Suitable methods for measuring expression of a gene expression product luciferase reporter assay and quantitative polymerase chain reaction (qPCR).

The increased specificity is correlated with an increased enrichment in the target in vivo environment, which in some cases is represented with an enrichment score provided herein in FIGS. 2-14. As a non-limiting example, AAV.CAP-B10 (SEQ ID NO: 3943; DGAATKN), which is shown herein to be positively enriched in the brain (enrichment score of approximately 0.950) and not enriched in the liver (enrichment score of ~0), as compared to a reference AAV9, also exhibited an increase in reporter gene expression (e.g., measured by luciferase reporter assay) in the brain and not in the liver as compared to a reference AAV9. Without being bound by a particular theory, the inventors of the present disclosure would expect to see this correlation for all rAAVs disclosed herein, and further, would expect that a more significant the enrichment score (whether negative or positive) would correlate with a more significant specificity to the in vivo environment(s) as indicated by a measured level of the gene expression product in the in vivo environment(s).

Transduction efficiency, as disclosed herein, may be measured by at least one of (1) a number of cells in a target in vivo or off-target in vivo environment expressing the heterologous nucleic acid encapsidated by the modified AAV capsid proteins disclosed herein, and (2) a quantity of expression of the heterologous nucleic acid in a single cell. Specificity for a target in vivo environment may be inferred when a presence, or an increase in a level, of rAAV-mediated transduction in a target in vivo environment is observed, as compared to a reference AAV. A lack of, or reduced, specificity to an off-target in vivo environment may be inferred when an absence, or a decrease in a level, of rAAV-mediated transduction in the off-target in vivo environment is observed, as compared to a reference AAV.

Native AAV serotypes have been shown to exhibit distinct tropism for various tissues and organs. The rAAV particles of the present disclosure include modified (e.g., chimeric) AAV9 capsids. AAV9 has been shown to exhibit a strong tropism for the central nervous system (CNS), lung, heart, liver, muscle, and testes as compared to AAV serotypes 1-8. In a direct comparison of AAV serotypes 1-9 administered intravenously via a tail vein injection in mice, AAV9 exhibits an increased specificity for viral transduction for the liver, lung, muscle, brain, testes, and heart as compared to AAV serotypes 1-8. In addition, AAV9 exhibits a high level of transduction efficiency in the liver, muscle, brain, and heart, as compared to AAV serotypes 1-8. However, the 7-mers disclosed herein may be engineered into a capsid protein from an AAV serotype other than AAV9, such as AAV2 or AAV8.

AAV capsid proteins from native AAV serotypes, such as AAV9, with tropisms specific to the liver activate the innate immune response, which is come cases causes a severe inflammatory response in a subject, which can lead to multi-organ failure. By improving transduction efficiency of a native AAV serotype for a target in vivo tissue (e.g., brain) and decreasing the specificity of the AAV capsid protein to the liver, the rAAV particles of the present disclosure reduce the immunogenic properties of AAV-mediated transgene delivery and prevent activation of the innate immune response.

The rAAV may comprise a chimeric AAV capsid. A "chimeric" AAV capsid refers to a capsid that has an exogenous amino acid or amino acid sequence (e.g., 7-mer substitution). The rAAV may comprise a mosaic AAV capsid. A "mosaic" AAV capsid refers to a capsid that made up of two or more capsid proteins or polypeptides, each derived from a different AAV serotype. The rAAV may be a result of transcapsidation, which, in some cases, refers to the packaging of an inverted terminal repeat (ITR) from a first serotype into a capsid of a second serotype, wherein the first and second serotypes are not the same. In some cases, the capsid genes of the parental AAV serotype is pseudotyped, which means that the \ITRs from a first AAV serotype (e.g., AAV2) are used in a capsid from a second AAV serotype (e.g., AAV9), wherein the first and second AAV serotypes are not the same. As a non-limiting example, a pseudotyped AAV serotype comprising the AAV2 ITRs and AAV9 capsid protein may be indicated AAV2/9. The rAAV may additionally, or alternatively, comprise a capsid that has been engineered to express an exogenous ligand binding moiety (e.g., receptor), or a native receptor that is modified. For example, the 7-mer substitutions described herein may alter the ligand-binding function of the parental AAV to provide an increased specificity for a particular cell-surface antigen.

The reference AAV disclosed herein, in some cases, is AAV9, because it provides the best comparison of a native AAV with strong tropisms for the CNS, lung, heart, liver, muscle, and testes. However, the reference AAV may be any serotype, e.g. a serotype selected from the group consisting of AAV1, AAV2, AAV3, AAV4, AAV5, AAV6, AAV7, AAV8, AAV9, AAV10, AAV11, AAV12, or variant thereof. For example, the reference AAV can have a serotype selected from the group consisting of AAV-PHP.B, AAV-PHP.eB, and AAV-PHP.S. In many instances, the reference AAV is the parental AAV, e.g., the corresponding unmodified AAV from which the variant AAV was engineered.

The rAAV capsid proteins of the present disclosure comprise a substitution of one or more amino acids in an amino acid sequence of an AAV capsid protein. The AAV capsid protein from which the engineered AAV capsid protein of the present disclosure is produced is referred to as a "parental" AAV capsid protein, or a "corresponding unmodified capsid protein". In some cases, the parental AAV capsid protein has a serotype selected from the group consisting of AAV1, AAV2, rAAV3, AAV4, AAV5, AAV6, AAV7, AAV8, AAV9, AAV10, AAV11, and AAV12. The complete genome of AAV-1 is provided in GenBank Accession No. NC_002077; the complete genome of AAV-2 is provided in GenBank Accession No. NC_001401 and Srivastava et al., J. Virol., 45: 555-564 (1983); the complete genome of AAV-3 is provided in GenBank Accession No. NC_1829; the complete genome of AAV-4 is provided in GenBank Accession No. NC_001829; the AAV-5 genome is provided in GenBank Accession No. AF085716; the complete genome of AAV-6 is provided in GenBank Accession No. NC_00 1862; at least portions of AAV-7 and AAV-8 genomes are provided in GenBank Accession Nos. AX753246 and AX753249, respectively; the AAV-9 genome is provided in Gao et al., J. Virol., 78: 6381-6388 (2004); the AAV-10 genome is provided in *Mol. Ther.*, 13(1): 67-76 (2006); the AAV-11 genome is provided in *Virology*, 330(2): 375-383 (2004); portions of the AAV-12 genome are provided in Genbank Accession No. DQ813647; portions of the AAV-13 genome are provided in Genbank Accession No. EU285562.

In some cases, the parental AAV is derived from an AAV with a serotype selected from the group consisting of AAV1, AAV2, AAV3, AAV4, AAV5, AAV6, AAV7, AAV8, AAV9, AAV10, AAV11, and AAV12. Put another way, the parental AAV is a variant of AAV1, AAV2, AAV3, AAV4, AAV5, AAV6, AAV7, AAV8, AAV9, AAV10, AAV11, or AAV12. By an AAV variant, it is meant an AAV having a sequence identity of 70% or more to AAV1, AAV2, AAV3, AAV4, AAV5, AAV6, AAV7, AAV8, AAV9, AAV10, AAV11, or AAV12, for example, a sequence identity of 80%, 85%, or 90% or more; of 91%, 92%, 93%, 94%, 95% or more, in some instances of 96%, 97%, 98%, or 99% to AAV1, AAV2, AAV3, AAV4, AAV5, AAV6, AAV7, AAV8, AAV9, AAV10, AAV11, and AAV12, A variant may include, for example, an AAV comprising a heterologous amino acid or heterologous amino acid sequence within an amino acid sequence of the AAV capsid protein. The heterologous amino acid may be naturally occurring in a different AAV capsid protein. In some instances, the parental AAV capsid is described in US2019/0055578, US2018/0230489, US2017/0067908, US2019/0048041, U.S. Pat. No. 9,585,971, or US2017/0166926, all of which are incorporated herein in their entirety.

In some instances, the parental AAV is AAV9. In some instances, the amino acid sequence of the AAV9 capsid protein comprises SEQ ID NO: 1. In some instances, the parental AAV capsid protein sequence is 70%, 75%, 80%, 85%, 90%, 91%, 92%, 93%, 94%, 95%, 96%, 97%, 98%, 99%, or 100% homologous to SEQ ID NO: 1, or part of SEQ ID NO: 1. In some instances, the parental AAV capsid protein comprises the entire VP1 region provided in SEQ ID NO: 1 (e.g., amino acids 1-736). In some instances, the parental AAV capsid protein comprises amino acids 217-736 in SEQ ID NO: 1, which is the common region found in VP1, VP2 and VP3 AAV9 capsid proteins. In some instances, the AAV capsid protein comprises amino acids 64-736 in SEQ ID NO: 1, which is the common region found in VP1 and VP2. The parental AAV capsid protein sequence may comprise amino acids selected from the group consisting of 1-736, 10-736, 20-736, 30-736, 40-736, 50-736, 60-736, 70-736, 80-736, 90-736, 100-736, 110-736, 120-736, 130-736, 140-736, 150-736, 160-736, 170-736, 180-736, 190-736, 200-736, 210-736, 220-736, 230-736, 240-736, 250-736, 260-736, 270-736, 280-736, 290-736, 300-

736, 310-736, 320-736, 330-736, 340-736, 350-736, 360-736, 370-736, 380-736, 390-736, 400-736, 410-736, 420-736, 430-736, 440-736, and 450-736, from SEQ ID NO: 1.

In some instances, the parental AAV is AAV5. In some instances, the amino acid sequence of the AAV5 capsid protein comprises SEQ ID NO: 2. In some instances, the parental AAV capsid protein sequence is 70%, 75%, 80%, 85%, 90%, 91%, 92%, 93%, 94%, 95%, 96%, 97%, 98%, 99%, or 100% homologous to SEQ ID NO: 2, or part of SEQ ID NO: 2. The parental AAV capsid protein sequence may comprise amino acids selected from the group consisting of 1-724, 10-724, 20-724, 30-724, 40-724, 50-724, 60-724, 70-724, 80-724, 90-724, 100-724, 110-724, 120-724, 130-724, 140-724, 150-724, 160-724, 170-724, 180-724, 190-724, 200-724, 210-724, 220-724, 230-724, 240-724, 250-724, 260-724, 270-724, 280-724, 290-724, 300-724, 310-724, 320-724, 330-724, 340-724, 350-724, 360-724, 370-724, 380-724, 390-724, 400-724, 410-724, 420-724, 430-724, 440-724, and 450-724, of SEQ ID NO: 2.

In some instances, the parental AAV is AAV-PHP.B. In some instances, the amino acid sequence of the AAV-PHP.B capsid protein comprises SEQ ID NO: 3. In some instances, the parental AAV capsid protein is 70%, 75%, 80%, 85%, 90%, 91%, 92%, 93%, 94%, 95%, 96%, 97%, 98%, 99%, or 100% homologous to SEQ ID NO: 3, or part of SEQ ID NO: 3. The parental AAV capsid protein sequence may comprise amino acids selected from the group consisting of 1-743, 10-743, 20-743, 30-743, 40-743, 50-743, 60-743, 70-743, 80-743, 90-743, 100-743, 110-743, 120-743, 130-743, 140-743, 150-743, 160-743, 170-743, 180-743, 190-743, 200-743, 210-743, 220-743, 230-743, 240-743, 250-743, 260-743, 270-743, 280-743, 290-743, 300-743, 310-743, 320-743, 330-743, 340-743, 350-743, 360-743, 370-743, 380-743, 390-743, 400-743, 410-743, 420-743, 430-743, 440-743, and 450-743, of SEQ ID NO: 3.

In some instances, the parental AAV is AAV.PHP.S. In some instances, the amino acid sequence of the AAV-PHP.S capsid protein comprises SEQ ID NO: 4. In some instances, the parental capsid protein is 70%, 75%, 80%, 85%, 90%, 91%, 92%, 93%, 94%, 95%, 96%, 97%, 98%, 99%, or 100% homologous to SEQ ID NO: 4, or part of SEQ ID NO: 4. The parental AAV capsid protein sequence may comprise amino acids selected from the group consisting of 1-743, 10-743, 20-743, 30-743, 40-743, 50-743, 60-743, 70-743, 80-743, 90-743, 100-743, 110-743, 120-743, 130-743, 140-743, 150-743, 160-743, 170-743, 180-743, 190-743, 200-743, 210-743, 220-743, 230-743, 240-743, 250-743, 260-743, 270-743, 280-743, 290-743, 300-743, 310-743, 320-743, 330-743, 340-743, 350-743, 360-743, 370-743, 380-743, 390-743, 400-743, 410-743, 420-743, 430-743, 440-743, and 450-743, of SEQ ID NO: 4.

In some instances, the parental AAV is AAV-PHP.eB. In some instances, the amino acid sequence of the AAV-PHP.eB capsid protein comprises SEQ ID NO: 5. In some instances, the AAV parental capsid protein is 70%, 75%, 80%, 85%, 90%, 91%, 92%, 93%, 94%, 95%, 96%, 97%, 98%, 99%, or 100% homologous to SEQ ID NO: 5, or part of SEQ ID NO: 5. The parental AAV capsid protein sequence may comprise amino acids selected from the group consisting of 1-743, 10-743, 20-743, 30-743, 40-743, 50-743, 60-743, 70-743, 80-743, 90-743, 100-743, 110-743, 120-743, 130-743, 140-743, 150-743, 160-743, 170-743, 180-743, 190-743, 200-743, 210-743, 220-743, 230-743, 240-743, 250-743, 260-743, 270-743, 280-743, 290-743, 300-743, 310-743, 320-743, 330-743, 340-743, 350-743, 360-743, 370-743, 380-743, 390-743, 400-743, 410-743, 420-743, 430-743, 440-743, and 450-743, of SEQ ID NO: 5.

In some instances, the insertion is introduced after any one amino acid position selected from 452-458 within an AAV9 (VP1 numbering), or equivalent amino acid position in a variant thereof. The amino acid sequence of AAV9 (VP1) is provided in SEQ ID NO: 1. In some instances, the substitution is a substitution of an amino acid at any one amino acid position selected from 452-458 within an AAV9 (VP1 numbering), or equivalent amino acid position in a variant thereof. In the some instances, the substitution is a substitution of the amino acid at amino acid position 452. In the some instances, the substitution is a substitution of the amino acid at amino acid position 453. In the some instances, the substitution is a substitution of the amino acid at amino acid position 454. In the some instances, the substitution is a substitution of the amino acid at amino acid position 455. In the some instances, the substitution is a substitution of the amino acid at amino acid position 456. In the some instances, the substitution is a substitution of the amino acid at amino acid position 457. In the some instances, the substitution is a substitution of the amino acid at amino acid position 458. In some instances, the substitution comprises a substitution of one amino acid. In some instances, the substitution comprises a substitution of two amino acids. In some instances, the substitution comprises a substitution of three amino acids. In some instances, the substitution comprises a substitution of four amino acids. In some instances, the substitution comprises a substitution of five amino acids. In some instances, the substitution comprises a substitution of six amino acids. In some instances, the substitution comprises a substitution of seven amino acids. The substitution or the insertion of two or more amino acids may be contiguous. The substitution or the insertion of two or more amino acids may not be contiguous.

Amino acids at position 452-458 according to VP1 numbering within SEQ ID NO: 1 (AAV9), SEQ ID NO: 3 (AAV-PHP.B), SEQ ID NO: 4 (AAV-PHP.S), and SEQ ID NO: 5 (AAV-PHP.eB) are indicated as "NGSGQNQ" (SEQ ID NO: 545). In some instances, amino acids at positions 452-458 within SEQ ID NO: 2 (AAV5) is indicated by a "NLAGRYA" (SEQ ID NO: 45478). In some instances, the substitution is at an amino acid position N452, G453, S454, G455, Q456, N457, or Q458, or a combination thereof, of an AAV9 capsid protein or variant thereof. In some instances, the substitution is an amino acid position N452, L453, A454, G455, G455, R456, Y457, or A458, or a combination thereof, of an AAV5 capsid protein or variant thereof. In some instances, the amino acid(s) substituted are located at amino acids 452-453, which may include a substituted amino acid at position 452 and 453. In some instances, two amino acids are substituted at an amino acid position selected from the group consisting of 452-453, 453-455, 455-456, 456-457, and 457-458. In some instances, three amino acids are substituted at an amino acid position selected from the group consisting of 452-454, 453-455, 454-456, 455-457, and 456-458. In some instances, four amino acids are substituted at an amino acid position selected from the group consisting of 452-455, 452-456, 453-457, 454-458. In some instances, five amino acids are substituted at an amino acid position selected from the group consisting of 452-456, 453-457, and 454-458. In some instances, six amino acids are substituted at an amino acid position 452-457 or 453-458. In some instances, seven amino acids are substituted at an amino acid position 452-458.

The rAAV capsid proteins described herein may be isolated and purified. The AAV may be isolated and purified by methods standard in the art such as by column chromatography or cesium chloride gradients. Methods for purifying AAV from helper virus are known in the art and may include methods disclosed in, for example, Clark et al., Hum. Gene Ther., 10(6): 1031-1039 (1999); Schenpp and Clark, Methods Mol. Med., 69: 427-443 (2002); U.S. Pat. No. 6,566,118 and WO 98/09657.

The rAAV capsid protein can be conjugated to a nanoparticle, a second molecule, or a viral capsid protein. In some cases, the nanoparticle or viral capsid protein would encapsidate the therapeutic nucleic acid described herein. In some instances, the second molecule is a therapeutic agent, e.g., a small molecule, antibody, antigen-binding fragment, peptide, or protein, such as those described herein. In some instances, the second molecule is a detectable moiety. For example, the modified AAV capsid protein conjugated to a detectable moiety may be used for in vitro, ex vivo, or in vivo biomedical research applications, the detectable moiety used to visualize the modified capsid protein. The modified AAV capsid protein conjugated to a detectable moiety may also be used for diagnostic purposes.

rAAV Capsid Proteins Targeting the Central Nervous System

Disclosed herein are recombinant AAVs (rAAV) with variant capsid proteins comprising a desired tropism characterized by a substitution or an insertion of at least one amino acid at an amino acid position described above in a corresponding parental AAV capsid protein. In some instances, the rAAV capsid protein has a desired a tropism comprising increased specificity for a target in vivo environment in a subject. In some instances, the target in vivo environment comprises the central nervous system (CNS), or peripheral nervous system (PNS). One of the many advantages of the tropism of the rAAV capsid proteins described herein is their ability to target the CNS and penetrate the blood brain barrier (BBB). In some instances, the desired tropism further comprises a decreased specificity for an off-target in vivo environment, relative to a tropism of a corresponding parental AAV capsid protein. In some instances, the off-target in vivo environment comprises a peripheral organ, such as a liver. Another advantage of the rAAV capsid proteins described herein, is their ability to avoid expression of the heterologous nucleic acid in the liver, thereby reducing liver toxicity and the viral dosage amount required for therapeutic effectiveness.

The in vivo environment can be a cell. The cell can be a cell-type selected from the group consisting of a central nervous system (CNS) cell and a peripheral nervous system (PNS) cell. Non-limiting examples of CNS cells include a neuron and a glial cell. Glial cells can be selected from the group consisting of an oligodendrocyte, an ependymal cell, and an astrocytes. Non-limiting examples of a PNS cell includes a neuron or a glial cell. The glial cell can be selected from the group consisting of a Schwann cell a satellite cell, and an enteric glial cell.

The in vivo environment can be a tissue, such as from an organ or organ system. The organ can be the brain, or the spinal cord. The tissue can be a region of an organ, such as for example, the cerebrum, the cerebellum, the brainstem, the cortex, the striatum, the thalamus, the lateral ventricles, the putamen, the hypothalamus, the medulla, the pons, the hippocampus, the amygdala, the motor cortex, or a combination thereof.

Disclosed herein are rAAV capsid proteins comprising an amino acid sequence that confers an increased specificity and/or increased transduction efficiency for the CNS or PNS of a subject, as compared to a reference AAV. In some cases, the amino acid sequence also confers a decreased specificity or decreased transduction efficiency for a peripheral organ (e.g., liver), as compared to the reference AAV. The amino acid sequence, in some cases, comprises a substitution of at least one amino acid at an amino acid position selected from the group consisting of 452, 453, 454, 455, 456, 457, and 458 in an amino acid sequence of the AAV capsid protein (e.g., parental AAV). In some embodiments, the parental AAV is AAV9 or variant thereof.

Provided herein are rAAV capsid proteins with an increased specificity and/or increased transduction efficiency for the CNS or PNS as compared to a reference AAV, the rAAV capsid proteins comprising an amino acid (X1), wherein X1 is A, D, G, L, N, Q, S, or T. The rAAV capsid protein can comprise at least two amino acids, wherein X1 is A, D, G, L, N, Q, S, or T; and X2 is A, G, N, P, Q, R, S, or T. The rAAV can comprise at least three amino, wherein X1 is A, D, G, L, N, Q, S, or T; and X2 is A, G, N, P, Q, R, S, or T; and X3 is A, D, G, N, S, or T. The rAAV can comprise at least four amino acids, wherein X1 is A, D, G, L, N, Q, S, or T; X2 is A, G, N, P, Q, R, S, or T; X3 is A, D, G, N, S, or T; and X4 is A, D, G, K, N, P Q, S, or T. The rAAV can comprise at least five amino acids, wherein X1 is A, D, G, L, N, Q, S, or T; X2 is A, G, N, P, Q, R, S, or T; X3 is A, D, G, N, S, or T; X4 is A, D, G, K, N, P Q, S, or T; and X5 is A, G, K, N, P, R, S, or T. The rAAV can comprise at least six amino acids, wherein X1 is A, D, G, L, N, Q, S, or T; X2 is A, G, N, P, Q, R, S, or T; X3 is A, D, G, N, S, or T; X4 is A, D, G, K, N, P Q, S, or T; X5 is A, G, K, N, P, R, S, or T; and X6 is A, G, K, N, P, R, S, T, or V. The rAAV can comprise at least seven amino acids, wherein X1 is A, D, G, L, N, Q, S, or T; X2 is A, G, N, P, Q, R, S, or T; X3 is A, D, G, N, S, or T; X4 is A, D, G, K, N, P Q, S, or T; X5 is A, G, K, N, P, R, S, or T; X6 is A, G, K, N, P, R, S, T, or V; and X7 is A, G, K, L, R, S, T, or V.

Provided herein are rAAV capsid proteins with an increased specificity and/or increased transduction efficiency for the CNS or PNS as compared to a reference AAV and a decreased specificity and/or a decreased transduction efficiency for a peripheral organ (e.g., liver) as compared to a reference AAV. The rAAV, in some cases, comprises an amino acid (X1), wherein X1 is G, A, V, N, S, H, L, E or Q. The rAAV capsid protein can comprise at least two amino acids, wherein X1 is G, A, V, N, S, H, L, E or Q; and X2 is A, I, T, P, N, R, T, G, S, K, H, or Q. The rAAV can comprise at least three amino, wherein X1 is G, A, V, N, S, H, L, E or Q; and X2 is A, I, T, P, N, R, T, G, S, K, H, or Q; and X3 is S, N, D, A, T, H, K, Q. The rAAV can comprise at least four amino acids. In some embodiments X1 is G, A, V, N, S, H, L, E or Q; X2 is A, I, T, P, N, R, T, G, S, K, H, or Q; X3 is, N, D, A, T, H, K, Q; and X4 is N, G, T, S, D, P, R, T, or Q. The rAAV can comprise at least five amino acids, wherein X1 is G, A, V, N, S, H, L, E or Q; X2 is A, I, T, P, N, R, T, G, S, K, H, or Q; X3 is, N, D, A, T, H, K, Q; X4 is N, G, T, S, D, P, R, T, or Q; and X5 is S, K, P, T, G, D, P, N, or V. The rAAV can comprise at least six amino acids, wherein X1 is G, A, V, N, S, H, L, E or Q; X2 is A, I, T, P, N, R, T, G, S, K, H, or Q; X3 is, N, D, A, T, H, K, Q; X4 is N, G, T, S, D, P, R, T, or Q; X5 is S, K, P, T, G, D, P, N, or V; and X6 is T, A, R, S, N, G, D, P, or V. The rAAV can comprise at least seven amino acids, wherein X1 is G, A, V, N, S, H, L, E or Q; X2 is A, I, T, P, N, R, T, G, S, K, H, or Q; X3 is, N, D, A, T, H, K, Q; X4 is N, G, T, S, D, P, R, T, or Q; X5 is S, K, P, T, G, D, P, N, or V; X6 is T, A, R, S, N, G, D, P, or V; and X7 is G, N, S, L, A, E, K, or Q.

In some cases, the rAAV, in some cases, comprises an amino acid (X1), wherein X1 is A, D, E, G, H, M, N, Q, S, T, or V. The rAAV can comprise at least two amino acids, wherein X1 is A, D, E, G, H, M, N, Q, S, T, or V; and X2 is A, D, E, G, K, N, Q, S, T, or V. The rAAV can comprise at least three amino acids, wherein X1 is A, D, E, G, H, M, N, Q, S, T, or V; X2 is A, D, E, G, K, N, Q, S, T, or V; and X3 is A, D, E, G, K, N, Q, S, T, or V. The rAAV can comprise at least four amino acids, wherein X1 is A, D, E, G, H, M, N, Q, S, T, or V; X2 is A, D, E, G, K, N, Q, S, T, or V; X3 is A, D, E, G, K, N, Q, S, T, or V; and X4 is A, D, E, G, K, N, P, Q, S, or T. The rAAV can comprise at least five amino acids, wherein X1 is A, D, E, G, H, M, N, Q, S, T, or V; X2 is A, D, E, G, K, N, Q, S, T, or V; X3 is A, D, E, G, K, N, Q, S, T, or V; X4 is A, D, E, G, K, N, P, Q, S, or T; and X5 is A, D, E, G, H, K, N, P, Q, S, or T. The rAAV can comprise at least six amino acids, wherein X1 is A, D, E, G, H, M, N, Q, S, T, or V; X2 is A, D, E, G, K, N, Q, S, T, or V; X3 is A, D, E, G, K, N, Q, S, T, or V; X4 is A, D, E, G, K, N, P, Q, S, or T; X5 is A, D, E, G, H, K, N, P, Q, S, or T; and X6 is A, D, E, G, K, N, P, S, T, or V. The rAAV can comprise at least seven amino acids, wherein X1 is A, D, E, G, H, M, N, Q, S, T, or V; X2 is A, D, E, G, K, N, Q, S, T, or V; X3 is A, D, E, G, K, N, Q, S, T, or V; X4 is A, D, E, G, K, N, P, Q, S, or T; X5 is A, D, E, G, H, K, N, P, Q, S, or T; X6 is A, D, E, G, K, N, P, S, T, or V; and X7 is A, E, G, H, K, L, N, Q, S, T, or V.

In some cases, X1, X2, X3, X4, X5, X6, and X7 are contiguous (X1-X2-X3-X4-X5-X6-X7). Alternatively, X1, X2, X3, X4, X5, X6, and X7 are not contiguous. In some embodiments, any two of X1, X2, X3, X4, X5, X6 and X7 are contiguous. In some embodiments, any three of X1, X2, X3, X4, X5, X6, and X7 are contiguous. In some embodiments, any four of X1, X2, X3, X4, X5, X6, and X7 are contiguous. In some embodiments, any five of X1, X2, X3, X4, X5, X6, and X7 are contiguous. In some embodiments, any six of X1, X2, X3, X4, X5, X6, and X7 are contiguous. In some embodiments, any seven of X1, X2, X3, X4, X5, X6, and X7 are contiguous. In some embodiments, X1 is at an amino acid position 452 within an AAV9 capsid protein, or variant thereof. In some embodiments X2 is at an amino acid position 453 within an AAV9 capsid protein, or variant thereof. In some embodiments X3 is at an amino acid position 454 within an AAV9 capsid protein, or variant thereof. In some embodiments X4 is at an amino acid position 455 within an AAV9 capsid protein, or variant thereof. In some embodiments X5 is at an amino acid position 456 within an AAV9 capsid protein, or variant thereof. In some embodiments X6 is at an amino acid position 457 within an AAV9 capsid protein, or variant thereof. In some embodiments X7 is at an amino acid position 458 within an AAV9 capsid protein, or variant thereof. In some embodiments, the amino acid sequence of the rAAV does not comprise of an amino acid sequence ILGTGTS (SEQ ID NO: 45479) or QSSQTPR (SEQ ID NO: 45480) at amino acids 452-458 in a parental AAV9 capsid protein, or variant thereof.

Disclosed herein are rAAV capsid proteins comprising a substitution of one, two, three, four, five, six, or seven amino acids in an amino acid sequence provided any one of SEQ ID NOS: 11-12739. In some embodiments, the rAAV capsid proteins comprise a substitution of two amino acids in an amino acid sequence provided in any one of SEQ ID NOS: 11-12739. In some embodiments, the rAAV capsid proteins comprise a substitution of three amino acids in an amino acid sequence provided in any one of SEQ ID NOS: 11-12739. In some embodiments, the rAAV capsid proteins comprise a substitution of four amino acids in an amino acid sequence provided in any one of SEQ ID NOS: 11-12739. In some embodiments, the rAAV capsid proteins comprise a substitution of five amino acids in an amino acid sequence provided in any one of SEQ ID NOS: 11-12739. In some embodiments, the rAAV capsid proteins comprise a substitution of six amino acids in an amino acid sequence provided in any one of SEQ ID NOS: 11-12739.

Disclosed herein are rAAV capsid proteins that have an increased specificity and/or increased transduction efficiency for the central nervous system (CNS) or the peripheral nervous system (PNS). Exemplary substitutions include N452D, N452A, N452G, N452L, N452Q, N452S, N452T, G453I, G453N, G453S, G453P, G453R, G453T, S454A, S454Q, S454D, S454G, S454N, S454T, G455A, G455S, G455D, G455K, G455N, G455P, G455Q, G455T, Q456T, Q456S, Q456A, Q456G, Q456K, Q456N, Q456R, Q456P, N457K, N457A, N457G, N457P, N457R, N457S, N457T, N457V, Q458N, Q458A, Q458G, Q458K, Q458L, Q458R, Q458S, Q458T, or Q458V, in an amino acid sequence of the AAV9 capsid protein, or a variant thereof. In some embodiments, the substitution is of at least or about one two, three, four, five, six, or seven amino acids of an amino acid sequence LQTSSPG (SEQ ID NO: 2933). In some embodiments, the amino acid sequence is QQGKQSV (SEQ ID NO: 79). In some embodiments, the amino acid sequence is SINTKTN (SEQ ID NO: 45475). In some embodiments, the amino acid sequence is SNGTKQT (SEQ ID NO: 442). In some embodiments, the amino acid sequence is GSGKTAA (SEQ ID NO: 88). In some embodiments, the amino acid sequence is MGDKPTR (SEQ ID NO: 2466). In some embodiments, the amino acid sequence is DGAATKN (SEQ ID NO: 3943). In some embodiments, the amino acid sequence is QPSGGNT (SEQ ID NO: 2672). In some embodiments, the amino acid sequence is ERGANTK (SEQ ID NO: 5192). In some embodiments, the amino acid sequence is TTGGHSS (SEQ ID NO: 2743). In some embodiments, the amino acid sequence is GTTKTSE (SEQ ID NO: 3064). In some embodiments, the amino acid sequence is GTGTSVL (SEQ ID NO: 11958). In some embodiments, the amino acid sequence is NQSGTKG (SEQ ID NO: 780). In some embodiments, the amino acid sequence is DGQSSKS (SEQ ID NO: 2764). In some embodiments, the amino acid sequence is KGPGQMG (SEQ ID NO: 45476). In some embodiments, the amino acid sequence is GTPSKAG (SEQ ID NO: 2741).

Also provided herein are rAAV capsid proteins that have an increased specificity and/or increased transduction efficiency for the CNS and PNS, and a decrease in specificity and/or a decrease in transduction efficiency for an off-target in vivo environment, such as the liver. Exemplary substitutions include N452D, N452G, N452A, N452V, N452S, N452H, N452L, N452E, N452Q, G452A, G452I, G452T, G452P, G452R, G452T, G452S, G452K, G452H, S454A, S454N, S454D, S454G, S454T, S454H, S454K, S454Q, G455A, G455N, G455T, G455S, G455D, G455P, G455R, G455Q, Q456T, Q456S, Q456K, Q456P, Q456G, Q456D, Q456V, Q456A, Q456N, N457K, N457T, N457A, N457R, N457S, N457G, N457D, N457P, N457V, Q458N, Q458G, Q458S, Q458L, Q458A, Q458E, and Q458K, in an amino acid sequence of the AAV9 capsid protein, or a variant thereof. Additional exemplary substitutions include N452A, N452D, N452E, N452G, N452H, N452M, N452N, N452Q, N452S, N452T, N452V, G453A, G453D, G453E, G453G, G453K, G453N, G453Q, G453S, G453T, G453V, S454A, S454D, S454E, S454G, S454K, S454N, S454Q, S454S, S454T, S454V, G455A, G455D, G455E, G455G, G455K, G455N, G455P, G455Q, G455S, G455T, Q456A, Q456D, Q456E, Q456H, Q456H, Q456K, Q456N, Q456P, Q456Q, Q456S, Q456T, N457A, N457D, N457E, N457G, N457K, N457N, N457P, N457S, N457T, N457V, Q458A, Q458E, Q458G, Q458H, Q458K, Q458L, Q458N, Q458Q, Q458S, Q458T, and Q458V. Additional exemplary substitutions include N452A, N452D, N452E, N452G, N452H, N452K, N452L, N452M, N452N, N452Q, N452S, N452T, N452V, G453A, G453D, G453G, G453H, G453M, G453N, G453P, G453Q, G453S, G453T, G453V, S454A, S454D, S454E, S454G, S454K, S454N, S454Q, S454S, S454T, S454V, G455A, G455D, G455E, G455G, G455K, G455N, G455P, G455Q, G455S, G455T, Q456A, Q456D, Q456G, Q456K, Q456N, Q456P, Q456Q, Q456S, Q456T, N457A, N457G, N457H, N457L, N457M, N457N, N457P, N457Q, N457S, N457T, N457V, Q458A, Q458D, Q458E, Q458G, Q458H, Q458I, Q458K, Q458L, Q458N, Q458Q, Q458R, Q458S, Q458T, and Q458V. In some embodiments, the substitution is of at least or about one two, three, four, five, six, or seven amino acids of an amino acid sequence DGAATKN (SEQ ID NO: 3943). In some embodiments, the substitution is of at least or about one two, three, four, five, six, or seven amino acids of an amino acid sequence DGQSSKS (SEQ ID NO: 2764).

In some instances, the substitution of an amino acid is at an amino acid position selected from 452-458 in a capsid amino acid sequence of AAV9 or a variant thereof. In some instances, the substitution of the amino acid is at amino acid position selected from 452-458 in a capsid amino acid sequence provided in SEQ ID NO: 1. In some instances, the substitution of the amino acid is at amino acid position selected from 452-458 in a capsid amino acid sequence of AAV5 or variant thereof. In some instances, the substitution of the amino acid is at amino acid position selected from 452-458 in a capsid amino acid sequence of provided in SEQ ID NO: 2. In some instances, the substitution of the amino acid is at amino acid position selected from 452-458 in the AAVV-PHP.B capsid protein sequence (SEQ ID NO: 3). In some instances, the substitution of the amino acid is at amino acid position selected from 452-458 in the AAV-PHP.S capsid protein sequence (SEQ ID NO: 4). In some instances, the substitution of the amino acid is at amino acid position selected from 452-458 in the AAV-PHP.eB capsid protein sequence (SEQ ID NO: 5). In some embodiments, the rAAV of the present disclosure comprises the substitution of the amino acid at an amino acid position selected from 452-458 in a parental AAV capsid protein, and an insertion of an amino acid or amino acid sequence at an amino acid position 588-589 in the parental AAV capsid protein.

The rAAV capsid proteins of the present disclosure may also have an insertion of an amino acid sequence at amino acid position 588-589 in a parental AAV9 capsid protein, or variant thereof. In some embodiments, the insertion of the amino acid sequence comprises X1LAVPFK (SEQ ID NO: 45481) at amino acid position 588-589 in the parental AAV9 capsid protein, wherein X1 is any amino acid other than T, S, or N. In some embodiments, the insertion of the amino acid sequence comprises X1X2AVPFK (SEQ ID NO: 45482) at amino acid position 588-589 in the parental AAV9 capsid protein, wherein X2 is any amino acid other than L or V. In some embodiments, the insertion of the amino acid sequence comprises X1X2X3VPFK (SEQ ID NO: 45483) at amino acid position 588-589 in the parental AAV9 capsid protein, wherein X3 is any amino acid other than A, S, Q, P, and T. In some embodiments, the insertion of the amino acid sequence comprises X1X2X3X4PFK (SEQ ID NO: 45484) at amino acid position 588-589 in the parental AAV9 capsid protein, wherein X4 is any amino acid other than V, T, Q, N, L, and M. In some embodiments, the insertion of the amino acid sequence comprises TLAX4PFK (SEQ ID NO: 45485) at amino acid position 588-589 in the parental AAV9 capsid protein, wherein X is any amino acid other than V, T, Q, N, L, and M. In some embodiments, the rAAV further comprises a substitution of an amino acid at an amino acid position 587 in the parental AAV9 capsid protein, or variant thereof. In some embodiments, the substitution is A587D. In some embodiments, the substitution is a substitution with amino acid other than D. In some embodiments, the rAAV further comprises a substitution of an amino acid at an amino acid position 588 in the parental AAV9 capsid protein or variant thereof. In, some embodiments, the substitution is Q588G. In some embodiments, the substitution is a substitution with amino acid other than G.

In some embodiments, the rAAV capsid has a variant AAV capsid protein (e.g., an rAAV capsid protein) comprises a substitution of at least or about three, four, five, six, or seven amino acids of an amino acid sequence LQTSSPG (SEQ ID NO: 2933) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence LQTSSPG (SEQ ID NO: 2933) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence LQTSSPG (SEQ ID NO: 2933) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46386.

In some embodiments, the rAAV capsid protein comprises a substitution of at least or about three, four, five, six, or seven amino acids of an amino acid sequence QQGKQSV (SEQ ID NO: 79) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence QQGKQSV (SEQ ID NO: 79) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence QQGKQSV (SEQ ID NO: 79) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46387.

In some embodiments, the rAAV capsid protein comprises a substitution of at least or about three, four, five, six, or seven amino acids of an amino acid sequence SINTKTN (SEQ ID NO: 45475) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence SINTKTN (SEQ ID NO: 45475) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence SINTKTN (SEQ ID NO: 45475) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46368.

In some embodiments, the rAAV capsid protein comprises a substitution of at least or about three, four, five, six, or seven amino acids of an amino acid sequence SNGTKQT (SEQ ID NO: 442) at an amino acid position 452-458 in a parental AAV9 capsid protein represented by SEQ ID NO: 1. In some embodiments, the rAAV capsid protein comprises a substitution of at least or about three, four, five, six, or seven amino acids of an amino acid sequence SNGTKQT (SEQ ID NO: 442) at an amino acid position 452-458 in a parental AAV9 variant capsid protein represented by SEQ ID NO: 3 or SEQ ID NO: 5. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46389.

In some embodiments, the rAAV capsid protein comprises a substitution of at least or about three, four, five, six, or seven amino acids of an amino acid sequence GSGKTAA (SEQ ID NO: 88) at an amino acid position 452-458 in a parental AAV9 capsid protein represented by SEQ ID NO: 1. In some embodiments, the rAAV capsid protein comprises a substitution of at least or about three, four, five, six, or seven amino acids of an amino acid sequence GSGKTAA (SEQ ID NO: 88) at an amino acid position 452-458 in a parental AAV9 variant capsid protein represented by SEQ ID NO: 3 or SEQ ID NO:5. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46390.

In some embodiments, the rAAV capsid protein comprises a substitution of at least or about three, four, five, six, or seven amino acids of an amino acid sequence MGDKPTR (SEQ ID NO: 2466) at an amino acid position 452-458 in a parental AAV9 capsid protein represented by SEQ ID NO: 1. In some embodiments, the rAAV capsid protein comprises a substitution of at least or about three, four, five, six, or seven amino acids of an amino acid sequence MGDKPTR (SEQ ID NO: 2466) at an amino acid position 452-458 in a parental AAV9 variant capsid protein represented by SEQ ID NO: 3 or SEQ ID NO: 5. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46391.

In some embodiments, the rAAV capsid protein comprises a substitution of at least or about three, four, five, six, or seven amino acids of an amino acid sequence DGAATKN (SEQ ID NO: 3943) at an amino acid position 452-458 in a parental AAV9 capsid protein represented by SEQ ID NO: 1. In some embodiments, the rAAV capsid protein comprises a substitution of at least or about three, four, five, six, or seven amino acids of an amino acid sequence DGAATKN (SEQ ID NO: 3943) at an amino acid position 452-458 in a parental AAV9 variant capsid protein represented by SEQ ID NO: 3 or SEQ ID NO:5. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46384.

In some embodiments, the rAAV capsid protein comprises a substitution of at least or about three, four, five, six, or seven amino acids of an amino acid sequence QPSGGNT (SEQ ID NO: 2672) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence QPSGGNT (SEQ ID NO: 2672) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence QPSGGNT (SEQ ID NO: 2672) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46392.

In some embodiments, the rAAV capsid protein comprises a substitution of at least or about three, four, five, six, or seven amino acids of an amino acid sequence ERGANTK (SEQ ID NO: 5192) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence ERGANTK (SEQ ID NO: 5192) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence ERGANTK (SEQ ID NO: 5192) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46393.

In some embodiments, the rAAV capsid protein comprises a substitution of at least or about three, four, five, six, or seven amino acids of an amino acid sequence TTGGHSS (SEQ ID NO: 2743) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence TTGGHSS (SEQ ID NO: 2743) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence TTGGHSS (SEQ ID NO: 2743) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46394.

In some embodiments, the rAAV capsid protein comprises a substitution of at least or about three, four, five, six, or seven amino acids of an amino acid sequence GTTKTSE (SEQ ID NO: 3064) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence GTTKTSE (SEQ ID NO: 3064) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence GTTKTSE (SEQ ID NO: 3064) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46395.

In some embodiments, the rAAV capsid protein comprises a substitution of at least or about three, four, five, six, or seven amino acids of an amino acid sequence GTGTSVL (SEQ ID NO: 11958) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence GTGTSVL (SEQ ID NO: 11958) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence GTGTSVL (SEQ ID NO: 11958) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46396.

In some embodiments, the rAAV capsid protein comprises a substitution of at least or about three, four, five, six, or seven amino acids of an amino acid sequence NQSGTKG (SEQ ID NO: 780) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence NQSGTKG (SEQ ID NO: 780) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence NQSGTKG (SEQ ID NO: 780) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of an amino acid sequence comprising at least or about three, four, five, six, seven, eight, nine, ten, or eleven amino acids. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46397.

In some embodiments, the rAAV capsid protein comprises a substitution of at least or about three, four, five, six, or seven amino acids of an amino acid sequence DGQSSKS (SEQ ID NO: 2764) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence DGQSSKS (SEQ ID NO: 2764) at an amino acid position 452-458 in a parental AAV9 variant capsid protein (SEQ ID NO: 5). In some embodiments, the rAAV capsid protein comprises a substitution of at least or about three, four, five, six, or seven amino acids of an amino acid sequence DGQSSKS (SEQ ID NO: 2764) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46385.

In some embodiments, the rAAV capsid protein comprises a substitution of at least or about three, four, five, six, or seven amino acids of an amino acid sequence KGPGQMG (SEQ ID NO: 45476) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence KGPGQMG (SEQ ID NO: 45476) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence KGPGQMG (SEQ ID NO: 45476) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46398.

In some embodiments, the rAAV capsid protein comprises a substitution of at least or about three, four, five, six, or seven amino acids of an amino acid sequence GTPSKAG (SEQ ID NO: 2741) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence GTPSKAG (SEQ ID NO: 2741) at an amino acid position 452-458 in a parental AAV9 capsid protein (SEQ ID NO: 5). In some embodiments, the rAAV capsid protein comprises a substitution of at least or about three, four, five, six, or seven amino acids of an amino acid sequence GTPSKAG (SEQ ID NO: 2741) at an amino acid position 452-458 in a parental AAV9 variant capsid protein (SEQ ID NO: 5). In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the insertion of an amino acid sequence comprising at least or about three, four, five, six, seven, eight, nine, ten, or eleven amino acids. In some embodiments, the insertion of the amino acid sequence comprises TLAVPFK (SEQ ID NO: 45477) at amino acid position 588-589 in the parental AAV9 capsid protein. In some embodiments, the rAAV capsid protein comprises an amino acid sequence provided in SEQ ID NO: 46399.

Table 1 provides amino acid sequences of top performing rAAV capsid proteins, ranked based on a positive enrichment in the brain and negative enriched in the liver after two rounds of in vivo selection, as well as the DNA sequences encoding them. Table 2 provides amino acid sequences of top performing rAAV capsid proteins ranked based on an enrichment in the brain alone after two rounds of in vivo selection, and corresponding DNA sequences. Example 3 provides details on how the enrichment score was calculated. An AAV variant was determined to de-target a tissue if its enrichment score in that tissue was less than or equal to 0.

TABLE 1

List of 7 amino acid targeting peptides of rAAVs that target the CNS and detarget the liver

| SEQ ID NO | DNA Sequence | SEQ ID NO | Amino Acid Sequence | Log 10 enrichment in the brain | Log 10 enrichment in the liver |
|---|---|---|---|---|---|
| 15469 | AGCAGCACCAGCGGCGCCGGC | 2740 | SSTSGAG | 1.805607713 | 0 |
| 15470 | GGCACCCCCAGCAAAGCCGGC | 2741 | GTPSKAG | 1.782483914 | 0 |
| 15471 | GACAAAACCACCGCCGGCCAA | 2742 | DKTTAGQ | 1.756796407 | 0 |
| 15472 | ACCACCGGCGGCCACAGCAGC | 2743 | TTGGHSS | 1.7086977 | 0 |
| 15473 | GGCGCCAGCAACAGCACCGGC | 2744 | GASNSTG | 1.6215475 | 0 |
| 15474 | GCCATCAACGGCAAAGCCGGC | 2745 | AINGKAG | 1.611787687 | 0 |
| 15475 | GTCATCGACACCAAAGCCGGC | 2746 | VIDTKAG | 1.611787687 | 0 |
| 15476 | AACGCCAGCAGCAGCACCGGC | 2747 | NASSSTG | 1.599553231 | 0 |
| 15477 | GGTACGAGTAGTCCGGCTAAT | 2748 | GTSSPAN | 1.593175811 | 0 |
| 15478 | GGCCCCGGCGACACCAGAAGC | 2749 | GPGDTRS | 1.559758687 | 0 |
| 15479 | GGGAATGGGTCGTCGGCGCTG | 2750 | GNGSSAL | 1.534699431 | -1.140781313 |
| 15480 | GGCAGAAGCGGCGGCACCGGC | 2751 | GRSGGTG | 1.532606441 | 0 |

TABLE 1-continued

List of 7 amino acid targeting peptides of rAAVs that target the CNS and detarget the liver

| SEQ ID NO | DNA Sequence | SEQ ID NO | Amino Acid S

TABLE 1-continued

List of 7 amino acid targeting peptides of rAAVs that target the CNS and detarget the liver

| SEQ ID NO | DNA Sequence | SEQ ID NO | Amino Acid Sequence | Log 10 enrichment in the brain | Log 10 enrichment in the liver |
|---|---|---|---|---|---|
| 15517 | GAGTCTGGGAAGGGTAGTTTG | 2788 | ESGKGSL | 1.345977191 | 0 |
| 15518 | GAAAACAGCAGCGGCCACGCC | 2789 | ENSSGHA | 1.3451798 | 0 |

TABLE 2

List of 7 amino acid targeting peptides of rAAVs that target the CNS

| SEQ ID NO | DNA Sequence | SEQ ID NO | Amino Acid Sequence | Log 10 enrichment in the brain |
|---|---|---|---|---|
| 12740 | AGCGGCCTCAAAGGCACCGGC | 11 | SGLKGTG | 1.912817683 |
| 15469 | AGCAGCACCAGCGGCGCCGGC | 2740 | SSTSGAG | 1.805607713 |
| 15470 | GGCACCCCCAGCAAAGCCGGC | 2741 | GTPSKAG | 1.782483914 |
| 15471 | GACAAAACCACCGCCGGCCAA | 2742 | DKTTAGQ | 1.756796407 |
| 15472 | ACCACCGGCGGCCACAGCAGC | 2743 | TTGGHSS | 1.7086977 |
| 12741 | GTGGGTGGGACTCAGGGTAAG | 12 | VGGTQGK | 1.683542214 |
| 12742 | AGCATGGACAGCAGACCCGGC | 13 | SMDSRPG | 1.646549793 |
| 12743 | GGTAGTAGTCCTAGTAAGGCT | 14 | GSSPSKA | 1.624376814 |
| 15473 | GGCGCCAGCAACAGCACCGGC | 2744 | GASNSTG | 1.6215475 |
| 15474 | GCCATCAACGGCAAAGCCGGC | 2745 | AINGKAG | 1.611787687 |
| 15475 | GTCATCGACACCAAAGCCGGC | 2746 | VIDTKAG | 1.611787687 |
| 12744 | ACTGGTACGGCGAATCCGTTG | 15 | TGTANPL | 1.609487799 |
| 15476 | AACGCCAGCAGCAGCACCGGC | 2747 | NASSSTG | 1.599553231 |
| 15477 | GGTACGAGTAGTCCGGCTAAT | 2748 | GTSSPAN | 1.593175811 |
| 12745 | AGCCAAGGCGCCAAACCCGTC | 16 | SQGAKPV | 1.581298365 |
| 12746 | CAGGGGGAGAAGAATACTATG | 17 | QGEKNTM | 1.560127515 |
| 15478 | GGCCCCGGCGACACCAGAAGC | 2749 | GPGDTRS | 1.559758687 |
| 15479 | GGGAATGGGTCGTCGGCGCTG | 2750 | GNGSSAL | 1.534699431 |
| 15480 | GGCAGAAGCGGCGGCACCGGC | 2751 | GRSGGTG | 1.532606441 |
| 15481 | AGCACCGGCCCCACCCCCGCC | 2752 | STGPTPA | 1.532606441 |
| 12747 | ACCAGCGGCAACAGCAGCAAA | 18 | TSGNSSK | 1.532606441 |
| 15482 | CATGGGGGAGGGATTCTAGT | 2753 | HGGRDSS | 1.514877674 |
| 15483 | GGTTCTGGTACGCCTAATGGG | 2754 | GSGTPNG | 1.511287094 |
| 12748 | ACGACGTCTAAGCCTGGTACT | 19 | TTSKPGT | 1.510809312 |
| 15484 | GGCAAAGCCGGCAGCACCGGC | 2755 | GKAGSTG | 1.497844335 |
| 12749 | AGCCAAGGCAAAGGCGGCAGC | 20 | SQGKGGS | 1.497374065 |
| 15485 | CTTAGTGCGGGTAAGGGTGAG | 2756 | LSAGKGE | 1.496394268 |
| 12750 | GGGTCGATTAAGGGGGAGGCT | 21 | GSIKGEA | 1.495179943 |
| 12751 | AACAGCGGCACCACCGGCAAC | 22 | NSGTTGN | 1.492959081 |

TABLE 2-continued

List of 7 amino acid targeting peptides of rAAVs that target the CNS

| SEQ ID NO | DNA Sequence | SEQ ID NO | Amino Acid Sequence | Log 10 enrichment in the brain |
|---|---|---|---|---|
| 15486 | GTCGGCATCCCCAGCGCCGGC | 2757 | VGIPSAG | 1.486848951 |
| 15487 | AGTGGTGGGCAGAAGGATAAT | 2758 | SGGQKDN | 1.480843526 |
| 12752 | GAAAGAACCAAAGAAACCCTC | 23 | ERTKETL | 1.465659651 |
| 12753 | GATCATGGTAAGGGGAATCAG | 24 | DHGKGNQ | 1.464822053 |
| 12754 | GATGGGCAGCAGCGGAGTAGT | 25 | DGQQRSS | 1.464030027 |
| 12755 | TCGGGTAATAGTACTAATAAG | 26 | SGNSTNK | 1.458626389 |
| 15488 | GAAACCGGCGGCAGCCCCAAA | 2759 | ETGGSPK | 1.45728072 |
| 12756 | GGTGTTGAGCAGCGTTCGGGG | 27 | GVEQRSG | 1.456753138 |
| 15489 | CAAGGCCACACCAACGTCGCC | 2760 | QGHTNVA | 1.455309339 |
| 12757 | AATGGTGGTAAGTCGAGTTCG | 28 | NGGKSSS | 1.451684533 |
| 12758 | TCGACTAATAAGAGTAATCTG | 29 | STNKSNL | 1.44624661 |
| 15490 | TCGCATGGGAGTCCGGCTAGT | 2761 | SHGSPAS | 1.445456265 |
| 15491 | AGCCAAAAAGCGTCGCCGGC | 2762 | SQKSVAG | 1.445456265 |
| 15492 | GTTGGTCAGTCTGCTGCTCAG | 2763 | VGQSAAQ | 1.444470352 |
| 15493 | GACGGCCAAAGCAGCAAAAGC | 2764 | DGQSSKS | 1.444085169 |
| 15494 | GCCCAAGCCAAACCCGCCGGC | 2765 | AQAKPAG | 1.442429811 |
| 15495 | ACCGGCCACAACAGCAGCATG | 2766 | TGHNSSM | 1.435696428 |
| 15496 | GGCCAAAGCACCAGCAGCGGC | 2767 | GQSTSSG | 1.432491288 |
| 15497 | ACCGGCATCAGCGGCGCCGGC | 2768 | TGISGAG | 1.429944099 |
| 12759 | GACGGCCAAGGCAACGGCAAA | 30 | DGQGNGK | 1.424823398 |
| 15498 | GTCAGAGACACCAGCAGCAGC | 2769 | VRDTSSS | 1.417512639 |

Modified AAV Capsid Proteins Targeting Organs or Tissues

Disclosed herein are recombinant AAV (rAAV) capsid proteins comprising a desired tropism characterized by a substitution or an insertion of at least one amino acid at an amino acid position described above in a parental AAV capsid protein (e.g., AAV5 or AAV9). The AAV capsid protein of the present disclosure is engineered to have a desired tropism comprising increased specificity for a target in vivo environment in a subject, such as an organ or organ system. One of the many advantages of the tropism of the rAAV capsid proteins described herein is their ability to express the heterologous nucleic acid in the organ, or organ system selectively and efficiently, while avoiding expression of the heterologous nucleic acid in an off-target organ, thereby reducing toxicity and the viral dosage amount required for therapeutic effectiveness.

The in vivo environment can be a tissue or a cell. The in vivo environment can be a tissue, such as from an organ or organ system. Non-limiting examples of an organ or organ system include a liver, intestine, heart, lung, reproductive organ, muscle, adipose, pancreas, a brain, and spleen. Non-limiting examples of a reproductive organ include an ovary and a testicle. The in vivo environment can be a cell. The cell can be a cell-type selected from the group consisting of a central nervous system (CNS) cell, a peripheral nervous system (PNS) cell, a liver cell, an intestine cell, a lung cell, a heart cell, an adipose cell, a muscle cell, a kidney cell, a muscle cell, a pancreas cell, a spleen cell, a reproductive organ cell, and a stomach cell. The CNS cell can be a neuron or a glial cell. The glial cell can be selected from the group consisting of an oligodendrocyte, an ependymal cell, and an astrocyte. The PNS cell can be a neuron or a glial cell. The glial cell can be selected from the group consisting of a Schwann cell a satellite cell, and an enteric glial cell. The liver cell can be a hepatocyte. The intestine cell can be selected from the group consisting of an enterocyte, a goblet cell, an enteroendocrine cell, a cup cell, a tuft cell, and a Paneth cell. The lung cell can be selected from the group consisting of an alveolar type I epithelial cell, an alveolar type II epithelial cell, an alveolar type I pneumocyte, an alveolar type II pneumocyte, a capillary endothelial cell, and an alveolar macrophage. The heart cell can be a cardiomyocyte. The stomach cell can be selected from the group consisting of a mucous cell, a parietal cell, a chief cell, and a G cell. The muscle cell can be a myocyte.

rAAVs of the present disclosure that are optimized for targeting specific organ or tissue within a subject have amino acid sequences comprising an amino acid sequence provided in SEQ ID NOS: 25469-35471. In some embodiments, rAAVs optimized for targeting the heart have amino acid sequence comprising an amino acid sequence provided in SEQ ID NOS: 25469-26205. In some embodiments, rAAVs optimized for targeting the lung have amino acid sequences comprising an amino acid sequence provided in SEQ ID NOS: 32537-34198. In some embodiments, rAAVs optimized for targeting the liver have amino acid sequences that comprise an amino acid sequence provided in SEQ ID NOS: 30720-30923. In some embodiments, rAAVs optimized for targeting the intestine have amino acid sequences comprising an amino acid sequence provided in SEQ ID NOS: 26206-26873. In some embodiments, rAAVs optimized for targeting the stomach have amino acid sequences comprising amino acid sequence provided in SEQ ID NOS: 31873-32060. In some embodiments, rAAVs optimized for targeting the spleen have amino acid sequences comprising an amino acid sequence provided in SEQ ID NOS: 31468-31872. In some embodiments, rAAVs optimized for targeting the kidney have amino acid sequences comprising an amino acid sequence provided in SEQ ID NOS: 26874-30719. In some embodiments, rAAVs optimized for targeting the fat (adipose) have amino acid sequences comprising an amino acid sequence provided in SEQ ID NOS: 34199-35471. In some embodiments, rAAVs optimized for targeting the muscle have amino acid sequences comprising an amino acid sequence provided in SEQ ID NO: 30924-31451. The muscle may be cardiac muscle. The muscle may be skeletal muscle. In some embodiments, rAAVs optimized for targeting the pancreas have amino acid sequences comprising an amino acid sequence provided in SEQ ID NOS: 31452-31467. In some embodiments, rAAVs optimized for targeting a reproductive organ, such as a testicle, comprise amino acid sequences comprising an amino acid sequence provided in SEQ ID NOS: 32061-32536. In some instances, the reproductive organ is an ovary.

Disclosed herein are rAAV capsid proteins comprising a desired tropism characterized by a substitution of at least one amino acid at an amino acid position selected from 452-458 in an amino acid sequence of a parental AAV9 capsid protein, or a variant thereof. The rAAV capsid protein can comprise a substitution of at least one amino acid in a parental AAV capsid protein. In some instances, X1 is K, R, N, or T. The rAAV capsid protein can comprise a substitution or an insertion of at least two amino acids in a parental AAV capsid protein, wherein X1 is K, R, N, or T; and X2 is D, E, N, or V. The rAAV capsid protein can comprise a substitution or an insertion of at least three amino acids in a parental AAV capsid protein, wherein X1 is K, R, N, or T; X2 is D, E, N, or V; and X3 is N, S, L, or P. The rAAV capsid protein can comprise a substitution or an insertion of at least four amino acids in a parental AAV capsid protein, wherein X1 is K, R, N, or T; X2 is D, E, N, or V; X3 is N, S, L, or P; and X4 is T, S, P, or L. The rAAV capsid protein can comprise a substitution or an insertion of at least five amino acids in a parental AAV capsid protein, wherein X1 is K, R, N, or T; X2 is D, E, N, or V; X3 is N, S, L, or P; X4 is T, S, P, or L; and X5 is P, R, or S. The rAAV capsid protein can comprise a substitution or an insertion of at least six amino acids in a parental AAV capsid protein, wherein X1 is K, R, N, or T; X2 is D, E, N, or V; X3 is N, S, L, or P; X4 is T, S, P, or L; X5 is P, R, or S; and X6 is G, S, N, or T. The rAAV capsid protein can comprise a substitution or an insertion of at least seven amino acids in a parental AAV capsid protein, wherein, X1 is K, R, N, or T; X2 is D, E, N, or V; X3 is N, S, L, or P; IX4 is T, S, P, or L; X5 is P, R, or S; X6 is G, S, N, or T; and X7 is R, L or I.

In some embodiments, X1, X2, X3, X4, X5, X6, and X7 are contiguous (X1-X2-X3-X4-X5-X6-X7). In some embodiments, any two of X1, X2, X3, X4, X5, X6, and X7 are contiguous. In some embodiments, any three of X1, X2, X3, X4, X5, X6, and X7 are contiguous. In some embodiments, any four of X1, X2, X3, X4, X5, X6, and X7 are contiguous. In some embodiments, any five of X1, X2, X3, X4, X5, X6, and X7 are contiguous. In some embodiments, any six of X1, X2, X3, X4, X5, X6, and X7 are contiguous. In some embodiments, any seven of X1, X2, X3, X4, X5, X6, and X7 are contiguous. In some embodiments, X1, X2, X3, X4, X5, X6, and X7 are not contiguous. In some embodiments, X1 is at an amino acid position 452 within an AAV9 capsid protein, or variant thereof. In some embodiments X2 is at an amino acid position 453 within an AAV9 capsid protein, or variant thereof. In some embodiments X3 is at an amino acid position 454 within an AAV9 capsid protein, or variant thereof. In some embodiments X4 is at an amino acid position 455 within an AAV9 capsid protein, or variant thereof. In some embodiments X5 is at an amino acid position 456 within an AAV9 capsid protein, or variant thereof. In some embodiments X6 is at an amino acid position 457 within an AAV9 capsid protein, or variant thereof. In some embodiments X7 is at an amino acid position 458 within an AAV9 capsid protein, or variant thereof.

Disclosed herein are rAAV capsid proteins that comprise a substitution of at least one, two, three, four, five, six, or seven amino acids provided any one of SEQ ID NOS: 25469-35471. In some embodiments, the at least one, two, three, four, five, six, or seven amino acids are provided in an amino acid sequence selected from SEQ ID NOS: 25469-26205. In some embodiments, the at least one, two, three, four, five, six, or seven amino acids are provided in an amino acid sequence selected from SEQ ID NOS: 26206-26873. In some embodiments, the at least one, two, three, four, five, six, or seven amino acids are provided in an amino acid sequence selected from SEQ ID NOS: 26874-30719. In some embodiments, the at least one, two, three, four, five, six, or seven amino acids are provided in an amino acid sequence selected from SEQ ID NOS: 30720-30923. In some embodiments, the at least one, two, three, four, five, six, or seven amino acids are provided in an amino acid sequence selected from SEQ ID NO: 30924-31451. In some embodiments, the at least one, two, three, four, five, six, or seven amino acids are provided in an amino acid sequence selected from SEQ ID NOS: 31452-31467. In some embodiments, the at least one, two, three, four, five, six, or seven amino acids are provided in an amino acid sequence selected from SEQ ID NOS: 31468-31872. In some embodiments, the at least one, two, three, four, five, six, or seven amino acids are provided in an amino acid sequence selected from SEQ ID NOS: 31873-32060. In some embodiments, the at least one, two, three, four, five, six, or seven amino acids are provided in an amino acid sequence selected from SEQ ID NOS: 32061-32536. In some embodiments, the at least one, two, three, four, five, six, or seven amino acids are provided in an amino acid sequence selected from SEQ ID NOS: 32537-34198. In some embodiments, the at least one, two, three, four, five, six, or seven amino acids are provided in an amino acid sequence selected from SEQ ID NOS: 34199-35471. In some embodiments, the substitution comprises N452K, N452R, N452T, G453D, G453L, G453E, G453V, G453N, G453S, G453L, G453P, S454L, S454P, S454A, S454D, S454G, S454T, G455T, G455S, G455P, G455L, Q456P, Q456R, Q456S, N457G, N457S, N457T, Q458R, Q458L or Q458I, or a combination thereof.

Disclosed herein are rAAV capsid proteins that comprise a substitution of at least or about one, two, three, four, five, six, or seven amino acids of an amino acid sequence provided herein. In some embodiments, the amino acid sequence is KDNTPGR (SEQ ID NO: 32538). In some embodiments, the amino acid sequence is NNLPRNL (SEQ ID NO: 32867). In some embodiments, the amino acid sequence is RESSPSL (SEQ ID NO: 29065). In some embodiments, the amino acid sequence is RVPLSTI (SEQ ID NO: 26933).

In some instances, the substitution of an amino acid is at an amino acid position selected from 452-458 in a capsid amino acid sequence of AAV9 or a variant thereof. In some instances, the substitution of the amino acid is at amino acid position selected from 452-458 in a capsid amino acid sequence provided in SEQ ID NO: 1. In some instances, the substitution of the amino acid is at amino acid position selected from 452-458 in a capsid amino acid sequence of AAV5 or variant thereof. In some instances, the substitution of the amino acid is at amino acid position selected from 452-458 in a capsid amino acid sequence of provided in SEQ ID NO: 2. In some instances, the substitution of the amino acid is at amino acid position selected from 452-458 in the AAVV-PHP.B capsid protein sequence (SEQ ID NO: 3). In some instances, the substitution of the amino acid is at amino acid position selected from 452-458 in the AAV-PHP.S capsid protein sequence (SEQ ID NO: 4). In some instances, the substitution of the amino acid is at amino acid position selected from 452-458 in the AAV-PHP.eB capsid protein sequence (SEQ ID NO: 5). In some embodiments, the rAAV of the present disclosure comprises the substitution of the amino acid at an amino acid position selected from 452-458 in a parental AAV capsid protein, and an insertion of an amino acid or amino acid sequence at an amino acid position 588-589 in the parental AAV capsid protein.

The rAAV capsid proteins of the present disclosure may also have an insertion of an amino acid sequence at amino acid position 588 in a parental AAV9 or AAV5 capsid protein, or variant thereof. In some embodiments, the insertion of the amino acid sequence comprises X1LAVPFK (SEQ ID NO: 45481) at amino acid position 588-589 in the parental AAV9 AAV5 capsid protein, wherein X1 is any amino acid other than T, S, or N. In some embodiments, the insertion of the amino acid sequence comprises X1X2AVPFK (SEQ ID NO: 45482) at amino acid position 588-589 in the parental AAV9 or AAV5 capsid protein, wherein X2 is any amino acid other than L or V. In some embodiments, the insertion of the amino acid sequence comprises X1X2X3VPFK (SEQ ID NO: 45483) at amino acid position 588-589 in the parental AAV9 or AAV5 capsid protein, wherein X3 is any amino acid other than A, S, Q, P, and T. In some embodiments, the insertion of the amino acid sequence comprises X1X2X3X4PFK (SEQ ID NO: 45484) at amino acid position 588-589 in the parental AAV9 or AAV5 capsid protein, wherein X4 is any amino acid other than V, T, Q, N, L, and M. In some embodiments, the insertion of the amino acid sequence comprises TLAX4PFK (SEQ ID NO: 45485) at amino acid position 588-589 in the parental AAV9 or AAV5 capsid protein, wherein X is any amino acid other than V, T, Q, N, L, and M. In some embodiments, the rAAV further comprises a substitution of an amino acid at an amino acid position 587 in the parental AAV9 or AAV5 capsid protein, or variant thereof. In some embodiments, the substitution is A587D. In some embodiments, the substitution is a substitution with amino acid other than D. In some embodiments, the rAAV further comprises a substitution of an amino acid at an amino acid position 588 in the parental AAV9 or AAV5 capsid protein or variant thereof. In, some embodiments, the substitution is Q588G. In some embodiments, the substitution is a substitution with amino acid other than G.

In some embodiments, the rAAV capsid protein comprises a substitution of at least or about three, four, five, six, or seven amino acids of an amino acid sequence KDNTPGR (SEQ ID NO:32538) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence KDNTPGR (SEQ ID NO:32538) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence KDNTPGR (SEQ ID NO:32538) at an amino acid position 452-458 in a parental AAV9 variant capsid protein (SEQ ID NO: 5). In some embodiments, the rAAV capsid protein comprises a substitution of at least or about three, four, five, six, or seven amino acids of an amino acid sequence KDNTPGR (SEQ ID NO:32538) at an amino acid position 452-458 in a parental AAV5 capsid protein (SEQ ID NO: 2). In some embodiments, the rAAV capsid protein comprises a substitution of at least or about three, four, five, six, or seven amino acids of an amino acid sequence KDNTPGR (SEQ ID NO:32538) at an amino acid position 452-458 in a parental AAV5 variant capsid protein. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the rAAV capsid protein comprises an amino acid sequence provided in SEQ ID NO: 46400.

In some embodiments, the rAAV capsid protein comprises a substitution of at least or about three, four, five, six, or seven amino acids of an amino acid sequence NNLPRNL (SEQ ID NO: 32867) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence NNLPRNL (SEQ ID NO: 32867) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence NNLPRNL (SEQ ID NO: 32867) at an amino acid position 452-458 in a parental AAV9 variant capsid protein (SEQ ID NO: 5). In some embodiments, the rAAV capsid protein comprises a substitution of at least or about three, four, five, six, or seven amino acids of an amino acid sequence NNLPRNL (SEQ ID NO: 32867) at an amino acid position 452-458 in a parental AAV5 capsid protein (SEQ ID NO: 2). In some embodiments, the rAAV capsid protein comprises a substitution of at least or about three, four, five, six, or seven amino acids of an amino acid sequence NNLPRNL (SEQ ID NO: 32867) at an amino acid position 452-458 in a parental AAV5 variant capsid protein. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the rAAV capsid protein comprises an amino acid sequence provided in SEQ ID NO: 46401.

In some embodiments, the rAAV capsid protein comprises a substitution of at least or about three, four, five, six, or seven amino acids of an amino acid sequence RESSPSL (SEQ ID NO: 29065) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence RESSPSL (SEQ ID NO: 29065) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence RESSPSL (SEQ ID NO: 29065) at an amino acid position 452-458 in a parental AAV9 variant capsid protein (SEQ ID NO: 5). In some embodiments, the rAAV capsid protein comprises a substitution of at least or about three, four, five, six, or seven amino acids of an amino acid sequence RESSPSL (SEQ ID NO: 29065) at an amino acid position 452-458 in a parental AAV5 capsid protein (SEQ ID NO: 2). In some embodiments, the rAAV capsid protein comprises a substitution of at least or about three, four, five, six, or seven amino acids of an amino acid sequence RESSPSL (SEQ ID NO: 29065) at an amino acid position 452-458 in a parental AAV5 variant capsid protein. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the rAAV capsid protein comprises an amino acid sequence provided in SEQ ID NO: 46402.

In some embodiments, the rAAV capsid protein comprises a substitution of at least or about three, four, five, six, or seven amino acids of an amino acid sequence RVPLSTI (SEQ ID NO: 26933) at an amino acid position 452-458 in a parental AAV9 capsid protein (SEQ ID NO: 1). In some embodiments, the rAAV capsid protein comprises a substitution of at least or about three, four, five, six, or seven amino acids of an amino acid sequence RVPLSTI (SEQ ID NO: 26933) at an amino acid position 452-458 in a parental AAV9 variant capsid protein (SEQ ID NO: 3). In some embodiments, the rAAV capsid protein comprises a substitution of at least or about three, four, five, six, or seven amino acids of an amino acid sequence RVPLSTI (SEQ ID NO: 26933) at an amino acid position 452-458 in a parental AAV9 variant capsid protein (SEQ ID NO: 5). In some embodiments, the rAAV capsid protein comprises a substitution of at least or about three, four, five, six, or seven amino acids of an amino acid sequence RVPLSTI (SEQ ID NO: 26933) at an amino acid position 452-458 in a parental AAV5 capsid protein (SEQ ID NO: 2). In some embodiments, the rAAV capsid protein comprises a substitution of at least or about three, four, five, six, or seven amino acids of an amino acid sequence RVPLSTI (SEQ ID NO: 26933) at an amino acid position 452-458 in a parental AAV5 variant capsid protein. In some embodiments, the rAAV capsid protein comprises an insertion of at least or about three, four, five, six, seven, eight, nine, ten, or eleven amino acids at an amino acid position 588-589 in the parental AAV9 capsid protein, or variant thereof. In some embodiments, the rAAV capsid protein comprises an amino acid sequence provided in SEQ ID NO: 46403.

Heterologous Nucleic Acids

Disclosed herein are heterologous nucleic acids comprising therapeutic nucleic acids useful for the treatment or prevention of a disease or condition, or symptom of the disease or condition, disclosed herein. In some embodiments, the therapeutic nucleic acids encode a therapeutic gene expression product. Non-limiting examples of gene expression products include proteins, polypeptides, peptides, enzymes, antibodies, antigen binding fragments, nucleic acid (RNA, DNA, antisense oligonucleotide, siRNA, and the like), and gene editing components, for use in the treatment, prophylaxis, and/or amelioration of the disease or disorder, or symptoms of the disease or disorder. In some instances, the therapeutic nucleic acids are placed in an organism, cell, tissue or organ of a subject by way of a rAAV, such as those disclosed herein.

Disclosed herein are rAAVs, each comprising a viral genome (e.g., a single stranded DNA molecule (ssDNA)). In some instances, the viral vector comprises two inverted terminal repeat (ITR) sequences that are about 145 bases each, flanking the heterologous nucleic acid or transgene. In some embodiments, the transgene comprises a therapeutic nucleic acid, and in some cases, a promoter in cis with the therapeutic nucleic acid in an open reading frame (ORF). The promoter is capable of initiating transcription of therapeutic nucleic acid in the nucleus of the target cell. The ITR sequences can be from any AAV serotype. Non-limiting examples of AAV serotypes include AAV1, AAV2, AAV3, AAV4, AAV5, AAV6, AAV7, AAV8, AAV9, AAV10, AAV11, and AAV12. In some cases, an ITR is from AAV2. In some cases, an ITR is from AAV9.

Disclosed herein are transgenes that can comprise any number of nucleotides. In some cases, a transgene can comprise less than about 100 nucleotides. In some cases, a transgene can comprise at least about 100 nucleotides. In some cases, a transgene can comprise at least about 200 nucleotides. In some cases, a transgene can comprise at least about 300 nucleotides. In some cases, a transgene can comprise at least about 400 nucleotides. In some cases, a transgene can comprise at least about 500 nucleotides. In some cases, a transgene can comprise at least about 1000 nucleotides. In some cases, a transgene can comprise at least about 5000 nucleotides. In some cases, a transgene can comprise at least about 10,000 nucleotides. In some cases, a transgene can comprise at least about 20,000 nucleotides. In some cases, a transgene can comprise at least about 30,000 nucleotides. In some cases, a transgene can comprise at least about 40,000 nucleotides. In some cases, a transgene can comprise at least about 50,000 nucleotides. In some cases, a transgene can comprise between about 500 and about 5000 nucleotides. In some cases, a transgene can comprise between about 5000 and about 10,000 nucleotides. In any of the cases disclosed herein, the transgene can comprise DNA, RNA, or a hybrid of DNA and RNA. In some cases, the transgene can be single stranded. In some cases, the transgene can be double stranded.

Disclosed herein are transgenes useful for modulating the expression or activity of a target gene or gene expression product thereof. In some instances, the transgene is encapsidated by an rAAV capsid protein of an rAAV particle described herein. In some instances, the rAAV particle is delivered to a subject to treat a disease or condition disclosed herein in the subject. In some instances, the delivery is systemic (e.g., intravenous, intranasal).

The transgenes disclosed herein are useful for expressing an endogenous gene at a level similar to that of a healthy or normal individual. This is particularly useful in the treatment of a disease or condition related to the underexpression, or lack of expression, of a gene expression product. In some embodiments, the transgenes disclosed herein are useful for overexpressing an endogenous gene, such that an expression level of the endogenous gene is above the expression level of a healthy or normal individual. Additionally, transgenes can be used to express exogenous genes (e.g., active agent such as an antibody, peptide, nucleic acid, or gene editing components). In some embodiments, the therapeutic gene expression product is capable of altering, enhancing, increasing, or inducing the activity of one or more endogenous biological processes in the cell. In some embodiments, the transgenes disclosed herein are useful for reducing expressing an endogenous gene, such as for example, a dominant negative gene. In some embodiments, the therapeutic gene expression product is capable of altering, inhibiting, reducing, preventing, eliminating, or impairing the activity of one or more endogenous biological processes in the cell. In some aspects, the increase of gene expression refers to an increase by at least about 20%, 30%, 40%, 50%, 60%, 70%, 80%, 85%, 90%, 95% and 100%. In one aspect, the protein product of the targeted gene may be increased by at least about 20%, 30%, 40%, 50%, 60%, 70%, 80%, 85%, 90%, 95% and 100%. In some aspects, the decrease of gene expression refers to an increase by at least about 20%, 30%, 40%, 50%, 60%, 70%, 80%, 85%, 90%, 95% and 100%. In one aspect, the protein product of the targeted gene may be decreased by at least about 20%, 30%, 40%, 50%, 60%, 70%, 80%, 85%, 90%, 95% and 100%.

When endogenous sequences (endogenous or part of a transgene) are expressed with a transgene, the endogenous sequences can be full-length sequences (wild-type or mutant) or partial sequences. The endogenous sequences can be functional. Non-limiting examples of the function of these full length or partial sequences include increasing the serum half-life of the polypeptide expressed by a transgene (e.g., therapeutic gene) and/or acting as a carrier.

A transgene can be inserted into an endogenous gene such that all, some or none of the endogenous gene is expressed. For example, a transgene as described herein can be inserted into an endogenous locus such that some (N-terminal and/or C-terminal to a transgene) or none of the endogenous sequences are expressed, for example as a fusion with a transgene. In other cases, a transgene (e.g., with or without additional coding sequences such as for the endogenous gene) is integrated into any endogenous locus, for example a safe-harbor locus. For example, a Frataxin (FXN) transgene can be inserted into an endogenous FXN gene. A transgene can be inserted into any gene, e.g., the genes as described herein.

At least one advantage of the present disclosure is that virtually any therapeutic nucleic acid may be used to express any therapeutic gene expression product. In some instances, the therapeutic gene expression product is a therapeutic protein or a peptide (e.g., antibody, antigen-binding fragment, peptide, or protein). In one embodiment the protein encoded by the therapeutic nucleic acid is between 50-5000 amino acids in length. In some embodiments the protein encoded is between 50-2000 amino acids in length. In some embodiments the protein encoded is between 50-1000 amino acids in length. In some embodiments the protein encoded is between 50-1500 amino acids in length. In some embodiments the protein encoded is between 50-800 amino acids in length. In some embodiments the protein encoded is between 50-600 amino acids in length. In some embodiments the protein encoded is between 50-400 amino acids in length. In some embodiments the protein encoded is between 50-200 amino acids in length. In some embodiments the protein encoded is between 50-100 amino acids in length. In some embodiments the peptide encoded is between 4-50 amino acids in length. In some embodiments, the protein encoded is a tetrapeptide, a pentapeptide, a hexapeptide, a heptapeptide, an octapeptide, a nonapeptide, or a decapeptide. In some embodiments, the protein encoded comprises a peptide of 2-30 amino acids, such as 5-30, 10-30, 2-25, 5-25, 10-25, or 10-20 amino acids. In some embodiments, the protein encoded comprises a peptide of at least 11, 12, 13, 14, 15, 17, 20, 25 or 30 amino acids, or a peptide that is no longer than 50 amino acids, e.g. no longer than 35, 30, 25, 20, 17, 15, 14, 13, 12, 11 or 10 amino acids.

Non-limiting examples of therapeutic protein or peptides include an adrenergic agonist, an anti-apoptosis factor, an apoptosis inhibitor, a cytokine receptor, a cytokine, a cytotoxin, an erythropoietic agent, a glutamic acid decarboxylase, a glycoprotein, a growth factor, a growth factor receptor, a hormone, a hormone receptor, an interferon, an interleukin, an interleukin receptor, a kinase, a kinase inhibitor, a nerve growth factor, a netrin, a neuroactive peptide, a neuroactive peptide receptor, a neurogenic factor, a neurogenic factor receptor, a neuropilin, a neurotrophic factor, a neurotrophin, a neurotrophin receptor, an N-methyl-D-aspartate antagonist, a plexin, a protease, a protease inhibitor, a protein decarboxylase, a protein kinase, a protein kinsase inhibitor, a proteolytic protein, a proteolytic protein inhibitor, a semaphoring, a semaphorin receptor, a serotonin transport protein, a serotonin uptake inhibitor, a serotonin receptor, a serpin, a serpin receptor, and a tumor suppressor. In certain embodiments, the therapeutic protein or peptide is selected from the group consisting of brain-derived neurotrophic factor (BDNF), ciliary neurotrophic factor (CNTF), macrophage colony-stimulating factor (CSF), epidermal growth factor (EGF), fibroblast growth factor (FGF), gonadotropin, interferon-gamma (IFN), insulin-like growth factor 1 (IFG-1), nerve growth factor (NGF), platelet-derived growth factor (PDGF), pigment epithelium-derived factor (PEDF), transforming growth factor (TGF), transforming growth factor-beta (TGF-B), tumor necrosis factor (TNF), vascular endothelial growth factor (VEGF), prolactin, somatotropin, X-linked inhibitor of apoptosis protein 1 (XIAP1), interleukin 1 (IL-1), IL-2, IL-3, IL-4, IL-5, IL-6, IL-7, IL-8, IL-9, IL-10, IL-10, viral IL-10, IL-11, IL-12, IL-13, IL-14, IL-15, IL-16, IL-17, and IL-18.

A therapeutic gene expression product can comprise gene editing components. Non-limiting examples of gene editing components include those required for CRISPR/Cas, artificial site-specific RNA endonuclease (ASRE), zinc finger endonuclease (ZFN), and transcription factor like effector nuclease (TALEN). In a non-limiting example, a subject having Huntington's disease is identified. The subject is then systemically administered a first amount of a rAAV encapsidating a viral vector encoding ZFN engineered to represses the transcription of the Huntingtin (HTT) gene. In some instances, the route of administration is intravenous. The rAAV will include a modified AAV capsid protein that includes an amino acid sequence provided in any one of Tables 1-2, or SEQ ID NOS: 11-12739, so as to allow proper targeting of the ZFN to the nervous system, while retargeting off-target organs, such as the liver. If needed, the subject is administered a second or third dose of the rAAV, until a therapeutically effective amount of the ZFN is expressed the subject in the nervous system. In another non-limiting example, a subject with cystic fibrosis is identified. The subject is then systemically administered a first amount of a rAAV encapsidating a transgene encoding ZFN engineered to represses the transcription of the cystic fibrosis transmembrane conductance regulator (CFTR) gene. In some instances the route of administration is intranasal (e.g., intranasal spray). The rAAV will include a modified AAV capsid protein that includes an amino acid sequence provided in any one of SEQ ID NOS: 32537-34198, so as to allow proper targeting of the ZFN to the lung. If needed, the subject is administered a second or third dose of the rAAV, until a therapeutically effective amount of the ZFN is expressed the subject in the lung.

A therapeutic nucleic acid can comprise a non-protein coding gene e.g., sequences encoding antisense RNAs, RNAi, shRNAs and micro RNAs (miRNAs), miRNA sponges or decoys, recombinase delivery for conditional gene deletion, conditional (recombinase-dependent) expression, includes those required for the gene editing components described herein. The a non-protein coding gene may also encode a tRNA, rRNA, tmRNA, piRNA, double stranded RNA, snRNA, snoRNA, and/or long non-coding RNA (lncRNA). In some cases, the non-protein coding gene can modulate the expression or the activity of a target gene or gene expression product. a non-protein coding gene. For example, the RNAs described herein may be used to inhibit gene expression in a target cell, for example, a cell in the central nervous system (CNS) or peripheral organ (e.g., lung). In some cases, inhibition of gene expression refers to an inhibition by at least about 20%, 30%, 40%, 50%, 60%, 70%, 80%, 85%, 90%, 95% and 100%. In some cases, the protein product of the targeted gene may be inhibited by at least about 20%, 30%, 40%, 50%, 60%, 70%, 80%, 85%, 90%, 95% and 100%. The gene can be either a wild type gene or a gene with at least one mutation. The targeted protein may be either a wild type protein or a protein with at least one mutation.

A therapeutic nucleic acid can modulates the expression or activity of a gene or gene expression product expressed from the gene that is implicated in disease or disorder of the brain. For example, the therapeutic nucleic acid, in some cases is a gene or a modified version of the gene described herein. In another example, the therapeutic nucleic acid comprises an effector gene expression product such as a gene editing components specific to target a gene therein. Non-limited examples of genes include Sarcoglycan Alpha (SGCA), glutamic acid decarboxylase 65 (GAD65), glutamic acid decarboxylase 67 (GAD67), CLN2 gene, Nerve Growth Factor (NGF), glial cell derived neurotrophic factor (GDNF), Neurturin, Survival Of Motor Neuron 1, Telomeric (SMN1), β-Glucocerebrosidase (GCase), Frataxin (FXN), Huntingtin (HTN), methyl-CpG binding protein 2 (MECP2), peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and NPS3. In some embodiments, the peroxisomal biogenesis factor (PEX) is selected from the group consisting of PEX1, PEX2, PEX3, PEX4, PEX5, PEX6, PEX7, PEX10, PEX1113, PEX12, PEX13, PEX14, PEX16, PEX19, and PEX26. In some instances, the gene or gene expression product is inhibited. In some instances, the gene or gene expression product is enhanced.

A therapeutic nucleic acid modulates expression or activity of a gene or gene expression product expressed from the gene that is implicated in disease or disorder of a particular organ (e.g., lung, heart, liver, muscle, eye). Non-limited examples of genes include Cystic Fibrosis Transmembrane Conductance Regulator (CFTR), Factor X (FIX), RPE65, Retinoid Isomerohydrolase (RPE65), Sarcoglycan Alpha (SGCA), and sarco/endoplasmic reticulum Ca2+-ATPase (SERCA2a). In some embodiments, the therapeutic gene expression product is of human, murine, avian, porcine, bovine, ovine, feline, canine, equine, epine, caprine, lupine or primate origin. In some instances, the gene or gene expression product is inhibited. In some instances, the gene or gene expression product is enhanced.

Disclosed herein are modified viral genomes comprising genetic information (e.g., heterologous nucleic acid) that are assembled into a rAAV via viral packaging. In some instances, the viral genome is from an AAV serotypes selected from the group consisting of AAV1, AAV2, AAV3, AAV4, AAV5, AAV6, AAV7, AAV8, AAV9, AAV10, AAV11, and AAV12. In some instances, the viral genome is from a modified AAV serotype selected from the group consisting of AAV-PHP.B, AAV-PHP.eB, and AAV-PHP.S.

A viral genome, such as those described herein, can comprise a transgene, which in some cases encodes a heterologous gene expression product (e.g., therapeutic gene expression product, recombinant capsid protein, and the like). The transgene is in cis with two inverted terminal repeats (ITRs) flanking the transgene. The transgene may comprise a therapeutic nucleic acid encoding a therapeutic gene expression product. Due to the limited packaging capacity of the rAAV (~2.5 kB), in some cases, a longer transgene may be split between two AAV vectors, the first with 3' splice donor and the second with a 5' splice acceptor. Upon co-infection of a cell, concatemers form, which are spliced together to express a full-length transgene.

The viral genome, in some cases, is a single stranded viral DNA comprising the transgene. The AAV vector can be episomal. In some instances, the viral genome is a concatemer. An episomal viral genome can develop chromatin-like organization in the target cell that does not integrate into the genome of the target cell. When infected into non-dividing cells, the stability of the episomal viral genome in the target cell enable the long-term transgene expression. Alternatively, the AAV vector integrates the transgene into the genome of the target cell predominantly at a specific site (e.g., AAVS1 on human chromosome 19).

A transgene is generally inserted so that its expression is driven by the endogenous promoter at the integration site, namely the promoter that drives expression of the endogenous gene into which a transgene is inserted. In some instances, a transgene comprises a promoter and/or enhancer, for example a constitutive promoter or an inducible or tissue/cell specific promoter. As a non-limiting example, the promoter may be CMV promoter, a CMV-β-Actin-intron-β-Globin hybrid promoter (CAG), CBA promoter, FRDA or FXN promoter, UBC promoter, GUSB promoter, NSE promoter, Synapsin promoter, MeCP2 promoter, GFAP promoter, H1 promoter, U6 promoter, NFL promoter, NFH promoter, SCN8A promoter, or PGK promoter. As a non-limiting example, promoters can be tissue-specific expression elements include, but are not limited to, human elongation factor 1α-subunit (EF1α), immediate-early cytomegalovirus (CMV), chicken β-actin (CBA) and its derivative CAG, the β glucuronidase (GUSB), and ubiquitin C (UBC). The transgene may include a tissue-specific expression elements for neurons such as, but not limited to, neuron-specific enolase (NSE), platelet-derived growth factor (PDGF), platelet-derived growth factor B-chain (PDGF-β), the synapsin (Syn), the methyl-CpG binding protein 2 (MeCP2), Ca2+/calmodulin-dependent protein kinase II (CaMKII), metabotropic glutamate receptor 2 (mGluR2), NFL, NFH, np32, PPE, Enk and EAAT2 promoters. The transgene may comprise a tissue-specific expression elements for astrocytes such as, but not limited to, the glial fibrillary acidic protein (GFAP) and EAAT2 promoters. The transgene may comprise tissue-specific expression elements for oligodendrocytes such as, but not limited to, the myelin basic protein (MBP) promoter. In one embodiment, the transgene comprises a region located approximately ~5 kb upstream of the first exon of the encoded therapeutic nucleic acid, more specifically, there is a 17 bp region located approximately 4.9 kb upstream of the first exon of the encoded frataxin gene in order to allow for expression with the FRDA promoter (See e.g., Puspasari et al. Long Range Regulation of Human FXN Gene Expression, PLOS ONE, 2011; the contents of which is herein incorporated by reference in its entirety).

In some embodiments, the promoter is less than 1 kb. The promoter may have a length of 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800 or more than 800. The promoter may have a length between 200-300, 200-400, 200-500, 200-600, 200-700, 200-800, 300-400, 300-500, 300-600, 300-700, 300-800, 400-500, 400-600, 400-700, 400-800, 500-600, 500-700, 500-800, 600-700, 600-800 or 700-800. The promoter may provide expression of the therapeutic gene expression product for a period of time in targeted tissues such as, but not limited to, the central nervous system and peripheral organs (e.g., lung). Expression of the therapeutic gene expression product may be for a period of 1 hour, 2, hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours, 22 hours, 23 hours, 1 day, 2 days, 3 days, 4 days, 5 days, 6 days, 1 week, 8 days, 9 days, 10 days, 11 days, 12 days, 13 days, 2 weeks, 15 days, 16 days, 17 days, 18 days, 19 days, 20 days, 3 weeks, 22 days, 23 days, 24 days, 25 days, 26 days, 27 days, 28 days, 29 days, 30 days, 31 days, 1 month, 2 months, 3 months, 4 months, 5 months, 6 months, 7 months, 8 months, 9 months, 10 months, 11 months, 1 year, 13 months, 14 months, 15 months, 16 months, 17 months, 18 months, 19 months, 20 months, 21 months, 22 months, 23 months, 2 years, 3 years, 4 years, 5 years, 6 years, 7 years, 8 years, 9 years, 10 years, 11 years, 12 years, 13 years, 14 years, 15 years, 16 years, 17 years, 18 years, 19 years, 20 years, 21 years, 22 years, 23 years, 24 years, 25 years, 26 years, 27 years, 28 years, 29 years, 30 years, 31 years, 32 years, 33 years, 34 years, 35 years, 36 years, 37 years, 38 years, 39 years, 40 years, 41 years, 42 years, 43 years, 44 years, 45 years, 46 years, 47 years, 48 years, 49 years, 50 years, 55 years, 60 years, 65 years, or more than 65 years. Expression of the payload may be for 1-5 hours, 1-12 hours, 1-2 days, 1-5 days, 1-2 weeks, 1-3 weeks, 1-4 weeks, 1-2 months, 1-4 months, 1-6 months, 2-6 months, 3-6 months, 3-9 months, 4-8 months, 6-12 months, 1-2 years, 1-5 years, 2-5 years, 3-6 years, 3-8 years, 4-8 years or 5-10 years or 10-15 years, or 15-20 years, or 20-25 years, or 25-30 years, or 30-35 years, or 35-40 years, or 40-45 years, or 45-50 years, or 50-55 years, or 55-60 years, or 60-65 years.

Heterologous nucleic acids and transgenes of the present embodiment may also include plasmid vectors. Plasmid vectors are useful for the generation of the recombinant AAV (rAAV) particles described herein. An AAV vector can comprise a genome of a helper virus. Helper virus proteins are required for the assembly of a recombinant rAAV, and packaging of a transgene containing a heterologous nucleic acid into the rAAV. The helper virus genes are adenovirus genes E4, E2a and VA, that when expressed in the cell, assist with AAV replication. In some embodiments, an AAV vector comprises E2. In some embodiments, an AAV vector comprises E4. In some embodiments, an AAV vector comprises VA. In some instances, the AAV vector comprises one of helper virus proteins, or any combination thereof.

An plasmid vector can comprise a viral genome comprising a nucleic acid encoding the recombinant AAV (rAAV) capsid protein described herein. The viral genome can comprise a Replication (Rep) gene encoding a Rep protein, and Capsid (Cap) gene encoding an Aap protein in the first open reading frame (ORF1) or a Cap protein in the second open reading frame (ORF2). The Rep protein is selected from the group consisting of Rep78, Rep68, Rep52, and Rep40. In some instances, the Cap gene is modified encoding a modified AAV capsid protein described herein. A wild-type Cap gene encodes three proteins, VP1, VP2, and VP3. In some cases, VP1 is modified. In some cases, VP2 is modified. In some cases, VP3 is modified. In some cases, all three VP1-VP3 are modified. The AAV vector can comprise nucleic acids encoding wild-type Rep78, Rep68, Rep52, Rep40 and Aap proteins.

In some instances, the plasmid vector is bacterial. In some instances, the plasmid vector is derived from *Escherichia coli*. In some instances, the nucleic acid sequence comprises, in a 5' to 3' direction: (1) a 5' inverted terminal repeat (ITR) sequence, (2) a Replication (Rep) gene, (3) a Capsid (Cap) gene, and (4) a 3' ITR, wherein the Cap gene encodes the AAV capsid protein described herein. In some instances, the plasmid vector encodes a pseudotyped AAV capsid protein. In some instances, the Cap gene is derived from the deoxyribose nucleic acid (DNA) provided in any one of SEQ ID NOs: 6-10.

In some instances, the 5' ITR and the 3' ITR are derived from an AAV2 serotype. In some instances, the 5' ITR and the 3' ITR are derived from an AAV5 serotype. In some instances, the 5' ITR and the 3' ITR are derived from an AAV9 serotype.

Disclosed herein are plasmid vectors comprising any one of SEQ ID NOS: 12740-25468 and 35472-45474, which are the DNA sequences encoding the rAAV capsid proteins of the present disclosure. In some instances, plasmid vector comprises a Cap gene that is at least 90%, 91%, 92%, 93%, 94%, 95%, 96%, 97%, 98%, 99%, or 100% identical to any one of the DNA sequences provided in SEQ ID NOS: 46404-46423. The plasmid vector of the present disclosure can comprise the VP1 Cap gene comprises any one of SEQ ID NOS: 6-10. An AAV vector can comprise 70%, 75%, 80%, 85%, 90%, 91%, 92%, 93%, 94%, 95%, 96%, 97%, 98%, 99%, or 100% of any one of SEQ ID NOS: 6-10.

Also disclosed are nucleic acids encoding the rAAV capsids comprising variant AAV capsid proteins (e.g., rAAV capsid proteins) of the present disclosure. In some instances, the rAAV capsid proteins comprise a DNA sequence provided in any one of SEQ ID NOS: 46404-46423, which encode the full-length VP1 protein with the 7-mer substituted at amino acid position 452-458. In some cases, the 7-mer is encoded by DNA sequence provided in any one of SEQ ID NOS: 46364-46383.

Provided here are plasmid vectors encoding the rAAV capsid proteins of the present disclosure comprising: (a) a nucleic acid sequence encoding 7-mer amino acid sequence provided in any one of FIGS. 2-14; and (b) a nucleic acid sequence that is 70%, 75%, 80%, 85%, 90%, 91%, 92%, 93%, 94%, 95%, 96%, 97%, 98%, 99%, or 100% of any one of SEQ ID NOS: 6-10. In some instances, AAV9 (SEQ ID NO: 6) is modified to include any one of SEQ ID NOS:

12740-25468 and 35472-45474. In some instances, the AAV-PHP.eB (SEQ ID NO: 10) is modified to include any one of SEQ ID NOS: 12740-25468 and 35472-45474. In some instances, AAV5 (SEQ ID NO: 7) is modified to include any one of SEQ ID NOS: 35472-45474. In some instances, AAV-PHP.B (SEQ ID NO: 8) is modified to include any one of SEQ ID NOS: SEQ ID NOS: 12740-25468 and 35472-45474. In some instances, AAV-PHP.S VP1 (SEQ ID NO: 9) is modified to include any one of SEQ ID NOS: 12740-25468 and 35472-45474. The AAV vector described herein may be used to produce a variant AAV capsid by the methods described herein.

Methods

Methods of Producing rAAVs

Disclosed herein are methods of producing a recombinant AAV (rAAV). In some instances all elements that are required for AAV production in target cell (e.g., HEK293 cells) are transiently transfected into the target cell using suitable methods known in the art. For example, the rAAV of the present disclosure can be product by co-transfecting three plasmid vectors, a first vector with ITR-containing plasmid carrying the transgene (e.g., therapeutic nucleic acid), a second vector that carries the AAV Rep and Cap genes; and (3), a third vector that provides the helper genes isolated from adenovirus. The methods described herein generate high-titer AAV vectors that are free of adenovirus. The Cap gene disclosed here comprises any one of SEQ ID NOS: 12740-25468 and 35472-45474, which are the DNA sequences encoding the modified AAV capsid proteins of the present disclosure. In some cases, rAAVs of the present disclosure are generated using the methods described in Challis, R. C. et al. Systemic AAV vectors for widespread and targeted gene delivery in rodents. *Nat. Protoc.* 14, 379 (2019), which is hereby incorporated by reference in its entirety. Briefly, triple transfection of HEK293T cells (ATCC) using polyethylenimine (PEI) is performed, viruses are collected after 120 hours from both cell lysates and media and purified over iodixanol.

Disclosed herein, are methods of manufacturing comprising: (a) introducing into a cell a nucleic acid comprising: (i) a first nucleic acid sequence encoding a therapeutic gene expression product enclosed by a 5' and a 3' inverted terminal repeat (ITR) sequence; (ii) a second nucleic acid sequence encoding a viral genome comprising a 5' ITR sequence, a Replication (Rep) gene, Capsid (Cap) gene, and a 3' ITR, wherein the Cap gene encodes the AAV capsid protein described herein; and (iii) a third nucleic acid sequence encoding a first helper virus protein selected from the group consisting of E4orf6, E2a, and VA RNA, and optionally, a second helper virus protein comprising E1a or E1b55k; (b) expressing in the cell the AAV capsid protein described herein; (c) assembling an AAV particle comprising the AAV capsid proteins disclosed herein; and (d) packaging the first nucleic acid sequence in the AAV particle. In some instances, the AAV particle is a rAAV capsid with an increased specificity when measured in a target tissue (e.g., CNS, PNS, lung) in a subject and a decreased specificity when measured in an off-target tissue (e.g., liver), relative to a reference AAV capsid. In some instances, the methods further comprise packing the first nucleic acid sequence encoding the therapeutic gene expression product such that it becomes encapsidated by the rAAV capsid protein. In some embodiments, the rAAV particles are isolated, concentrated, and purified using suitable viral purification methods, such as those described herein.

In a non-limiting example, the rAAVs are generated by triple transfection of precursor cells (e.g., HEK293T) cells using a standard transfection protocol (e.g., with PEI). Viral particles are harvested from the media after a period of time (e.g., 72 h post transfection) and from the cells and media at a later point in time (e.g., 120 h post transfection). Virus present in the media is concentrated by precipitation with 8% poly(ethylene glycol) and 500 mM sodium chloride and the precipitated virus is added to the lysates prepared from the collected cells. The viruses are purified over iodixanol (Optiprep, Sigma) step gradients (15%, 25%, 40% and 60%). Viruses are concentrated and formulated in PBS. Virus titers are determined by measuring the number of DNaseI-resistant vector genome copies (VGs) using qPCR and the linearized genome plasmid as a control.

The Rep protein can be selected from the group consisting of Rep78, Rep68, Rep52, and Rep40. The genome of the AAV helper virus comprises an AAV helper gene selected from the group consisting of E2, E4, and VA. In some instances, the first nucleic acid sequence and the second nucleic acid sequence are in trans. In some instances, the first nucleic acid sequence and the second nucleic acid sequence are in cis. In some instances, the first nucleic acid sequence, the second nucleic acid sequence and the third nucleic acid sequence, are in trans.

The cell can be selected from a group consisting of a human, a primate, a murine, a feline, a canine, a porcine, an ovine, a bovine, an equine, an epine, a caprine and a lupine host cell. In some instances, the cell is a progenitor or precursor cell, such as a stem cell. In some instances, the stem cell is a mesenchymal cell, embryonic stem cell, induced pluripotent stem cell (iPSC), fibroblast or other tissue specific stem cell. The cell can be immortalized. In some instances, the embryonic stem cell is a human embryonic stem cell. In some instances, the human embryonic stem cell is a human embryonic kidney 293 (HEK-293) cell. In some instances, the cell is a differentiated cell. Base on the disclosure provided, it is expected that this system can be used in conjunction with any transgenic line expressing a recombinase in the target cell type of interest to develop AAV capsids that more efficiently transduce that target cell population.

Methods of rAAV-Mediated Delivering a Heterologous Nucleic Acid

Disclosed herein are methods of delivering a heterologous nucleic acid (e.g., therapeutic nucleic acid or transgene disclosed herein) to subject in need thereof. The transgene may be encapsidated by a recombinant AAV (rAAV) capsid protein or rAAV particle such as those described herein.

Methods may be ex vivo, e.g., scientific research purposes or for producing adoptive cellular therapies. The subject may be a human primary cell or a mature cell, or cell line. The subject may be a cell from a monkey, hamster, or mouse. In either case, delivery may include contacting the composition with the cell or cell line.

Methods may be in vivo, e.g., treating a disease or a condition in a subject in need thereof. In some instances, the subject may be mammal, such as a human or non-human primate, in which case delivery of the composition may comprise administering the composition to the subject. In some embodiments, delivery of the heterologous nucleic acid comprises administering to the subject the composition using any one of the routes of administration described herein. In a non-limiting example, the rAAV encapsidating an aromatic L-amino acid decarboxylase deficiency (AADC) gene may be administered to a subject intravenously to treat AADC deficiency.

In some embodiments, methods of increasing transduction of a heterologous nucleic acid in a target in vivo or ex vivo tissue comprise delivering a rAAV particle described herein, the rAAV engineered to have an increased transduction efficiency in a target in vivo environment (e.g., tissue or cell type). In some instances, the increased transduction efficiency comprises a 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold increase, or more, relative to a reference AAV. In some instances, the increased transduction efficiency is at least 30-fold. In some instances, the increased transduction efficiency is at least 40-fold. In some instances, the increased transduction efficiency is at least 50-fold. In some instances, the increased transduction efficiency is at least 60-fold. In some instances, the increased transduction efficiency is at least 80-fold. In some instances, the increased transduction efficiency is at least 90-fold. In some instances, the increased transduction efficiency is at least 100-fold.

In some embodiments, methods of decreasing transduction of a heterologous nucleic acid in an off-target in vivo or ex vivo tissue comprise delivering a rAAV particle described herein, the rAAV engineered to have a reduced transduction efficiency by 1-fold, 2-fold, 3-fold, 4-fold, 5-fold, 6-fold, 7-fold, 8-fold, 9-fold, 10-fold, 11-fold, 12-fold, 13-fold, 14-fold, 15-fold, 16-fold, 17-fold, 18-fold, 19-fold, 20-fold, 21-fold, 22-fold, 23-fold, 24-fold, 25-fold, 26-fold, 27-fold, 28-fold, 29-fold, 30-fold, 31-fold, 32-fold, 33-fold, 34-fold, 35-fold, 36-fold, 37-fold, 38-fold, 39-fold, 40-fold, 41-fold, 42-fold, 43-fold, 44-fold, 45-fold, 46-fold, 47-fold, 48-fold, 49-fold, 50-fold, 75-fold, or 100-fold, or more, relative to a reference AAV. In some instances, the off-target gene transfer is reduced by at least 20-fold. In some instances, the off-target gene transfer is reduced by at least 30-fold. In some instances, the off-target gene transfer is reduced by at least 40-fold. In some instances, the off-target gene transfer is reduced by at least 50-fold. In some instances, the off-target gene transfer is reduced by at least 60-fold. In some instances, the off-target gene transfer is reduced by at least 80-fold. In some instances, the off-target gene transfer is reduced by at least 90-fold. In some instances, the off-target gene transfer is reduced by at least 100-fold.

Methods of delivering a heterologous nucleic acid to a target in vivo environment are also provided comprising delivering the a rAAV particle described herein that has been engineered to have an increased specificity in a target in vivo or ex vivo tissue (e.g., organ or cell type), as compared to a reference AAV. In some embodiment, the rAAV particle has been engineered to have a decreased specificity for an off-target in vivo or ex vivo tissue. Methods, in some cases, comprise detecting whether a rAAV possesses more specificity for a target in vivo or ex vivo tissue than a reference AAV, includes measuring a level of gene expression product (e.g., RNA or protein) expressed from the heterologous nucleic acid encapsidated by the rAAV in a tissue sample obtained from the target in vivo environment in a subject; and comparing the measured level to a control level (such as, for e.g., the gene expression product expressed from a heterologous nucleic acid encapsidated by a reference AAV (e.g., AAV9)). Suitable methods for measuring expression of a gene expression product luciferase reporter assay and quantitative polymerase chain reaction (qPCR).

In some instances, the reference AAV has a serotype selected from the group consisting of AAV1, AAV2, AAV3, AAV4, AAV5, AAV6, AAV7, AAV8, AAV9, AAV10, AAV11, AAV12, or variant thereof. For example, the reference AAV can have a serotype selected from the group consisting of AAV-PHP.B, AAV-PHP.eB, and AAV-PHP.S.

Delivery to the Central or Peripheral Nervous System

Provided herein are methods of delivering a heterologous nucleic acid to a target in vivo environment comprising delivering a composition to the target in vivo environment selected from the group consisting of a central nervous system (CNS) and the peripheral nervous system (PNS) in a subject, the composition comprising a rAAV particle with a rAAV capsid protein, the rAAV capsid protein encapsidating a viral vector encoding a heterologous nucleic acid (e.g., therapeutic nucleic acid). In some embodiments, the rAAV particle encapsidating the heterologous nucleic acid comprises a rAAV capsid protein engineered with an increased specificity and, in some cases, transduction efficiency for the CNS or the PNS of the subject, even when administered to the subject systemically, as compared to a reference AAV.

Methods comprise delivering a rAAV particle comprising an rAAV capsid protein with increased specificity and/or transduction efficiency for the CNS or the PNS in the subject, as compared to a reference AAV (e.g., AAV9, AAV5). The rAAV capsid protein, in some cases, has a decreased specificity and/or transduction efficiency for a peripheral organ (e.g., liver). In some instances, the delivery is systemic. Alternatively, delivery is direct (e.g., into the affected area of the CNS or PNS). The rAAV capsid protein may comprise a substitution of at least one amino acid in an amino acid sequence in an amino acid sequence of a parental AAV, wherein X1 is A, D, G, L, N, Q, S, or T. The rAAV capsid protein can comprise a substitution of at least two amino acids in an amino acid sequence of a parental AAV, wherein X1 is A, D, G, L, N, Q, S, or T; and X2 is A, G, N, P, Q, R, S, or T. The rAAV can comprise a substitution of at least three amino in an amino acid sequence of a parental AAV, wherein X1 is A, D, G, L, N, Q, S, or T; and X2 is A, G, N, P, Q, R, S, or T; and X3 is A, D, G, N, S, or T. The rAAV can comprise a substitution of at least four amino acids in an amino acid sequence of a parental AAV, wherein X1 is A, D, G, L, N, Q, S, or T; X2 is A, G, N, P, Q, R, S, or T; X3 is A, D, G, N, S, or T; and X4 is A, D, G, K, N, P Q, S, or T. The rAAV can comprise a substitution of at least five amino acids in an amino acid sequence of a parental AAV, wherein X1 is A, D, G, L, N, Q, S, or T; X2 is A, G, N, P, Q, R, S, or T; X3 is A, D, G, N, S, or T; X4 is A, D, G, K, N, P Q, S, or T; and X5 is A, G, K, N, P, R, S, or T. The rAAV can comprise a substitution of at least six amino acids in an amino acid sequence of a parental AAV, wherein X1 is A, D, G, L, N, Q, S, or T; X2 is A, G, N, P, Q, R, S, or T; X3 is A, D, G, N, S, or T; X4 is A, D, G, K, N, P Q, S, or T; X5 is A, G, K, N, P, R, S, or T; and X6 is A, G, K, N, P, R, S, T, or V. The rAAV can comprise a substitution of at least seven amino acids in an amino acid sequence of a parental AAV, wherein X1 is A, D, G, L, N, Q, S, or T; X2 is A, G, N, P, Q, R, S, or T; X3 is A, D, G, N, S, or T; X4 is A, D, G, K, N, P Q, S, or T; X5 is A, G, K, N, P, R, S, or T; X6 is A, G, K, N, P, R, S, T, or V; and X7 is A, G, K, L, R, S, T, or V.

X1, X2, X3, X4, X5, X6, and X7 are, in some cases, contiguous (X1-X2-X3-X4-X5-X6-X7). Any two, three, four, five, six or seven of X1, X2, X3, X4, X5, X6, and X7 may be contiguous. In some embodiments, X1 is at an amino acid position 452 within an AAV9 capsid protein, or variant thereof. In some embodiments X2 is at an amino acid position 453 within an AAV9 capsid protein, or variant thereof. In some embodiments X3 is at an amino acid position 454 within an AAV9 capsid protein, or variant thereof. In some embodiments X4 is at an amino acid position 455 within an AAV9 capsid protein, or variant thereof. In some embodiments X5 is at an amino acid position 456 within an AAV9 capsid protein, or variant thereof. In some embodiments X6 is at an amino acid position 457 within an AAV9 capsid protein, or variant thereof. In some embodiments X7 is at an amino acid position 458 within an AAV9 capsid protein, or variant thereof.

Methods disclosed herein provide delivering a rAAV particle comprising an rAAV capsid protein with increased specificity and/or transduction efficiency for the CNS or the PNS in the subject, as compared to a reference AAV, wherein the substitution comprises N452D, N452A, N452G, N452L, N452Q, N452S, N452T, G453I, G453N, G453S, G453P, G453R, G453T, S454A, S454Q, S454D, S454G, S454N, S454T, G455A, G455S, G455D, G455K, G455N, G455P, G455Q, G455T, Q456T, Q456S, Q456A, Q456G, Q456K, Q456N, Q456R, Q456P, N457K, N457A, N457G, N457P, N457R, N457S, N457T, N457V, Q458N, Q458A, Q458G, Q458K, Q458L, Q458R, Q458S, Q458T, or Q458V in an amino acid sequence of the AAV9 capsid protein (VP1 numbering), variant thereof, or equivalent amino acid position in a different AAV serotype. In some embodiments, methods comprising delivering a rAAV particle comprising a rAAV capsid protein comprising a substitution of one, two, three, four, five, six, or seven amino acids in an amino acid sequence provided any one of SEQ ID NOS: 11-12739. The substitution can comprise at least one, two, three, four, five, six, or seven, amino acids from an amino acid sequence selected from the group consisting of LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), KGPGQMG (SEQ ID NO: 45476), GTPSKAG (SEQ ID NO: 2741), and any amino acid sequence provided in Table 1 or Table 2. In some embodiments, the rAAV capsid proteins suitable for delivery of a heterologous nucleic acid to the CNS or PNS of a subject may also have an insertion of an amino acid sequence at amino acid position 588 (AAV9 VP1 numbering). In some cases, the rAAV capsid protein has a decreased specificity and/or transduction efficiency for the liver. In some embodiments, the substitution does not consist of an amino acid sequence ILGTGTS (SEQ ID NO: 45479) or QSSQTPR (SEQ ID NO: 45480) at amino acids 452-458 in a parental AAV9 capsid protein, or variant thereof. In some embodiments, the rAAV capsid proteins suitable for delivery of a heterologous nucleic acid to the CNS or PNS of a subject may also have an insertion of an amino acid sequence at amino acid position 588 (AAV9 VP1 numbering).

Disclosed herein are methods comprising delivering a rAAV particle encapsidating a heterologous nucleic acid to a CNS or PNS in a subject, the rAAV particle comprising (i) an increased specificity and/or transduction efficiency of the heterologous nucleic acid for the CNS or PNS, and (ii) a decreased specificity and/or transduction efficiency for the heterologous nucleic acid for the liver, wherein the rAAV particle has an rAAV capsid protein comprising a substitution selected from the group consisting of N452D, N452A, N452V, N452S, N452H, N452L, N452E, N452Q, G452A, G452I, G452T, G452P, G452R, G452T, G452S, G452K, G452H, S454A, S454N, S454D, S454G, S454T, S454H, S454K, S454Q, G455A, G455N, G455T, G455S, G455D, G455P, G455R, G455G, G455Q, Q456T, Q456S, Q456K, Q456P, Q456G, Q456D, Q456V, Q456A, Q456N, N457K, N457T, N457A, N457R, N457S, N457G, N457D, N457P, N457V, Q458N, Q458G, Q458S, Q458L, Q458A, Q458E, and Q458K, in an amino acid sequence of the AAV9 capsid protein, or a variant thereof, or equivalent amino acid position in a different AAV serotype. In some cases, the substitution is of at least or about one two, three, four, five, six, or seven amino acids of an amino acid sequence DGAATKN (SEQ ID NO: 3943). In some cases, the substitution is of at least or about one two, three, four, five, six, or seven amino acids of an amino acid sequence DGQSSKS (SEQ ID NO: 2764). In some cases, the substitution is any amino acid sequence provided in Table 1 or Table 2. In some embodiments, the delivering is systemic. In some embodiments, the delivery is direct (e.g., injected into the in vivo environment). In some embodiments, the parental AAV capsid protein is AAV9 capsid protein (for e.g., provided in SEQ ID NO: 1). In some embodiments, the parental AAV capsid protein is an AAV9 variant capsid protein AAV-PHP.B (SEQ ID NO: 3). In some embodiments, the parental AAV capsid protein is AAV9 variant capsid protein AAV-PHP.eB (SEQ ID NO: 5). In some embodiments, the parental AAV capsid protein further comprises an insertion of at least or about three, four, five, six, seven, eight, nine, ten, or eleven amino acids of an amino acid in an amino acid position 588-589 of the amino acid sequence of the parental AAV (AAV9 VP1 numbering). In some embodiments, delivery is more specific than a delivery of the heterologous nucleic acid by a reference AAV, e.g., AAV9. In some embodiments, methods further comprise reducing or ablating delivery of the heterologous nucleic acid in an off-target in vivo environment, such as the liver. In some embodiments, delivery is characterized by an increase in efficiency of transduction (e.g., of the heterologous nucleic acid) in the CNS or PNS than a transduction efficiency in the CNS or PNS of the reference AAV. In some embodiments, the delivery is systemic (e.g., intravenous). In some embodiments, the subject is a human or a non-human primate.

Delivery to a Target Organs or Tissues

In some cases, the methods of delivering a heterologous nucleic acid comprise delivering to a target in vivo environment in a subject a composition, the composition comprising a rAAV particle with a rAAV capsid protein, the rAAV capsid protein encapsidating a viral vector encoding a heterologous nucleic acid (e.g., therapeutic nucleic acid). In some cases, the target in vivo environment is the liver, intestine, heart, lung, reproductive organ, muscle, adipose, pancreas, a brain, or spleen. In some embodiments, the rAAV particle encapsidating the heterologous nucleic acid comprises a rAAV capsid protein engineered with an increased specificity and, in some cases, transduction efficiency for the target in vivo environment of the subject, even when administered to the subject systemically.

Disclosed herein are methods that comprise delivering to a subject a rAAV particle encapsidating a heterologous nucleic acid, the rAAV comprising an rAAV capsid protein with increased specificity and/or transduction efficiency of the heterologous nucleic acid when measured in the heart of the subject, as compared to a reference AAV (e.g., AAV9, AAV5). In some embodiments, rAAVs optimized for targeting the heart have amino acid sequence comprising an amino acid sequence provided in SEQ ID NOS: 25469-26205. In some embodiments, methods comprise delivering a rAAV particle comprising an rAAV capsid protein with increased specificity and/or transduction efficiency of the heterologous nucleic acid when measured in the lung in the subject, as compared to a reference AAV (e.g., AAV9, AAV5). In some embodiments, rAAVs optimized for targeting the lung have amino acid sequences comprising an amino acid sequence provided in SEQ ID NOS: 32537-34198. In some embodiments, methods comprise delivering a rAAV particle comprising an rAAV capsid protein with increased specificity and/or transduction efficiency of the heterologous nucleic acid when measured in the liver in the subject, as compared to a reference AAV (e.g., AAV9, AAV5). In some embodiments, rAAVs optimized for targeting the liver have amino acid sequences that comprise an amino acid sequence provided in SEQ ID NOS: 30720-30923. In some embodiments, methods comprise delivering a rAAV particle comprising an rAAV capsid protein with increased specificity and/or transduction efficiency of the heterologous nucleic acid when measured in the intestine in the subject, as compared to a reference AAV (e.g., AAV9, AAV5). In some embodiments, rAAVs optimized for targeting the intestine have amino acid sequences comprising an amino acid sequence provided in SEQ ID NOS: 26206-26873. In some embodiments, methods comprise delivering a rAAV particle comprising a rAAV capsid protein with increased specificity and/or transduction efficiency of the heterologous nucleic acid when measured in the stomach in the subject, as compared to a reference AAV (e.g., AAV9, AAV5). In some embodiments, rAAVs optimized for targeting the stomach have amino acid sequences comprising amino acid sequence provided in SEQ ID NOS: 31873-32060. In some embodiments, methods comprise delivering a rAAV particle comprising an rAAV capsid protein with increased specificity and/or transduction efficiency of the heterologous nucleic acid when measured in the spleen in the subject, as compared to a reference AAV (e.g., AAV9, AAV5). In some embodiments, rAAVs optimized for targeting the spleen have amino acid sequences comprising an amino acid sequence provided in SEQ ID NOS: 31468-31872. In some embodiments, methods comprise delivering a rAAV particle comprising a rAAV capsid protein with increased specificity and/or transduction efficiency of the heterologous nucleic acid when measured in the kidney in the subject, as compared to a reference AAV (e.g., AAV9, AAV5). In some embodiments, rAAVs optimized for targeting the kidney have amino acid sequences comprising an amino acid sequence provided in SEQ ID NOS: 26874-30719. In some embodiments, methods comprise delivering a rAAV particle comprising an rAAV capsid protein with increased specificity and/or transduction efficiency of the heterologous nucleic acid when measured in the fat of the subject, as compared to a reference AAV (e.g., AAV9, AAV5). In some embodiments, rAAVs optimized for targeting the fat (adipose) have amino acid sequences comprising an amino acid sequence provided in SEQ ID NOS: 34199-35471.

Provided herein are methods that comprise delivering a rAAV particle to a subject, the rAAV comprising an rAAV capsid protein with increased specificity and/or transduction efficiency of the heterologous nucleic acid for the muscle in the subject, as compared to a reference AAV (e.g., AAV9, AAV5). In some embodiments, rAAVs optimized for targeting the muscle have amino acid sequences comprising an amino acid sequence provided in SEQ ID NO: 30924-31451. The muscle may be cardiac muscle. The muscle may be skeletal muscle. In some embodiments, methods comprise delivering a rAAV particle comprising an rAAV capsid protein with increased specificity and/or transduction efficiency of the heterologous nucleic acid for the pancreas in the subject, as compared to a reference AAV (e.g., AAV9, AAV5). In some embodiments, rAAVs optimized for targeting the pancreas have amino acid sequences comprising an amino acid sequence provided in SEQ ID NOS: 31452-31467. In some embodiments, methods comprise delivering a rAAV particle comprising an rAAV capsid protein with increased specificity and/or transduction efficiency of the heterologous nucleic acid for the reproductive organ(s) in the subject, as compared to a reference AAV (e.g., AAV9, AAV5). In some embodiments, rAAVs optimized for targeting a reproductive organ, such as a testicle, comprise amino acid sequences comprising an amino acid sequence provided in SEQ ID NOS: 32061-32536. In some instances, the reproductive organ is an ovary.

The rAAV capsid protein suitable for delivery of the heterologous nucleic acid to the liver, intestine, heart, lung, reproductive organ, muscle, adipose, pancreas, a brain, or spleen can comprise a substitution of at least one amino acid in a parental AAV capsid protein. In some embodiments, X1 is K, R, N, or T. The rAAV capsid protein can comprise a substitution or an insertion of at least two amino acids in a parental AAV capsid protein. In some embodiments, X1 is K, R, N, or T; and X2 is D, E, N, or V. The rAAV capsid protein can comprise a substitution or an insertion of at least three amino acids in a parental AAV capsid protein. In some embodiments, X1 is K, R, N, or T; X2 is D, E, N, or V; and X3 is N, S, L, or P. The rAAV capsid protein can comprise a substitution or an insertion of at least four amino acids in a parental AAV capsid protein. In some embodiments, X1 is K, R, N, or T; X2 is D, E, N, or V; X3 is N, S, L, or P; and X4 is T, S, P, or L. The rAAV capsid protein can comprise a substitution or an insertion of at least five amino acids in a parental AAV capsid protein. In some embodiments, X1 is K, R, N, or T; X2 is D, E, N, or V; X3 is N, S, L, or P; X4 is T, S, P, or L; and X5 is P, R, or S. The rAAV capsid protein can comprise a substitution or an insertion of at least six amino acids in a parental AAV capsid protein. In some embodiments, X1 is K, R, N, or T; X2 is D, E, N, or V; X3 is N, S, L, or P; X4 is T, S, P, or L; X5 is P, R, or S; and X6 is G, S, N, or T. The rAAV capsid protein can comprise a substitution or an insertion of at least seven amino acids in a parental AAV capsid protein. In some embodiments, X1 is K, R, N, or T; X2 is D, E, N, or V; X3 is N, S, L, or P; IX4 is T, S, P, or L; X5 is P, R, or S; X6 is G, S, N, or T; and X7 is R, L or I. In some embodiments, X1, X2, X3, X4, X5, X6, and X7 are contiguous (X1-X2-X3-X4-X5-X6-X7). In some embodiments, any two, three, four, five, six, or seven, of X1, X2, X3, X4, X5, X6, and X7 are contiguous. In some embodiments, X1, X2, X3, X4, X5, X6, and X7 are not contiguous. In some embodiments, X1 is at an amino acid position 452 within an AAV9 capsid protein, or variant thereof. In some embodiments X2 is at an amino acid position 453 within an AAV9 capsid protein, or variant thereof. In some embodiments X3 is at an amino acid position 454 within an AAV9 capsid protein, or variant thereof. In some embodiments X4 is at an amino acid position 455 within an AAV9 capsid protein, or variant thereof. In some embodiments X5 is at an amino acid position 456 within an AAV9 capsid protein, or variant thereof. In some embodiments X6 is at an amino acid position 457 within an AAV9 capsid protein, or variant thereof. In some embodiments X7 is at an amino acid position 458 within an AAV9 capsid protein, or variant thereof. In some embodiments, the substitution does not consist of an amino acid sequence ILGTGTS (SEQ ID NO: 45479) or QSSQTPR (SEQ ID NO: 45480) at amino acids 452-458 in a parental AAV9 capsid protein, or variant thereof. In some embodiments, the rAAV capsid proteins suitable for delivery of a heterologous nucleic acid to the target in vivo environment of a subject may also have an insertion of an amino acid sequence at amino acid position 588 (AAV9 VP1 numbering).

Disclosed herein are methods comprising delivering a rAAV particle encapsidating a heterologous nucleic acid to the target in vivo environment selected from the group consisting of the liver, intestine, heart, lung, reproductive organ, muscle, adipose, pancreas, a brain, and spleen, in a subject, the rAAV particle comprising an increased specificity and/or transduction efficiency of the heterologous nucleic acid for the target in vivo environment, wherein the rAAV particle has an rAAV capsid protein comprising a substitution of at least or about three, four, five, six, or seven amino acids of an amino acid sequence KDNTPGR (SEQ ID NO: 32538), NNLPRNL (SEQ ID NO: 32867), RESSPSL (SEQ ID NO: 29065), or RVPLSTI (SEQ ID NO: 26933) at an amino acid position 452-458 in a parental AAV capsid protein. In some embodiments, the parental AAV capsid protein is AAV9 capsid protein (for e.g., provided in SEQ ID NO: 1). In some embodiments, the parental AAV capsid protein is AAV5 capsid protein (for e.g., provided in SEQ ID NO: 2). In some embodiments, the parental AAV capsid protein is an AAV9 variant capsid protein AAV-PHP.B (SEQ ID NO: 3). In some embodiments, the parental AAV capsid protein is AAV9 variant capsid protein AAV-PHP.eB (SEQ ID NO: 5). In some embodiments, the parental AAV capsid protein further comprises an insertion of at least or about three, four, five, six, seven, eight, nine, ten, or eleven amino acids of an amino acid in an amino acid position 588-589 of the amino acid sequence of the parental AAV (AAV9 VP1 numbering). In some embodiments, delivery is more specific than a delivery of the heterologous nucleic acid by a reference AAV, e.g., AAV9. In some embodiments, methods further comprise reducing or ablating delivery of the heterologous nucleic acid in an off-target in vivo environment, such as the liver, compared to a reference AAV. In some embodiments, delivery is characterized by an increase in efficiency of transduction (e.g., of the heterologous nucleic acid) in the target in vivo environment than a transduction efficiency in the target in vivo environment of the reference AAV. In some embodiments, the delivery is systemic (e.g., intravenous). In some embodiments, the subject is a human or a non-human primate.

Methods of Treatment

Disclosed herein are methods of treating a disease or condition, or a symptom of the disease or condition, in a subject, comprising administrating of therapeutically effective amount of one or more compositions (e.g., rAAV particle, AAV vector, pharmaceutical formulations and composition) disclosed herein to the subject. In some embodiments, the composition is a rAAV capsid protein described herein. In some embodiments, the composition is an isolated and purified rAAV capsid protein described herein. In some embodiments, the rAAV particle encapsidates a heterologous nucleic acid comprising a transgene (e.g., therapeutic nucleic acid). In some embodiments, the composition is a rAAV capsid protein described herein conjugated with a therapeutic agent disclosed herein. In some embodiments, the composition is a pharmaceutical composition comprising the rAAV particle and a pharmaceutically acceptable carrier. In some embodiments, the one or more compositions are administered to the subject alone (e.g., standalone therapy). In some embodiments, the one or more compositions are administered in combination with an additional agent. In some embodiments, the composition is a first-line therapy for the disease or condition. In some embodiments, the composition is a second-line, third-line, or fourth-line therapy, for the disease or condition.

Provided herein are methods of treating a disease or a condition, or a symptom of the disease or condition, in a subject, comprising: (a) diagnosing a subject with a disease or a condition affecting a target in vivo environment; and (b) treating the disease or the condition by administering to the subject a therapeutically effective amount of a composition disclosed herein (e.g., rAAV particle, AAV vector, pharmaceutical composition), wherein the composition is engineered with an increased specificity for the target in vivo environment. In some cases, the composition is engineered with a decreased specificity for an off-target in vivo environment, e.g., the liver.

Disclosed herein are methods of treating a disease or a condition, or a symptom of the disease or the condition, afflicting a target in vivo environment in a subject comprising: (a) administering to the subject a composition (e.g., rAAV particle, AAV vector, pharmaceutical composition); and (b) expressing the therapeutic nucleic acid into a target in vivo environment in the subject with an increased specificity and/or transduction efficiency, as compared to a reference AAV. In some cases, the reference AAV is AAV9 or AAV5, or a variant thereof.

Methods of treating a disease or condition affecting the central nervous system (CNS) or peripheral nervous system (PNS) comprise administering a rAAV particle to a subject, the rAAV particle comprising an rAAV capsid protein comprising a substitution of at least or about three, four, five, six, or seven amino acids of an amino acid sequence DGAATKN (SEQ ID NO: 3943) or DGQSSKS (SEQ ID NO: 2764), LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), KGPGQMG (SEQ ID NO: 45476), GTPSKAG (SEQ ID NO: 2741), and any amino acid sequence provided in Table 1, Table 2, FIG. 2, or FIG. 3, at an amino acid position 452-458 in a parental AAV capsid protein. In some embodiments, the rAAV capsid protein comprises an amino acid sequence provided in any one of SEQ ID NOS: 46384-46399.

In some embodiments, the parental AAV capsid protein is AAV9 capsid protein (for e.g., provided in SEQ ID NO: 1). In some embodiments, the parental AAV capsid protein is an AAV9 variant capsid protein AAV-PHP.B (SEQ ID NO: 3). In some embodiments, the parental AAV capsid protein is AAV9 variant capsid protein AAV-PHP.eB (SEQ ID NO: 5). In some embodiments, the parental AAV capsid protein further comprises an insertion of at least or about three, four, five, six, seven, eight, nine, ten, or eleven amino acids of an amino acid in an amino acid position 588-589 of the amino acid sequence of the parental AAV (AAV9 VP1 numbering). In some embodiments, delivery is more specific than a delivery of the heterologous nucleic acid by a reference AAV, e.g., AAV9. In some embodiments, methods further comprise reducing or ablating delivery of the heterologous nucleic acid in an off-target in vivo environment, such as the liver. In some embodiments, delivery is characterized by an increase in efficiency of transduction (e.g., of the heterologous nucleic acid) in the CNS or PNS than a transduction efficiency in the CNS or PNS of the reference AAV. In some embodiments, the delivery is systemic (e.g., intravenous). In some embodiments, the subject is a human or a non-human primate.

Methods of treating a disease or a condition afflicting a target in vivo environment selected from the group consisting of the liver, intestine, heart, lung, reproductive organ, muscle, adipose, pancreas, a brain, or spleen, comprise administering to a subject a rAAV particle comprising an amino acid provided in any one of FIG. 4-14, the rAAV particle comprising an rAAV capsid protein comprising a substitution of at least or about three, four, five, six, or seven amino acids of an amino acid sequence provided in any one of SEQ ID NOS: 25469-26205. In some embodiments, methods comprise delivering a rAAV particle an amino acid sequence KDNTPGR (SEQ ID NO: 32538) or NNLPRNL (SEQ ID NO: 32867), at an amino acid position 452-458 in a parental AAV capsid protein, thereby targeting the lung. In some embodiments, methods comprise delivering a rAAV particle comprising an amino acid sequence RESSPSL (SEQ ID NO: 26474) at an amino acid position 452-458 in a parental AAV capsid protein, thereby targeting the intestine. In some embodiments, methods comprise delivering a rAAV particle an amino acid sequence RVPLSTI (SEQ ID NO: 26933) or RESSPSL (SEQ ID NO: 29065) at an amino acid position 452-458 in a parental AAV capsid protein, thereby targeting the kidney. In some embodiments, methods comprise delivering a rAAV particle comprising an amino acid sequence RESSPSL (SEQ ID NO: 31904) at an amino acid position 452-458 in a parental AAV capsid protein, thereby targeting the stomach. In some embodiments, the rAAV capsid protein comprises an amino acid sequence provided in any one of SEQ ID NOS: 46400-46403. In some embodiments, the parental AAV capsid protein is AAV9 capsid protein (for e.g., provided in SEQ ID NO: 1). In some embodiments, the parental AAV capsid protein is AAV5 capsid protein (for e.g., provided in SEQ ID NO: 2). In some embodiments, the parental AAV capsid protein is an AAV9 variant capsid protein AAV-PHP.B (SEQ ID NO: 3). In some embodiments, the parental AAV capsid protein is AAV9 variant capsid protein AAV-PHP.eB (SEQ ID NO: 5). In some embodiments, the parental AAV capsid protein further comprises an insertion of at least or about three, four, five, six, seven, eight, nine, ten, or eleven amino acids of an amino acid in an amino acid position 588-589 of the amino acid sequence of the parental AAV (AAV9 VP1 numbering). In some embodiments, delivery is more specific than a delivery of the heterologous nucleic acid by a reference AAV, e.g., AAV9. In some embodiments, methods further comprise reducing or ablating delivery of the heterologous nucleic acid in an off-target in vivo environment, such as the liver. In some embodiments, delivery is characterized by an increase in efficiency of transduction (e.g., of the heterologous nucleic acid) in the target in vivo environment than a transduction efficiency in the target in vivo environment of the reference AAV. In some embodiments, the delivery is systemic (e.g., intravenous or intranasal). In some embodiments, the subject is a human or a non-human primate.

Also provide are methods of modulating a target gene expression product, the methods comprising administering to a subject in need thereof a composition (e.g., rAAV particle, AAV vector, pharmaceutical composition) disclosed herein. For example, methods provided herein comprise administering to a subject a rAAV with a rAAV capsid protein encapsidating a viral vector comprising a heterologous nucleic acid that modulates the expression or the activity of the target gene expression product. In some embodiments, the disease or the condition is characterized by an increased or enhanced expression or activity of a gene or gene expression product thereof, as compared to a normal individual. In some cases, administering the therapeutically effective amount of the composition restores the expression or the activity of the gene or gene expression product thereof to a level that is typical in a normal individual. The term "normal individual" refers to an unaffected individual, i.e. an individual that is not afflicted with the disease or the condition characterized by the variation in expression or activity of the gene or gene expression product thereof.

Non-limiting examples of genes involved in central nervous system (CNS) diseases or disorders include Sarcoglycan Alpha (SGCA), glutamic acid decarboxylase 65 (GAD65), glutamic acid decarboxylase 67 (GAD67), CLN2 gene, Nerve Growth Factor (NGF), glial cell derived neurotrophic factor (GDNF), Neurturin, Survival Of Motor Neuron 1, Telomeric (SMN1), β-Glucocerebrosidase (GCase), Frataxin (FXN), Huntingtin (HTN), methyl-CpG binding protein 2 (MECP2), peroxisomal biogenesis factor (PEX), progranulin (GRN), an antitubulin agent, copper-zinc superoxide dismutase (SOD1), Glucosylceramidase Beta (GBA), NPC Intracellular Cholesterol Transporter 1 (NPC1), and NPS3. In some embodiments, the peroxisomal biogenesis factor (PEX) is selected from the group consisting of PEX1, PEX2, PEX3, PEX4, PEX5, PEX6, PEX7, PEX10, PEX1113, PEX12, PEX13, PEX14, PEX16, PEX19, and PEX26. Non-limiting examples of genes implicated in disease or disorder of a particular organ (e.g., lung, heart, liver, muscle, eye) include Cystic Fibrosis Transmembrane Conductance Regulator (CFTR), Factor X (FIX), RPE65, Retinoid Isomerohydrolase (RPE65), Sarcoglycan Alpha (SGCA), and sarco/endoplasmic reticulum Ca2+-ATPase (SERCA2a). In some instances, the expression of a gene or expression or activity of a gene expression product is inhibited by the administration of the composition to the subject. In some instances, the expression of a gene or the expression or the activity of a gene expression product is enhanced by the administration of the composition to the subject.

In some cases, the composition is administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic effect.

In some cases, the viral genome (vg) concentration of the composition that is administered is between $1.0 \times 10^{11}$ vg per kilogram (kg) and $1.0 \times 10^{16}$ vg/kg. In some cases, the concentration of infectious particles of at least or about $10^7$, $10^8$, $10^9$, $10^{10}$, $10^{11}$, $10^{12}$, $10^{13}$, $10^{14}$, $10^{15}$, $10^{16}$, or $10^{17}$. In some cases the concentration of infectious particles is $2 \times 10^7$, $2 \times 10^8$, $2 \times 10^9$, $2 \times 10^{10}$, $2 \times 10^{11}$, $2 \times 10^{12}$, $2 \times 10^{13}$, $2 \times 10^{14}$, $2 \times 10^{15}$, $2 \times 10^{16}$, or $2 \times 10^{17}$. In some cases the concentration of the infectious particles $3 \times 10^7$, $3 \times 10^8$, $3 \times 10^9$, $3 \times 10^{10}$, $3 \times 10^{11}$, $3 \times 10^{12}$, $3 \times 10^{13}$, $3 \times 10^{14}$, $3 \times 10^{15}$, $3 \times 10^{16}$, or $3 \times 10^{17}$. In some cases the concentration of the infectious particles $4 \times 10^7$, $4 \times 10^8$, $4 \times 10^9$, $4 \times 10^{10}$, $4 \times 10^{11}$, $4 \times 10^{12}$, $4 \times 10^{13}$, $4 \times 10^{14}$, $4 \times 10^{15}$, $4 \times 10^{16}$, or $4 \times 10^{17}$. In some cases the concentration of the infectious particles $5 \times 10^7$, $5 \times 10^8$, $5 \times 10^9$, $5 \times 10^{10}$, $5 \times 10^{11}$, $5 \times 10^{12}$, $5 \times 10^{13}$, $5 \times 10^{14}$, $5 \times 10^{15}$, $5 \times 10^{16}$, or $5 \times 10^{17}$. In some cases the concentration of the infectious particles $6 \times 10^7$, $6 \times 10^8$, $6 \times 10^9$, $6 \times 10^{10}$, $6 \times 10^{11}$, $6 \times 10^{12}$, $6 \times 10^{13}$, $6 \times 10^{14}$, $6 \times 10^{15}$, $6 \times 10^{16}$, or $6 \times 10^{17}$. In some cases the concentration of the infectious particles $7 \times 10^7$, $7\times10^8$, $7\times10^9$, $7\times10^{10}$, $7\times10^{11}$, $7\times10^{12}$, $7\times10^{13}$, $7\times10^{14}$, $7\times10^{15}$, $7\times10^{16}$, or $7\times10^{17}$. In some cases the concentration of the infectious particles $8\times10^7$, $8\times10^8$, $8\times10^9$, $8\times10^{10}$, $8\times10^{11}$, $8\times10^{12}$, $8\times10^{13}$, $8\times10^{14}$, $8\times10^{15}$, $8\times10^{16}$, or $8\times10^{17}$. In some cases the concentration of the infectious particles $9\times10^7$, $9\times10^8$, $9\times10^9$, $9\times10^{10}$, $9\times10^{11}$, $9\times10^{12}$, $9\times10^{13}$, $9\times10^{14}$, $9\times10^{15}$, $9\times10^{16}$, or $9\times10^{17}$.

In some embodiments, the administering of step is performed once. Alternatively, the administering of step is repeated at least twice. The administering of step may be performed once daily. In some cases, the administering of step comprises intravenous administration. In some cases, the administering comprises pulmonary administration. In some cases, the administering comprises intranasal administration (such as a spray). In some cases, the administering of step comprises injecting the composition into a target in vivo environment. In some cases, the administering of step does not comprise injecting the composition into the target in vivo environment.

Subject

Disclosed herein methods of delivering at least one of an AAV particle and viral vector to a subject, for example—to treat or prevent a disease or condition in a subject. The subject, in some cases, is a mammal. Non-limiting examples of a mammal include a mouse, rat, guinea pig, rabbit, chimpanzee, or farm animal. In some instances, the mammal is a non-human primate. In some instances, the subject is human. The subject of the present disclosure may not be diagnosed with a disease or condition. Alternatively, the subject may be a patient that is diagnosed with a disease or disorder, or suspected of having the disease or the disorder.

Disease or Condition

Disclosed herein are methods of treating a disease or condition in a subject by administering a composition comprising a rAAV such as those disclosed herein. At least one advantage of the rAAVs disclosed herein, is that the rAAV may be used to treat virtually any disease or condition that would benefit from a transgene therapy, including but not limited to spinal muscular atrophy (SMA), amyotrophic lateral sclerosis (ALS), Parkinson's disease, Pompe disease, Huntington's disease, Alzheimer's disease, Battens disease, lysosomal storage disorders, glioblastoma multiforme, Rett syndrome, Leber's congenital amaurosis, Late infantile neuronal ceroid lipofuscinosis (LINCL), chronic pain, stroke, spinal cord injury, traumatic brain injury and lysosomal storage disorders.

The disease or the condition may, in some embodiments, be characterized by a reduced or ablated expression or activity of a gene or gene expression product thereof, as compared to a normal individual. In some embodiments, be characterized by an increased or enhanced expression or activity of a gene or gene expression product thereof, as compared to a normal individual.

In some cases, the disease or condition is localized to a particular in vivo environment in the subject, e.g., the brain or the lung. The compositions of the present disclosure are particularly useful for the treatment of the diseases or conditions described herein because they specifically target the in vivo environment and deliver a therapeutic nucleic acid engineered to modulate the activity or the expression of a target gene expression product involved with the pathogenesis or pathology of the disease or condition.

In some instances, the disease or condition comprises a disease or condition of the central nervous system (CNS). Non-limiting examples of disease of the CNS include Absence of the Septum Pellucidum, Acid Lipase Disease, Acid Maltase Deficiency, Acquired Epileptiform Aphasia, Acute Disseminated Encephalomyelitis, Attention Deficit-Hyperactivity Disorder (ADHD), Adie's Pupil, Adie's Syndrome, Adrenoleukodystrophy, Agenesis of the Corpus Callosum, Agnosia, Aicardi Syndrome, Aicardi-Goutieres Syndrome Disorder, AIDS—Neurological Complications, Alexander Disease, Alpers' Disease, Alternating Hemiplegia, Alzheimer's Disease, Amyotrophic Lateral Sclerosis (ALS), Anencephaly, Aneurysm, Angelman Syndrome, Angiomatosis, Anoxia, Antiphospholipid Syndrome, Aphasia, Apraxia, Arachnoid Cysts, Arachnoiditis, Arnold-Chiari Malformation, Arteriovenous Malformation, Asperger Syndrome, Ataxia, Ataxia Telangiectasia, Ataxias and Cerebellar or Spinocerebellar Degeneration, Atrial Fibrillation and Stroke, Attention Deficit-Hyperactivity Disorder, Autism Spectrum Disorder, Autonomic Dysfunction, Back Pain, Barth Syndrome, Batten Disease, Becker's Myotonia, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain and Spinal Tumors, Brain Aneurysm, Brain Injury, Brown-Sequard Syndrome, Bulbospinal Muscular Atrophy, Cerebral Autosomal Dominant Arteriopathy with Subcortical Infarcts and Leukoencephalopathy (CADASIL), Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Central Pontine Myelinolysis, Cephalic Disorders, Ceramidase Deficiency, Cerebellar Degeneration, Cerebellar Hypoplasia, Cerebral Aneurysms, Cerebral Arteriosclerosis, Cerebral Atrophy, Cerebral Beriberi, Cerebral Cavemous Malformation, Cerebral Gigantism, Cerebral Hypoxia, Cerebral Palsy, Cerebro-Oculo-Facio-Skeletal Syndrome (COFS), Charcot-Marie-Tooth Disease, Charcot-Marie-Tooth syndrome, classical rhizomelic chondrodysplasia punctata (RCDP), Chiari Malformation, Cholesterol Ester Storage Disease, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Colpocephaly, Coma, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Cree encephalitis, Creutzfeldt—Jakob Disease, Cumulative Trauma Disorders, Cushing's Syndrome, Cytomegalic Inclusion Body Disease, Cytomegalovirus Infection, Dancing Eyes-Dancing Feet Syndrome, Dandy-Walker Syndrome, Dawson Disease, Deafness, De Morsier's Syndrome, Dejerine-Klumpke Palsy, Dementia, Dementia—Multi-Infarct, Dementia—Semantic, Dementia—Subcortical, Dementia With Lewy Bodies, Dentate Cerebellar Ataxia, Dentatorubral Atrophy, Dermatomyositis, Developmental Dyspraxia, Devic's Syndrome, Diabetic Neuropathy, Diffuse Sclerosis, Dravet Syndrome, Duchenne muscular dystrophy, Dysautonomia, Dysgraphia, Dyslexia, Dysphagia, Dyspraxia, Dyssynergia Cerebellaris Myoclonica, Dyssynergia Cerebellaris Progressiva, Dystonias, Early Infantile Epileptic Encephalopathy, Empty Sella Syndrome, Encephalitis, Encephalitis Lethargica, Encephaloceles, Encephalopathy, Encephalopathy (familial infantile), Encephalotrigeminal Angiomatosis, Epilepsy, Epileptic Hemiplegia, Erb's Palsy, Erb-Duchenne and Dejerine-Klumpke Palsies, Essential Tremor, Extrapontine Myelinolysis, Fabry Disease, Fahr's Syndrome, Fainting, Familial Dysautonomia, Familial Hemangioma, Familial Idiopathic Basal Ganglia Calcification, Familial Periodic Paralyses, Familial Spastic Paralysis, Farber's Disease, Febrile Seizures, Fibromuscular Dysplasia, Fisher Syndrome, Floppy Infant Syndrome, Foot Drop, Friedreich's Ataxia, Frontotemporal Dementia, Gaucher Disease, Generalized Gangliosidoses, Gerstmann's Syndrome, Gerstmann-Straussler-Scheinker Disease, Giant Axonal Neuropathy, Giant Cell Arteritis, Giant Cell Inclusion Disease, glioblastoma, Globoid Cell Leukodystrophy, Glossopharyngeal Neuralgia, Glycogen Storage Disease, Guillain-Barre Syndrome, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster, Herpes Zoster Oticus, Hirayama Syndrome, Holmes-Adie syndrome, Holoprosencephaly, HTLV-1 Associated Myelopathy, Hughes Syndrome, Huntington's Disease, Hydranencephaly, Hydrocephalus, Hydrocephalus—Normal Pressure, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Neuroaxonal Dystrophy, Infantile Phytanic Acid Storage Disease, Infantile Refsum Disease, Infantile Spasms, Inflammatory Myopathies, Iniencephaly, Intestinal Lipodystrophy, Intracranial Cysts, Intracranial Hypertension, Isaacs' Syndrome, Joubert Syndrome, Kearns-Sayre Syndrome, Kennedy's Disease, Kinsbourne syndrome, Kleine-Levin Syndrome, Klippel-Feil Syndrome, Klippel-Trenaunay Syndrome (KTS), Kliiver-Bucy Syndrome, Korsakoff s Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lipid Storage Diseases, Lipoid Proteinosis, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Meningitis and Encephalitis, Menkes Disease, Meralgia Paresthetica, Metachromatic Leukodystrophy, Microcephaly, Migraine, Miller Fisher Syndrome, Mini Stroke, Mitochondrial Myopathy, Moebius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy, Multiple System Atrophy with Orthostatic Hypotension, Muscular Dystrophy, Myasthenia—Congenital, Myasthenia Gravis, Myelinoclastic Diffuse Sclerosis, Myoclonic Encephalopathy of Infants, Myoclonus, Myopathy, Myopathy—Congenital, Myopathy—Thyrotoxic, Myotonia, Myotonia Congenita, Narcolepsy, Neuroacanthocytosis, Neurodegeneration with Brain Iron Accumulation, Neurofibromatosis, Neuroleptic Malignant Syndrome, Neurological Complications of AIDS, Neurological Complications of Lyme Disease, Neurological Consequences of Cytomegalovirus Infection, Neurological Manifestations of Pompe Disease, Neurological Sequelae Of Lupus, Neuromyelitis Optica, Neuromyotonia, Neuronal Ceroid Lipofuscinosis, Neuronal Migration Disorders, Neuropathy—Hereditary, Neurosarcoidosis, Neurosyphilis, Neurotoxicity, Nevus Cavernosus, Niemann-Pick Disease, O'Sullivan-McLeod Syndrome, Occipital Neuralgia, Ohtahara Syndrome, Olivopontocerebellar Atrophy, Opsoclonus Myoclonus, Orthostatic Hypotension, Overuse Syndrome, Pain—Chronic, Pantothenate Kinase-Associated Neurodegeneration, Paraneoplastic Syndromes, Paresthesia, Parkinson's Disease, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Pinched Nerve, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Dentatum Atrophy, Primary Lateral Sclerosis, Primary Progressive Aphasia, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Prosopagnosia, Pseudo-Torch syndrome, Pseudotoxoplasmosis syndrome, Pseudotumor Cerebri, Psychogenic Movement, Ramsay Hunt Syndrome I, Ramsay Hunt Syndrome II, Rasmussen's Encephalitis, Reflex Sympathetic Dystrophy Syndrome, Refsum Disease, Refsum Disease—Infantile, Repetitive Motion Disorders, Repetitive Stress Injuries, Restless Legs Syndrome, Retrovirus-Associated Myelopathy, Rett Syndrome, Reye's Syndrome, Rheumatic Encephalitis, Riley-Day Syndrome, Sacral Nerve Root Cysts, Saint Vitus Dance, Salivary Gland Disease, Sandhoff Disease, Schilder's Disease, Schizencephaly, Seitelberger Disease, Seizure Disorder, Semantic Dementia, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Sotos Syndrome, Spasticity, Spina Bifida, Spinal Cord Infarction, Spinal Cord Injury, Spinal Cord Tumors, Spinal Muscular Atrophy, Spinocerebellar Atrophy, Spinocerebellar Degeneration, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Short-lasting, Unilateral, Neuralgiform (SUNCT) Headache, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen's Myotonia, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Troyer Syndrome, Tuberous Sclerosis, Vascular Erectile Tumor, Vasculitis Syndromes of the Central and Peripheral Nervous Systems, Von Economo's Disease, Von Hippel-Lindau Disease (VHL), Von Recklinghausen's Disease, Wallenberg's Syndrome, Werdnig-Hoffman Disease, Wernicke-Korsakoff Syndrome, West Syndrome, Whiplash, Whipple's Disease, Williams Syndrome, Wilson Disease, Wolman's Disease, and X-Linked Spinal and Bulbar Muscular Atrophy.

In some instances, the disease or condition comprises a liver disease or disorder, or is associated with a liver disease or disorder. Non-limiting examples include disorders of bile acid synthesis (e.g., Wilson disease, Progressive familial intrahepatic cholestasis type 3), disorders of carbohydrate metabolism (e.g., Hereditary fructose intolerance, Glycogen storage disease type IV), disorders of amino acids metabolism (e.g., tyrosinemia type I), Urea cycle disorders (e.g., argininosuccinate lyase deficiency, citrin deficiency (CTLN2, NICCD)), disorders of lipid metabolism (e.g., cholesteryl ester storage disease), and others including but not limited to Alpha-1 antitrypsin deficiency, cystic fibrosis, hereditary hemochromatosis, Alström syndrome, and congenital hepatic fibrosis.

In some instances, the disease or condition is a disease or condition is a pulmonary disease or disorder (of the lung). In some instances, the pulmonary disease or disorder is selected form the group consisting of chronic obstructive pulmonary disease (COPD), pulmonary fibrosis (PF), and plasmalogen deficiency disorders.

Provided here, are methods of treating a disease or a condition associated with an aberrant expression or activity of a target gene or gene expression product thereof, the method comprising modulating the expression or the activity of a target gene or gene expression product in a subject by administering a rAAV encapsidating a heterologous nucleic acid of the present disclosure. In some instances, administration is systemic administration. In some instances, the expression or the activity of the target gene or gene expression product is decreased, relative to that in a normal (non-diseased) individual; and administering the rAAV to the subject is sufficient to increase the expression of the activity of the target gene or gene expression product to that of a normal individual. In some instances, the expression or the activity of the gene or gene expression product is increased, relative to that in a normal individual; and administering the rAAV to the subject is sufficient to decrease the expression or the activity of the target gene or gene expression product. In a non-limiting example, a subject diagnosed with Alzheimer's disease, which is caused, in some cases, by a gain-of-function of a Presenilin 1 and/or Presenilin 2 (encoded by the gene PSEN1 and PSEN2, respectively) is administered a rAAV disclosed herein encapsidating a therapeutic nucleic acid that is a silencing RNA (siRNA), or other RNAi with a loss-of-function effect on PSEN1 mRNA.

Formulations, Dosages, and Routes of Administration

In general, methods disclosed herein comprise administering a therapeutic rAAV composition by systemic administration. In some instances, methods comprise administering a therapeutic rAAV composition by oral administration. In some instances, methods comprise administering a therapeutic rAAV composition by intraperitoneal injection. In some instances, methods comprise administering a therapeutic rAAV composition in the form of an anal suppository. In some instances, methods comprise administering a therapeutic rAAV composition by intravenous ("i.v.") administration. It is conceivable that one may also administer therapeutic rAAV compositions disclosed herein by other routes, such as subcutaneous injection, intramuscular injection, intradermal injection, transdermal injection percutaneous administration, intranasal administration, intralymphatic injection, rectal administration intragastric administration, intraocular administration, intracerebro-ventricularly administration, intrathecally, or any other suitable parenteral administration. In some instances, methods comprise administering a therapeutic rAAV composition by topical administration, such as for example, by brushing or otherwise contacting the rAAV composition to a region of the subject (e.g., eardrum, bladder). In some embodiments, routes for local delivery closer to site of injury or inflammation are preferred over systemic routes. Routes, dosage, time points, and duration of administrating therapeutics may be adjusted. In some embodiments, administration of therapeutics is prior to, or after, onset of either, or both, acute and chronic symptoms of the disease or condition.

An effective dose and dosage of pharmaceutical compositions to prevent or treat the disease or condition disclosed herein is defined by an observed beneficial response related to the disease or condition, or symptom of the disease or condition. Beneficial response comprises preventing, alleviating, arresting, or curing the disease or condition, or symptom of the disease or condition. In some embodiments, the beneficial response may be measured by detecting a measurable improvement in the presence, level, or activity, of biomarkers, transcriptomic risk profile, or intestinal microbiome in the subject. An "improvement," as used herein refers to shift in the presence, level, or activity towards a presence, level, or activity, observed in normal individuals (e.g. individuals who do not suffer from the disease or condition). In instances wherein the therapeutic rAAV composition is not therapeutically effective or is not providing a sufficient alleviation of the disease or condition, or symptom of the disease or condition, then the dosage amount and/or route of administration may be changed, or an additional agent may be administered to the subject, along with the therapeutic rAAV composition. In some embodiments, as a patient is started on a regimen of a therapeutic rAAV composition, the patient is also weaned off (e.g., step-wise decrease in dose) a second treatment regimen.

In some embodiments, pharmaceutical compositions in accordance with the present disclosure may be administered at dosage levels sufficient to deliver from about 0.0001 mg/kg to about 100 mg/kg, from about 0.001 mg/kg to about 0.05 mg/kg, from about 0.005 mg/kg to about 0.05 mg/kg, from about 0.001 mg/kg to about 0.005 mg/kg, from about 0.05 mg/kg to about 0.5 mg/kg, from about 0.01 mg/kg to about 50 mg/kg, from about 0.1 mg/kg to about 40 mg/kg, from about 0.5 mg/kg to about 30 mg/kg, from about 0.01 mg/kg to about 10 mg/kg, from about 0.1 mg/kg to about 10 mg/kg, or from about 1 mg/kg to about 25 mg/kg, of subject body weight per day, one or more times a day, to obtain the desired therapeutic, diagnostic, or prophylactic, effect. It will be understood that the above dosing concentrations may be converted to vg or viral genomes per kg or into total viral genomes administered by one of skill in the art.

In some cases, a dose of the pharmaceutical composition may comprise a concentration of infectious particles of at least or about $10^7$, $10^8$, $10^9$, $10^{10}$, $10^{11}$, $10^{12}$, $10^{13}$, $10^{14}$, $10^{15}$, $10^{16}$, or $10^{17}$. In some cases the concentration of infectious particles is $2\times10^7$, $2\times10^8$, $2\times10^9$, $2\times10^{10}$, $2\times10^{11}$, $2\times10^{12}$, $2\times10^{13}$, $2\times10^{14}$, $2\times10^{15}$, $2\times10^{16}$, or $2\times10^{17}$. In some cases the concentration of the infectious particles is $3\times10^7$, $3\times10^8$, $3\times10^9$, $3\times10^{10}$, $3\times10^{11}$, $3\times10^{12}$, $3\times10^{13}$, $3\times10^{14}$, $3\times10^{15}$, $3\times10^{16}$, or $3\times10^{17}$. In some cases the concentration of the infectious particles is $4\times10^7$, $4\times10^8$, $4\times10^9$, $4\times10^{10}$, $4\times10^{11}$, $4\times10^{12}$, $4\times10^{13}$, $4\times10^{14}$, $4\times10^{15}$, $4\times10^{16}$, or $4\times10^{17}$. In some cases the concentration of the infectious particles is $5\times10^7$, $5\times10^8$, $5\times10^9$, $5\times10^{10}$, $5\times10^{11}$, $5\times10^{12}$, $5\times10^{13}$, $5\times10^{14}$, $5\times10^{15}$, $5\times10^{16}$, or $5\times10^{17}$. In some cases the concentration of the infectious particles is $6\times10^7$, $6\times10^8$, $6\times10^9$, $6\times10^{10}$, $6\times10^{11}$, $6\times10^{12}$, $6\times10^{13}$, $6\times10^{14}$, $6\times10^{15}$, $6\times10^{16}$, or $6\times10^{17}$. In some cases the concentration of the infectious particles is $7\times10^7$, $7\times10^8$, $7\times10^9$, $7\times10^{10}$, $7\times10^{11}$, $7\times10^{12}$, $7\times10^{13}$, $7\times10^{14}$, $7\times10^{15}$, $7\times10^{16}$, or $7\times10^{17}$. In some cases the concentration of the infectious particles is $8\times10^7$, $8\times10^8$, $8\times10^9$, $8\times10^{10}$, $8\times10^{11}$, $8\times10^{12}$, $8\times10^{13}$, $8\times10^{14}$, $8\times10^{15}$, $8\times10^{16}$, or $8\times10^{17}$. In some cases the concentration of the infectious particles is $9\times10^7$, $9\times10^8$, $9\times10^9$, $9\times10^{10}$, $9\times10^{11}$, $9\times10^{12}$, $9\times10^{13}$, $9\times10^{14}$, $9\times10^{15}$, $9\times10^{16}$, or $9\times10^{17}$.

Disclosed herein, in some embodiments are formulations of pharmaceutically-acceptable excipients and carrier solutions suitable for delivery of the rAAV compositions described herein, as well as suitable dosing and treatment regimens for using the particular compositions described herein in a variety of treatment regimens. In some embodiments, the amount of therapeutic gene expression product in each therapeutically-useful composition may be prepared is such a way that a suitable dosage will be obtained in any given unit dose of the compound. Factors such as solubility, bioavailability, biological half-life, route of administration, product shelf life, as well as other pharmacological considerations will be contemplated by one skilled in the art of preparing such pharmaceutical formulations, and as such, a variety of dosages and treatment regimens may be desirable. In some instances, the rAAV compositions are suitably formulated pharmaceutical compositions disclosed herein, to be delivered either intraocularly, intravitreally, parenterally, subcutaneously, intravenously, intracerebro-ventricularly, intramuscularly, intrathecally, orally, intraperitoneally, by oral or nasal inhalation, or by direct injection to one or more cells, tissues, or organs by direct injection.

In some embodiments, the pharmaceutical forms of the AAV-based viral compositions suitable for injectable use include sterile aqueous solutions or dispersions and sterile powders for the extemporaneous preparation of sterile injectable solutions or dispersions. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial ad antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

In some cases, for administration of an injectable aqueous solution, for example, the solution may be suitably buffered, if necessary, and the liquid diluent first rendered isotonic with sufficient saline or glucose. These particular aqueous solutions are especially suitable for intravenous, intramuscular, subcutaneous and intraperitoneal administration. Some variation in dosage will necessarily occur depending on the condition of the subject being treated. The person responsible for administration will, in any event, determine the appropriate dose for the individual subject. Moreover, for human administration, preparations should meet sterility, pyrogenicity, and the general safety and purity standards as required by FDA Office of Biologics standards.

Disclosed herein are sterile injectable solutions comprising the rAAV compositions disclosed herein, which are prepared by incorporating the rAAV compositions disclosed herein in the required amount in the appropriate solvent with several of the other ingredients enumerated above, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof. Injectable solutions may be advantageous for systemic administration, for example by intravenous administration.

Also provided herein are formulations in a neutral or salt form. Pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

Pulmonary administration may be advantageously achieved via the buccal administration. In some embodiments, formulations may comprise dry particles comprising active ingredients. In such embodiments, dry particles may have a diameter in the range from about 0.5 nm to about 7 nm or from about 1 nm to about 6 nm. In some embodiments, formulations may be in the form of dry powders for administration using devices comprising dry powder reservoirs to which streams of propellant may be directed to disperse such powder. In some embodiments, self-propelling solvent/powder dispensing containers may be used. In such embodiments, active ingredients may be dissolved and/or suspended in low-boiling propellant in sealed containers. Such powders may comprise particles wherein at least 98% of the particles by weight have diameters greater than 0.5 nm and at least 95% of the particles by number have diameters less than 7 nm. Alternatively, at least 95% of the particles by weight have a diameter greater than 1 nm and at least 90% of the particles by number have a diameter less than 6 nm. Dry powder compositions may include a solid fine powder diluent such as sugar and are conveniently provided in a unit dose form. Low boiling propellants generally include liquid propellants having a boiling point of below 65° F. at atmospheric pressure. Generally, propellants may constitute 50% to 99.9% (w/w) of the composition, and active ingredient may constitute 0.1% to 20% (w/w) of the composition. Propellants may further comprise additional ingredients such as liquid non-ionic and/or solid anionic surfactant and/or solid diluent (which may have particle sizes of the same order as particles comprising active ingredients).

Pharmaceutical compositions formulated for pulmonary delivery may provide active ingredients in the form of droplets of solution and/or suspension. Such formulations may be prepared, packaged, and/or sold as aqueous and/or dilute alcoholic solutions and/or suspensions, optionally sterile, comprising active ingredients, and may conveniently be administered using any nebulization and/or atomization device. Such formulations may further comprise one or more additional ingredients including, but not limited to, a flavoring agent such as saccharin sodium, a volatile oil, a buffering agent, a surface active agent, and/or a preservative such as methylhydroxybenzoate. Droplets provided by this route of administration may have an average diameter in the range from about 0.1 nm to about 200 nm. Formulations described herein useful for pulmonary delivery may also be useful for intranasal delivery. In some embodiments, formulations for intranasal administration comprise a coarse powder comprising the active ingredient and having an average particle size from about 0.2 µm to 500 µm. Such formulations are administered in the manner in which snuff is taken, e.g. by rapid inhalation through the nasal passage from a container of the powder held close to the nose.

Formulations suitable for nasal administration may, for example, comprise from about as little as 0.1% (w/w) and as much as 100% (w/w) of active ingredient, and may comprise one or more of the additional ingredients described herein. A pharmaceutical composition may be prepared, packaged, and/or sold in a formulation suitable for buccal administration. Such formulations may, for example, be in the form of tablets and/or lozenges made using conventional methods, and may, for example, comprise 0.1% to 20% (w/w) active ingredient, the balance comprising an orally dissolvable and/or degradable composition and, optionally, one or more of the additional ingredients described herein. Alternately, formulations suitable for buccal administration may comprise powders and/or an aerosolized and/or atomized solutions and/or suspensions comprising active ingredients. Such powdered, aerosolized, and/or aerosolized formulations, when dispersed, may comprise average particle and/or droplet sizes in the range of from about 0.1 nm to about 200 nm, and may further comprise one or more of any additional ingredients described herein.

Suitable dose and dosage administrated to a subject is determined by factors including, but not limited to, the particular therapeutic rAAV composition, disease condition and its severity, the identity (e.g., weight, sex, age) of the subject in need of treatment, and can be determined according to the particular circumstances surrounding the case, including, e.g., the specific agent being administered, the route of administration, the condition being treated, and the subject or host being treated.

The amount of AAV compositions and time of administration of such compositions will be within the purview of the skilled artisan having benefit of the present teachings. It is likely, however, that the administration of therapeutically-effective amounts of the disclosed compositions may be achieved by a single administration, such as for example, a single injection of sufficient numbers of infectious particles to provide therapeutic benefit to the patient undergoing such treatment. This is made possible, at least in part, by the fact that certain target cells (e.g., neurons) do not divide, obviating the need for multiple or chronic dosing.

Alternatively, in some circumstances, it may be desirable to provide multiple, or successive administrations of the AAV vector compositions, either over a relatively short, or a relatively prolonged period of time, as may be determined by the medical practitioner overseeing the administration of such compositions. For example, the number of infectious particles administered to a mammal may be on the order of about $10^7$, $10^8$, $10^9$, $10^{10}$, $10^{11}$, $10^{12}$, $10^{13}$, or even higher, infectious particles/ml given either as a single dose, or divided into two or more administrations as may be required to achieve therapy of the particular disease or disorder being treated. In fact, in certain embodiments, it may be desirable to administer two or more different AAV vector compositions, either alone, or in combination with one or more other therapeutic drugs to achieve the desired effects of a particular therapy regimen. In various embodiments, the daily and unit dosages are altered depending on a number of variables including, but not limited to, the activity of the therapeutic rAAV composition used, the disease or condition to be treated, the mode of administration, the requirements of the individual subject, the severity of the disease or condition being treated, and the judgment of the practitioner.

In some embodiments, the administration of the therapeutic rAAV composition is hourly, once every 2 hours, 3 hours, 4 hours, 5 hours, 6 hours, 7 hours, 8 hours, 9 hours, 10 hours, 11 hours, 12 hours, 13 hours, 14 hours, 15 hours, 16 hours, 17 hours, 18 hours, 19 hours, 20 hours, 21 hours 22 hours, 23 hours, 1 day, 2 days, 3 days, 4 days, 5 days, 6 days, 7 days, 8 days, 9 days, 10 days, 11 days, 12 days, 13 days, 14 days, 15 days, 1 month, 2 months, 3 months, 4 months, 5 months, 6 months, 7 months, 8 months, 9 months, 10 months, 11 months, 1 year, 2 years, 3 years, 4 years, 5 years, or 10 years. The effective dosage ranges may be adjusted based on subject's response to the treatment. Some routes of administration will require higher concentrations of effective amount of therapeutics than other routes.

Although not anticipated given the advantages of the present disclosure, in certain embodiments wherein the patient's condition does not improve, upon the doctor's discretion the administration of therapeutic rAAV composition is administered chronically, that is, for an extended period of time, including throughout the duration of the patient's life in order to ameliorate or otherwise control or limit the symptoms of the patient's disease or condition. In certain embodiments wherein a patient's status does improve, the dose of therapeutic rAAV composition being administered may be temporarily reduced or temporarily suspended for a certain length of time (i.e., a "drug holiday"). In specific embodiments, the length of the drug holiday is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug holiday is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. In certain embodiments, the dose of drug being administered may be temporarily reduced or temporarily suspended for a certain length of time (i.e., a "drug diversion"). In specific embodiments, the length of the drug diversion is between 2 days and 1 year, including by way of example only, 2 days, 3 days, 4 days, 5 days, 6 days, 7 days, 10 days, 12 days, 15 days, 20 days, 28 days, or more than 28 days. The dose reduction during a drug diversion is, by way of example only, by 10%-100%, including by way of example only 10%, 15%, 20%, 25%, 30%, 35%, 40%, 45%, 50%, 55%, 60%, 65%, 70%, 75%, 80%, 85%, 90%, 95%, and 100%. After a suitable length of time, the normal dosing schedule is optionally reinstated.

In some embodiments, once improvement of the patient's conditions has occurred, a maintenance dose is administered if necessary. Subsequently, in specific embodiments, the dosage or the frequency of administration, or both, is reduced, as a function of the symptoms, to a level at which the improved disease, disorder or condition is retained. In certain embodiments, however, the patient requires intermittent treatment on a long-term basis upon any recurrence of symptoms.

Toxicity and therapeutic efficacy of such therapeutic regimens are determined by standard pharmaceutical procedures in cell cultures or experimental animals, including, but not limited to, the determination of the LD50 and the ED50. The dose ratio between the toxic and therapeutic effects is the therapeutic index and it is expressed as the ratio between LD50 and ED50. In certain embodiments, the data obtained from cell culture assays and animal studies are used in formulating the therapeutically effective daily dosage range and/or the therapeutically effective unit dosage amount for use in mammals, including humans. In some embodiments, the dosage amount of the therapeutic rAAV composition described herein lies within a range of circulating concentrations that include the ED50 with minimal toxicity. In certain embodiments, the daily dosage range and/or the unit dosage amount varies within this range depending upon the dosage form employed and the route of administration utilized.

Kits

Disclosed herein are kits comprising compositions disclosed herein. Also disclosed herein are kits for the treatment or prevention of a disease or conditions of the central nervous system (CNS), peripheral nervous system (PNS), or target organ or environment (e.g., lung, heart, liver). In some instances, the disease or condition is cancer, a pathogen infection, pulmonary disease or condition, neurological disease, muscular disease, or an immune disorder, such as those described herein. In one embodiment, a kit can include a therapeutic or prophylactic composition containing an effective amount of a composition of a rAAV particle encapsidating a heterologous nucleic acid comprising a therapeutic nucleic acid (e.g., therapeutic nucleic acid) and a recombinant AAV (rAAV) capsid protein of the present disclosure. In another embodiment, a kit can include a therapeutic or prophylactic composition containing an effective amount of cells modified by the rAAV described herein ("modified cell"), in unit dosage form that express therapeutic nucleic acid. In some embodiments, a kit comprises a sterile container which can contain a therapeutic composition; such containers can be boxes, ampules, bottles, vials, tubes, bags, pouches, blister-packs, or other suitable container forms known in the art. Such containers can be made of plastic, glass, laminated paper, metal foil, or other materials suitable for holding medicaments.

In some cases, rAAV are provided together with instructions for administering the rAAV to a subject having or at risk of developing the disease or condition (e.g., disease of the CNS, PNS, liver, and the like). Instructions can generally include information about the use of the composition for the treatment or prevention of the disease or condition.

In some cases, a kit can include allogenic cells. In some cases, a kit can include cells that can comprise a genomic modification. In some cases, a kit can comprise "off-the-shelf" cells. In some cases, a kit can include cells that can be expanded for clinical use. In some cases, a kit can contain contents for a research purpose.

In some cases, the instructions include at least one of the following: description of the therapeutic rAAV composition; dosage schedule and administration for treatment or prevention of the disease or condition disclosed herein; precautions; warnings; indications; counter-indications; overdosage information; adverse reactions; animal pharmacology; clinical studies; and/or references. The instructions can be printed directly on the container (when present), or as a label applied to the container, or as a separate sheet, pamphlet, card, or folder supplied in or with the container. In some cases, instructions provide procedures for administering the rAAV to the subject alone. In some cases, instructions provide procedures for administering the rAAV to the subject at least about 1 hour (hr), 2 hr, 3 hr, 4 hr, 5 hr, 6 hr, 7 hr, 8 hr, 9 hr, 10 hr, 11 hr, 12 hr, 13 hr, 14 hr, 15 hr, 16 hr, 17 hr, 18 hr, 19 hr, 20 hr, 21 hr, 22 hr, 23 hr, 24 hr, 25 hr, 26 hr, 27 hr, 28 hr, 29 hr, 30 hr, or up to 2 days, 3 days, 4 days, 5 days, 6 days, or 7 days after or before administering an additional therapeutic agent disclosed herein. In some instances, the instructions provide that the rAAV is formulated for intravenous injection. In some instances, the instructions provide that the rAAV is formulated for intranasal administration.

Definitions

The terminology used herein is for the purpose of describing particular cases only and is not intended to be limiting. As used herein, the singular forms "a", "an" and "the" are intended to include the plural forms as well, unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising."

The term "about" or "approximately" means within an acceptable error range for the particular value as determined by one of ordinary skill in the art, which will depend in part on how the value is measured or determined, e.g., the limitations of the measurement system. For example, "about" can mean within 1 or more than 1 standard deviation, per the practice in the given value. Where particular values are described in the application and claims, unless otherwise stated the term "about" should be assumed to mean an acceptable error range for the particular value.

As used herein "consisting essentially of" when used to define compositions and methods, shall mean excluding other elements of any essential significance to the combination for the stated purpose. Thus, a composition consisting essentially of the elements as defined herein would not exclude other materials or steps that do not materially affect the basic and novel characteristic(s) of the claimed disclosure, such as compositions for treating skin disorders like acne, eczema, psoriasis, and rosacea.

The terms "homologous," "homology," or "percent homology" are used herein to generally mean an amino acid sequence or a nucleic acid sequence having the same, or similar sequence to a reference sequence. Percent homology of sequences can be determined using the most recent version of BLAST, as of the filing date of this application.

The terms "increased," or "increase" are used herein to generally mean an increase by a statically significant amount. In some embodiments, the terms "increased," or "increase," mean an increase of at least 10% as compared to a reference level, for example an increase of at least about 10%, at least about 20%, or at least about 30%, or at least about 40%, or at least about 50%, or at least about 60%, or at least about 70%, or at least about 80%, or at least about 90% or up to and including a 100% increase or any increase between 10-100% as compared to a reference level, standard, or control. Other examples of "increase" include an increase of at least 2-fold, at least 5-fold, at least 10-fold, at least 20-fold, at least 50-fold, at least 100-fold, at least 1000-fold or more as compared to a reference level.

The terms, "decreased" or "decrease" are used herein generally to mean a decrease by a statistically significant amount. In some embodiments, "decreased" or "decrease" means a reduction by at least 10% as compared to a reference level, for example a decrease by at least about 20%, or at least about 30%, or at least about 40%, or at least about 50%, or at least about 60%, or at least about 70%, or at least about 80%, or at least about 90% or up to and including a 100% decrease (e.g., absent level or non-detectable level as compared to a reference level), or any decrease between 10-100% as compared to a reference level. In the context of a marker or symptom, by these terms is meant a statistically significant decrease in such level. The decrease can be, for example, at least 10%, at least 20%, at least 30%, at least 40% or more, and is preferably down to a level accepted as within the range of normal for an individual without a given disease.

The terms "subject" is any organism. In some instances, the organism is a mammal Non-limiting examples of mammal include, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like. In one aspect, the mammal is a human. The term "animal" as used herein comprises human beings and non-human animals. In one embodiment, a "non-human animal" is a mammal, for example a rodent such as rat or a mouse. In some instances, the subject is a patient, which as used herein, may refer to a subject diagnosed with a particular disease or disorder.

The term "gene," as used herein, refers to a segment of nucleic acid that encodes an individual protein or RNA (also referred to as a "coding sequence" or "coding region"), optionally together with associated regulatory region such as promoter, operator, terminator and the like, which may be located upstream or downstream of the coding sequence.

The term "adeno-associated virus," or "AAV" as used herein refers to the adeno-associated virus or derivatives thereof. Non-limited examples of AAV's include AAV type 1 (AAV1), AAV type 2 (AAV2), AAV type 3 (AAV3), AAV type 4 (AAV4), AAV type 5 (AAV5), AAV type 6 (AAV6), AAV type 7 (AAV7), AAV type 8 (AAV8), AAV type 9 (AAV9), AAV type 10 (AAV10), AAV type 11 (AAV11), AAV type 12 (AAV12), avian AAV, bovine AAV, canine AAV, equine AAV, primate AAV, non-primate AAV, and ovine AAV. In some instances, the AAV is described as a "Primate AAV," which refers to AAV that infect primates. Likewise an AAV may infect bovine animals (e.g., "bovine AAV", and the like). In some instances, the AAV is wildtype, or naturally occurring. In some instances the AAV is recombinant.

The term "AAV capsid" as used herein refers to a capsid protein or peptide of an adeno-associated virus. In some instances, the AAV capsid protein is configured to encapsidate genetic information (e.g., a transgene, therapeutic nucleic acid, viral genome). In some instances, the AAV capsid of the instant disclosure is a variant AAV capsid, which means in some instances that it is a parental AAV capsid that has been modified in an amino acid sequence of the parental AAV capsid protein.

The term "tropism" as used herein refers to a quality or characteristic of the AAV capsid that may include specificity for, and/or an increase or a decrease in efficiency of, expressing the encapsidated genetic information into one in in vivo environment, relative to a second in vivo environment. An in vivo environment, in some instances, is a cell-type. An in vivo environment, in some instances, is a tissue, organ, or organ system.

The term "AAV genome" as used herein refers to nucleic acid polynucleotide encoding genetic information related to the virus. The genome, in some instances, comprises a nucleic acid sequence flanked by AAV inverted terminal repeat (ITR) sequences. The AAV genome may be a recombinant AAV genome generated using recombinatorial genetics methods, and which can include a heterologous nucleic acid (e.g., transgene) that is flanked by the ITR sequences.

The term "AAV particle" or an "AAV vector" as used interchangeably herein refers to an AAV virus or virion comprising an AAV capsid within which is packaged a heterologous DNA polynucleotide, or "genome", comprising nucleic acid sequence flanked by AAV inverted terminal repeat (ITR) sequences. In some cases, the AAV particle is modified relative to a parental AAV particle.

The term "gene product" of "gene expression product" refers to an expression product of a polynucleotide sequence such as, for e.g., a polypeptide, peptide, protein or RNA, including but not limited to interfering RNA (e.g., siRNA, miRNA, shRNA) and messenger RNA (mRNA).

The terms "operatively linked" or "operably linked" refers to a location of two or more elements in cis with one another, and in some cases, next to one other (e.g., genetic elements such as a promoter, enhancer, termination signal sequence, polyadenylation sequence, and the like) that enables a functional relationship between the two or more elements. In one non-limiting example, a promoter that is operatively linked to a coding region enables the initiation of transcription of the coding sequence.

The term "heterologous" as used herein refers to a genetic element (e.g., coding region) or gene expression product (e.g., RNA, protein) that is derived from a genotypically distinct entity from that of the rest of the entity to which it is being compared.

The term "endogenous" as used herein refers to a genetic element (e.g., coding region) or gene expression product (e.g., RNA, protein) that is naturally occurring in or associated with an organism or a particular cell within the organism.

A "detectable moiety" as used herein refers to a moiety that can be covalently or noncovalently attached to a compound or biomolecule that can be detected for instance, using techniques known in the art. In embodiments, the detectable moiety is covalently attached. The detectable moiety may provide for imaging of the attached compound or biomolecule. The detectable moiety may indicate the contacting between two compounds. Exemplary detectable moieties are fluorophores, antibodies, reactive dies, radio-labeled moieties, magnetic contrast agents, and quantum dots. Exemplary fluorophores include fluorescein, rhodamine, GFP, coumarin, FITC, Alexa fluor, Cy3, Cy5, BODIPY, and cyanine dyes. Exemplary radionuclides include Fluorine-18, Gallium-68, and Copper-64. Exemplary magnetic contrast agents include gadolinium, iron oxide and iron platinum, and manganese.

The terms "treat," "treating," and "treatment" as used herein refers to alleviating or abrogating a disorder, disease, or condition; or one or more of the symptoms associated with the disorder, disease, or condition; or alleviating or eradicating a cause of the disorder, disease, or condition itself. Desirable effects of treatment can include, but are not limited to, preventing occurrence or recurrence of disease, alleviation of symptoms, diminishing any direct or indirect pathological consequences of the disease, preventing metastasis, decreasing the rate of disease progression, amelioration or palliation of the disease state and remission or improved prognosis.

The term "therapeutically effective amount" refers to the amount of a compound or therapy that, when administered, is sufficient to prevent development of, or alleviate to some extent, one or more of the symptoms of a disorder, disease, or condition of the disease; or the amount of a compound that is sufficient to elicit biological or medical response of a cell, tissue, system, animal, or human that is being sought by a researcher, veterinarian, medical doctor, or clinician.

The term "pharmaceutically acceptable carrier," "pharmaceutically acceptable excipient," "physiologically acceptable carrier," or "physiologically acceptable excipient" refers to a pharmaceutically acceptable material, composition, or vehicle, such as a liquid or solid filler, diluent, excipient, solvent, or encapsulating material. A component can be "pharmaceutically acceptable" in the sense of being compatible with the other ingredients of a pharmaceutical formulation. It can also be suitable for use in contact with the tissue or organ of humans and animals without excessive toxicity, irritation, allergic response, immunogenicity, or other problems or complications, commensurate with a reasonable benefit/risk ratio. See, Remington: The Science and Practice of Pharmacy, 21st Edition; Lippincott Williams & Wilkins: Philadelphia, Pa., 2005; Handbook of Pharmaceutical Excipients, 5th Edition; Rowe et al., Eds., The Pharmaceutical Press and the American Pharmaceutical Association: 2005; and Handbook of Pharmaceutical Additives, 3rd Edition; Ash and Ash Eds., Gower Publishing Company: 2007; Pharmaceutical Preformulation and Formulation, Gibson Ed., CRC Press LLC: Boca Raton, Fla., 2004).

The term "pharmaceutical composition" refers to a mixture of a compound disclosed herein with other chemical components, such as diluents or carriers. The pharmaceutical composition can facilitate administration of the compound to an organism. Multiple techniques of administering a compound exist in the art including, but not limited to, oral, injection, aerosol, parenteral, and topical administration.

Non-limiting examples of "sample" include any material from which nucleic acids and/or proteins can be obtained. As non-limiting examples, this includes whole blood, peripheral blood, plasma, serum, saliva, mucus, urine, semen, lymph, fecal extract, cheek swab, cells or other bodily fluid or tissue, including but not limited to tissue obtained through surgical biopsy or surgical resection. In some embodiments, the sample is obtained directly from the patient. Alternatively, a sample can be obtained through primary patient derived cell lines, or archived patient samples in the form of preserved samples, or fresh frozen samples.

EXAMPLES

Example 1. Method of Producing an rAAV

A recombinant AAV (rAAV) is produced. Three plasmid vectors are triple-transfected into immortalized HEK293 cells using a standard transfection protocol (e.g., with PEI). The first vector contains a transgene cassette flanked by inverted terminal repeat (ITR) sequences from a parental AAV virus. The transgene cassette has a promoter sequence and that drives transcription of a heterologous nucleic acid in the nucleus of the target cell. The second vector contains nucleic acids encoding the AAV Rep gene, as well as a modified Cap gene e.g., AAV2/9 REP-AAP-ΔCap). The modified Cap gene comprises any one of SEQ ID NOS: 12740-25468, 35472-45474, and 46364-46383, which are the DNA sequences encoding the modified AAV capsid proteins of the present disclosure. The modified Cap gene, in some cases, comprises any one of SEQ ID NOS: 46404-46423, which are the DNA sequences encoding the full-length VP1 protein with the 7-mer substitute at amino acid positions 452-458. The third vector contains nucleic acids encoding helper virus proteins needed for viral assembly, and packaging of the heterologous nucleic acid into the modified capsid structure.

Viral particles are harvested from the media after 72 h post transfection and from the cells and media at 120 h post transfection. Virus present in the media is concentrated by precipitation with 8% poly(ethylene glycol) and 500 mM sodium chloride and the precipitated virus is added to the lysates prepared from the collected cells. The viruses are purified over iodixanol (Optiprep, Sigma) step gradients (15%, 25%, 40% and 60%). Viruses are concentrated and formulated in PBS. Virus titers are determined by measuring the number of DNaseI-resistant vector genome copies (VGs) using qPCR and the linearized genome plasmid as a control.

Example 2. Method of Identifying the Modified Capsid Proteins

Plasmids.

First round viral DNA library was generated by amplification of a section of the AAV9-PHP.eB capsid genome between amino acids 450-599 using NNK degenerate primers (Integrated DNA Technologies, Inc., IDT) to substitute amino acids 452-458 with all possible variations. The resulting library inserts were then introduced into the rAAV-ΔCap-in-cis-Lox plasmid via Gibson assembly as previously described. The resulting capsid DNA library, rAAV-Cap-in-cis-Lox, contained a diversity of ~1.28 billion variants at the amino acid level. Second round viral DNA library was generated similarly to the first round, but instead of NNK degenerate primers at the 452-458 location, a synthesized oligo pool (Twist Bioscience) was used to only generate selected variants. This second round DNA library contained a diversity of ~82,000 variants at the amino acid level.

The AAV2/9 REP-AAP-ΔCap plasmid transfected into HEK293T cells for library viral production was modified from the AAV2/9 REP-AAP plasmid previously used by deletion of the amino acids between 450-592. This modification prevents production of an AAV9 capsid during viral library production after a plausible recombination event between this plasmid co-transfected with rAAV-ΔCap-in-cis-Lox containing the library inserts.

Two rAAV genomes were used in this study. The first, pAAV-CAG-mNeonGreen, utilizes a single-stranded (ss) rAAV genome containing the fluorescent protein mNeonGreen under control of the ubiquitous CMV-β-Actin-intron-β-Globin hybrid promoter (CAG). The second, pAAV-CAG-NLS-GFP (Addgene #104061), utilizes a ssAAV genome containing the fluorescent protein EGFP flanked by two nuclear localization sites, PKKKRKV (SEQ ID NO: 45486), under control of the CAG promoter.

Viral Production

Recombinant AAVs were described in Challis, R. C. et al. Systemic AAV vectors for widespread and targeted gene delivery in rodents. Nat. Protoc. 14, 379 (2019). Briefly, triple transfection of HEK293T cells (ATCC) using polyethylenimine (PEI) was performed, virus was collected after 120 hours from both cell lysates and media and purified over iodixanol (Optiprep, Sigma).

A modified protocol was used for transfection and purification of viral libraries. First, to prevent mosaic capsid formation, only 10 ng of rAAV-Cap-in-cis-Lox library DNA was transfected (per 150 mm plate) to decrease the likelihood of multiple library DNAs entering the same cell. Second, virus was collected after 60 hours, instead of 120, to limit secondary transduction of producer cells. Finally, instead of PEG precipitation of the viral particles from the media, as performed in the standard protocol, media was concentrated >60-fold for loading onto iodixanol. This step was performed to prevent aggregation and loss of viral diversity, something that was noticed during PEG precipitation.

Animals

All rodent procedures were approved by the Institutional Animal Use and Care Committee (IACUC) of the California Institute of Technology. Transgenic animals, expressing Cre under control of various cell-type specific promoters, as well as C57Bl/6J WT mice (000664) were purchased from the Jackson Laboratory (JAX). Transgenic mice included Syn1-Cre (3966), GFAP-Cre (012886) and Tek-Cre (8863). For round 1 and round 2 selections of viral library, one male and one female mouse, 8-12 weeks of age, of each transgenic line were used, as well as a single male C57Bl/6J. For validation of individual viral variants, male C57Bl/6J mice were used, aged 6-8 weeks. Intravenous administration of rAAV vectors was performed via injection into the retro-orbital sinus.

Viral Library Recovery and Sequencing

Round 1 and round 2 viral libraries were injected into C57Bl/6J and Cre-transgenic animals at a dose of $8\times10^{10}$ vg/animal and rAAV genomes were recovered two weeks post injection. Mice were euthanized, and most major organs were recovered, snap frozen on dry ice and placed into long-term storage at −80° C. Tissues included: brain, spinal cord, DRGs, liver, lungs, heart, stomach, intestines, kidneys, spleen, pancreas, skeletal muscle and adipose tissue. 100 mg of each tissue (~250 mg for brain hemisphere, <100 mg for DRGs) was homogenized in Trizol (Life Technologies, 15596) using a BeadBug (Benchmark Scientific, D1036) and viral DNA isolated according to the manufacturer's recommended protocol. Recovered viral DNA was treated with RNase, underwent restriction digestion with SmaI (found within the ITRs) to improve later rAAV genome recovery by PCR, and purified with a Zymo DNA Clean and Concentrator kit (D4033). Viral genomes flipped by Cre-recombinase in select transgenic lines (or pre-flipped in WT animals) were selectively recovered using the following primers: 5'-CTTCCAGTTCAGCTACGAGTTTGAGAAC-3'(SEQ ID NO: 45487) and 5'-CAAGTAAAACCTCTA-CAAATGTGGTAAAATCG-3' (SEQ ID NO: 45488), after 25 cycles of 98° C. for 10s, 60° C. for 15s and 72° C. for 40s, using Q5 DNA polymerase in five 25 µl reactions with 50% of the total extracted viral DNA as a template.

After Zymo DNA purification, samples from the WT C57Bl/6J animals were serially diluted between 1:10-1:10,000 and each dilution further amplified around the library variable region. This amplification was done using primers: 5'-ACGCTCTTCCGATCTAATACTTGTAC-TATCTCTCTAGAACTATT-3' (SEQ ID NO: 45489) and 5'-TGTGCTCTTCCGATCTCACACTGAATTT-TAGCGTTTG-3' (SEQ ID NO: 45490) and 10 cycles of 98° C. for 10s, 61° C. for 15s and 72° C. for 20s, to recover 73 bp of viral genome around and including the 21 bp variable region and add adapters for Illumina next-generation sequencing. After PCR cleanup, these products were further amplified using NEBNext Dual Index Primers for Illumina sequencing (New England Biolabs, E7600), after 10 cycles of 98° C. for 10s, 60° C. for 15s and 72° C. for 20s. The amplification products were run on a 2% low-melting-point agarose gel (ThermoFisher Scientific, 162050) for better separation and recovery of the 210 bp band. The dilution series was analyzed for each WT tissue and the highest concentration dilution which resulted in no product was chosen for further amplification of the viral DNA from the transgenic animal tissues. This process was performed to differentiate between viral genomes flipped prior to packaging or due to Cre in the animal Pre-flipped viral genomes should be avoided to minimize false-positives in the NGS sequencing results.

Using the dilutions resulting in a product that doesn't contain pre-flipped viral genomes, all Cre-flipped viral genomes from transgenic animal tissues were similarly amplified to add Illumina sequencing adapters and subsequently for index labeling. The amplified products now containing unique indices for each tissue from each animal were run on a low-melting-point agarose gel and the correct bands extracted and purified with a Zymoclean Gel DNA Recovery kit.

Packaged viral library DNA was isolated from the injected viral library by digestion of the viral capsid and purification of the contained ssDNA. These viral genomes were amplified by two PCR amplification steps, like the viral DNA extracted from tissue, to add Illumina adapters and then indices and extracted and purified after gel electrophoresis. This viral library DNA, along with the viral DNA extracted from tissue was sent for deep sequencing using an Illumina HiSeq 2500 System (Millard and Muriel Jacobs Genetics and Genomics Laboratory, Caltech).

NGS Data Alignment and Processing

Raw fastq files from NGS runs were processed with custom built that align the data to an AAV9 template DNA fragment containing the 21 bp diversified region between AA 452-458. The pipeline to process these datasets involved filtering to remove low-quality reads, utilizing a quality score for each sequence and eliminating bias from PCR-induced mutations or high GC-content. The filtered dataset was then aligned by perfect string match algorithm and trimmed to improve the alignment quality. Read counts for each sequence were then pulled out and displayed along with their enrichment score, defined as the relative abundance of the sequence found within the specific tissue over the relative abundance of that sequence within the injected viral library.

Enrichment quantification. Enrichment for a specific variant in a target tissue was calculated in reference to the entire library within that tissue and was defined as the prevalence of the variant within the target tissue normalized to the prevalence in the variant within the injected viral library.

$$\text{Enrichment(Var1)} = \log\frac{\text{probability of Var1 in tissue}}{\text{probability of Var1 in injected library}}$$

A positive enrichment score is achieved if the AAV variant is found more prevalently in the tissue than in the injected viral library and a negative one is achieved if the AAV variant is found less prevalently. An enrichment score of 0 means that either the variant was found in exactly the same prevalence in tissue and injected viral library, or that there were no read counts of the specific variant in the target tissue, i.e. the variant could not be detected in the tissue. As the former is unlikely, an enrichment score of 0 is interpreted to meant that the variant is not present in the tissue. Thus, an AAV variant was determined to de-target a tissue if its enrichment score in that tissue was less than or equal to 0. In vivo characterization of liver transduction from a number of AAV variants having an enrichment score of 0 relative to their parental AAV vector AAV9 verified that this interpretation was accurate (see, e.g., FIG. 17D, E).

Tissue Preparation and Immunohistochemistry

Mice were euthanized with Euthasol and transcardially perfused with ice-cold 1×PBS and then freshly prepared, ice-cold 4% paraformaldehyde (PFA) in 1×PBS. All organs were excised and post-fixed in 4% PFA at 4° for 48 hours and then sectioned by vibratome. IHC was performed on floating sections with primary and secondary antibodies in PBS containing 10% donkey serum and 0.1% Triton X-100. Primary antibodies used were rabbit anti-NeuN (1:200, Abcam, 177487), rabbit anti-S100 (1:200, Abcam, 868), rabbit anti-Olig2 (1:200, Abcam, 109186) and rabbit anti-Calbindin (1:200, Abcam, 25085). Primary antibody incubations were performed for 16-20 hours at room temperature (RT). The sections were then washed and incubated with secondary Alexa-647 conjugated anti-rabbit FAB fragment antibody (1:200, Jackson ImmunoResearch Laboratories, Inc., 711-607-003) for 6-8 hours at RT. For nuclear staining, floating sections were incubated in PBS containing 0.2% Triton X-100 and DAPI (1:1000, Sigma Aldrich, 10236276001) for 6-8 hours and then washed. Stained sections were then mounted with ProLong Diamond Antifade Mountant (ThermoFisher Scientific, P36970).

Imaging and Quantification

All CAG-mNeonGreen expressing tissues were imaged on a Zeiss LSM 880 confocal microscope using a Fluar 5×0.25 M27 objective, with matched laser powers, gains and gamma across all samples of the same tissue. The acquired images were processed in Zen Black 2.3 SP1 (Zeiss).

All CAG-NLS-GFP expressing tissues were imaged on a Keyence BZ-X all-in-one fluorescence microscope at 48-bit resolution with the following objectives: PlanApo-λ 20×/0/75 (1 mm working distance) or PlanApo-λ 10×/0.45 (4 mm working distance). For colocalization of GFP expression to antibody staining, in some cases the exposure time for the green (GFP) channel was adjusted to facilitate imaging of high and low expressing cells while avoiding oversaturation. In all cases in which fluorescent intensity was compared between samples, exposure settings and changes to gamma or contrast were maintained across images. To minimize bias, multiple fields of view per brain region and peripheral organ were acquired for each sample. For brain regions, the fields of view were matched between samples and chosen based upon the antibody staining rather than GFP signal. For peripheral tissues, fields of view were chosen based upon the DAPI or antibody staining to preclude observer bias.

All image processing was performed with the Keyence BZ-X Analyzer. Data analysis was performed with Microsoft Excel 2018 and GraphPad Prism 7. Colocalization between GFP signal and antibody or DAPI staining was performed using the Keyence BZ-X Analyzer with the hybrid cell count automated plugin. Automated counts were validated and routinely monitored by comparison to manual hand-counts and found to be below the margin of error for manual counts.

To compare total cell counts and fluorescent intensity throughout the brain between samples, an entire sagittal section located 1200 μM from midline was imaged using matched exposure conditions with the Keyence BZ-X automated XY stitching module. Stitched images were then deconstructed in the Keyence BZ-X Analyzer suite and run through the hybrid cell count automated plugin to count the total number of cells in the entire sagittal section. Average fluorescent intensity was calculated by creating a mask of all GFP positive cells throughout the sagittal section and measuring the integrated pixel intensity of that mask. The total integrated pixel intensity was divided by the total cell count to obtain the fluorescent intensity per cell measure. In all cases where direct comparisons were made of fluorescent intensity, exposure settings and postprocessing contrast adjustments were matched between samples.

Statistics

Microsoft Excel 2018 and GraphPad Prism 7 were used for statistical analysis and data representation. Unless otherwise noted, all experimental groups were n=6 and determined using preliminary data and experimental power analysis. For the statistical analysis and their graphs, a single data point was defined as two tissue sections per animal with multiple technical replicates per section when possible. Technical replicates are defined as multiple fields of view per section, with the following numbers for each region or tissue of interest: cerebellum=3, cortex=4, hippocampus=3, midbrain=1, striatum=3, thalamus=4, liver=4, spleen=2, testi=2, kidney=2, lung=2, spine=1, DRG=1, whole sagittal=1.

Example 2. Overview of Cre-Dependent Positive and Negative Selection of Viral Libraries For the express purpose of engineering AAVs with high efficiency toward specific organs and away from others after systemic administration, an updated version of the CREATE screening method (M-CREATE) was used, which allowed for the selection of large libraries of viral variants in vivo. FIG. 1 shows a schematic of the M-CREATE methods used. With CREATE, a library of AAV capsids with mutations at a specific location was generated by PCR with degenerate primers, viruses packaging a replication-incompetent version of their own genome with a polyadenylation site flanked by Cre/Lox sites are produced in HEK293 cells, and the viral library is injected into transgenic animals expressing Cre in a specific population of cells. If variants of the library successfully transduce cells expressing Cre, their genome is flipped and the sequence of those variants can be recovered in a Cre-dependent manner.

Selection of variants in multiple transgenic mouse lines expressing Cre in different cell populations: Tek-Cre for endothelial cells throughout the body, hSynl-Cre for neurons of the CNS and PNS, and GFAP-Cre for astrocytes, was performed. By performing selections in parallel in multiple transgenic lines, both positive and negative selection can be applied thereby recovering target sequences from a specific tissue of interest, that were not recovered from others. Next, the recovered viral DNA from the tissues of interest were sequenced and indexed. The sequences were then ranked based on prevalence in target environment or cell-type of interest. A second-round library was synthesized containing only the top-performing sequences from round 1.

The AA455 loop of AAV9 is the furthest protruding from the surface of the capsid and has previously been implicated in neutralizing antibody binding. The most commonly manipulated loop in AAVs is the AA588 loop, due to it being the site of heparan sulfate binding of AAV2 and amenable to peptide display. The only known receptor for AAV9 is N-linked terminal galactose, but many indications point toward there being others.

Without wishing to be bound by any particular theory, the AA455 loop may also play a role in cell-surface receptor binding, either on its own or by interaction with the AA588 loop. To determine whether variant amino acid sequences at the AA455 loop contribute to desired AAV tropisms, rAAVs were engineered and rounds of selection were performed using the M-CREATE method of a 7 amino acid substitution library of the 455 loop, between AA452-458 (FIG. 1A-1B) in AAV-PHP.eB, a variant of AAV9 previously engineered at the AA588 loop for increased efficiency in crossing the BBB.

Figure 15A:
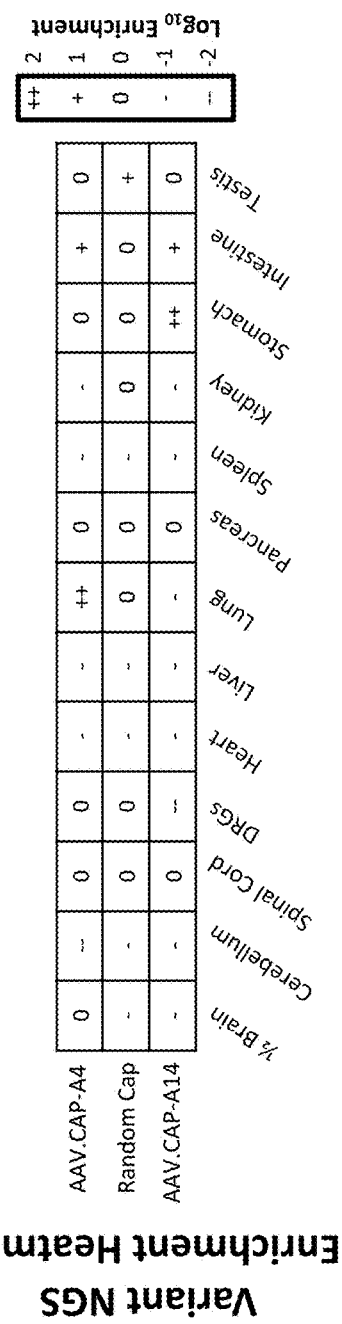
FIG. 15A-15B shows next generation sequencing data and in vivo transduction efficiency of candidate variants.
Figure 15B:
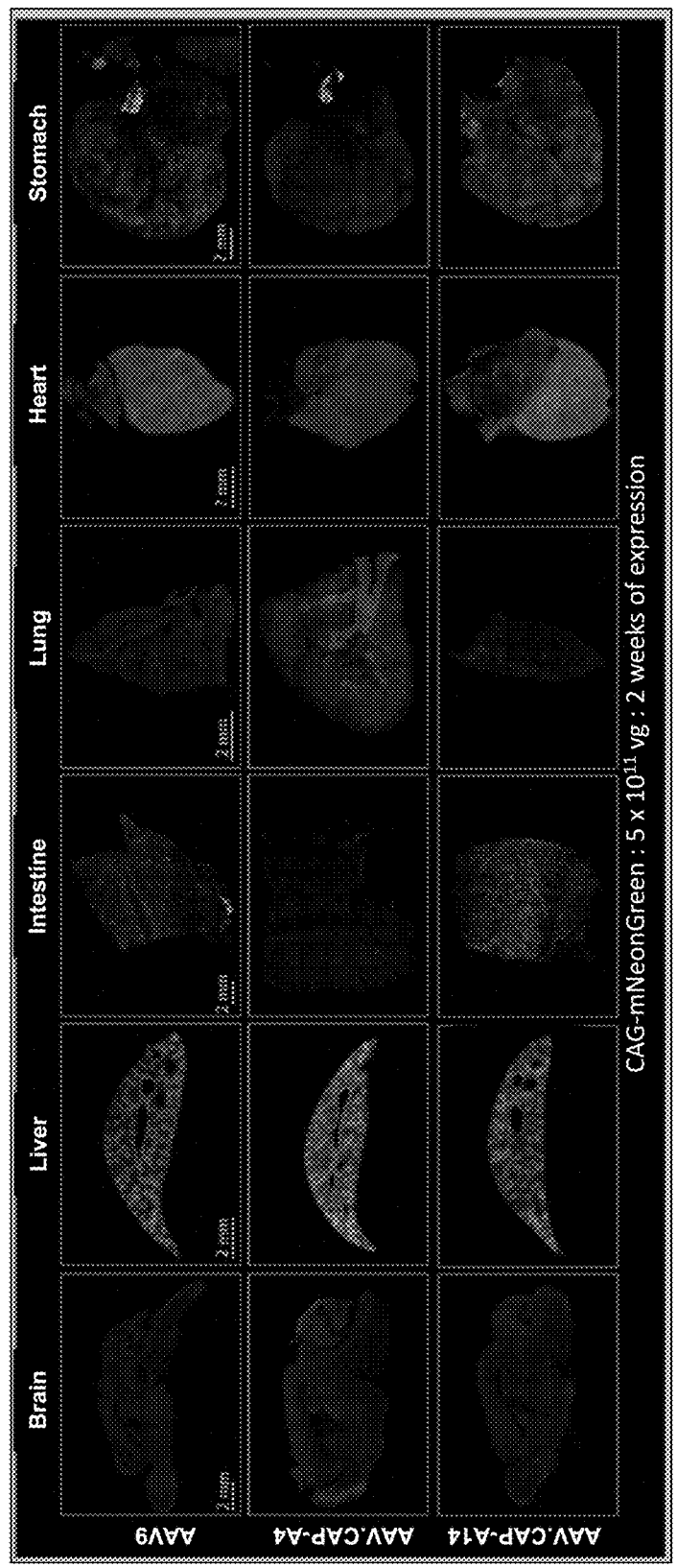

Example 3. AAV Capsid Variants with Tropisms Bias Toward the Lung and Against the Liver in Rodents AAV.CAP-A4 Exhibits Strong Lung-Specific Transduction Highly enriched variants for a number of targets were discovered after two rounds of in vivo selection. The results from the second round of selection for lung enrichment yielded several candidate variants, one of which showed significant enrichment in the lung, with detargeting of several peripheral organs A randomly chosen variant (FIG. 15A), as well as a second novel capsid that emerged from this screen that was found to be enriched specifically in gut neurons are provided as a comparison. To directly assess transduction efficiencies, the capsid sequences for the candidate variants were cloned into an AAV9 backbone, and virus was produced for each variant packaging mNeonGreen, a fluorescent reporter, driven by the ubiquitous synthetic promoter CAG. This construct will drive strong expression of the fluorescent promoter in all cell types transduced by the vector, thereby giving a visual readout of the transduction of each variant across cell and tissue types. Following purification, $5 \times 10^{11}$ vector genomes (vg) of each variant, including AAV9 as a control, were injected into 2 male c57bl/6 mice. Following two weeks of expression, animals were sacrificed, perfusion fixed, and a panel of organs were sectioned and imaged for fluorescence (FIG. 15B). The expression pattern confirms the next generation sequencing (NGS) results, with AAV.CAP-A4 (KDNTPGR (SEQ ID NO: 32538) encoded by AACAACCTCCCCAGAAACCTC (SEQ ID NO: 46429)) showing increased transduction throughout the lung. As a comparison, AAV.CAP-A14 shows increased expression in neurons within the intestine and stomach, which is in accordance with the NGS results.

Figure 16A:
FIG. 16A-16D shows the tropism of AAV.CAP-A4 is strongly enriched in submucosal cells within the lung. ssAAV9:CAG-NLSx2-EGFP, ssAAV5:CAG-NLSx2-EGFP or ssAAV.CAP-A4:CAG-NLSx2-EGFP was intravenously injected into male adult mice at $1\times10^{11}$ vg/mouse. GFP fluorescence was assessed after three weeks of expression.
Figure 16B:
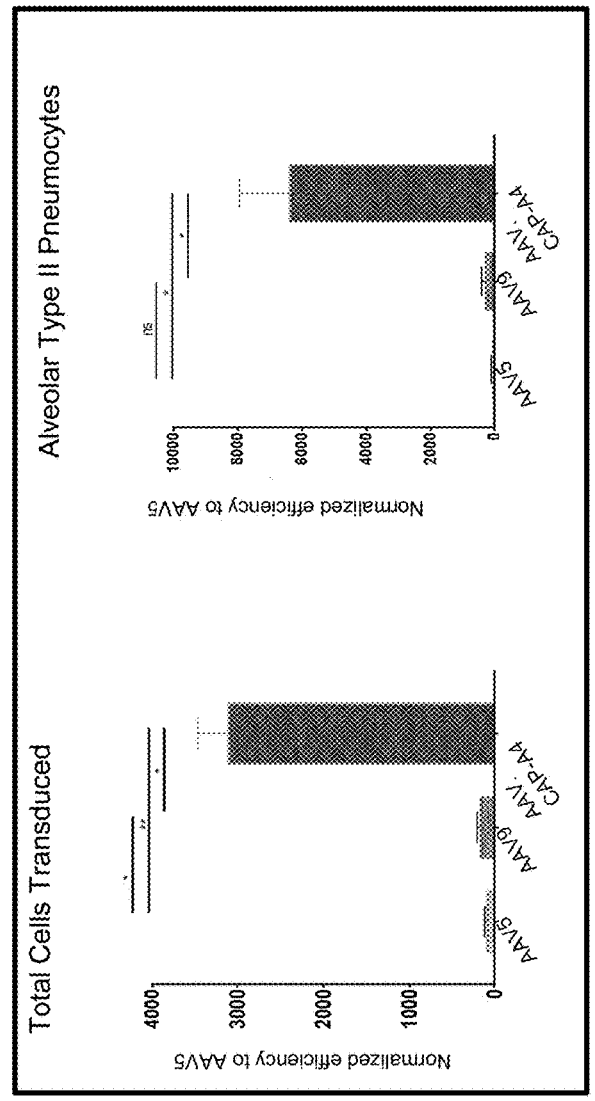
Figure 16C:
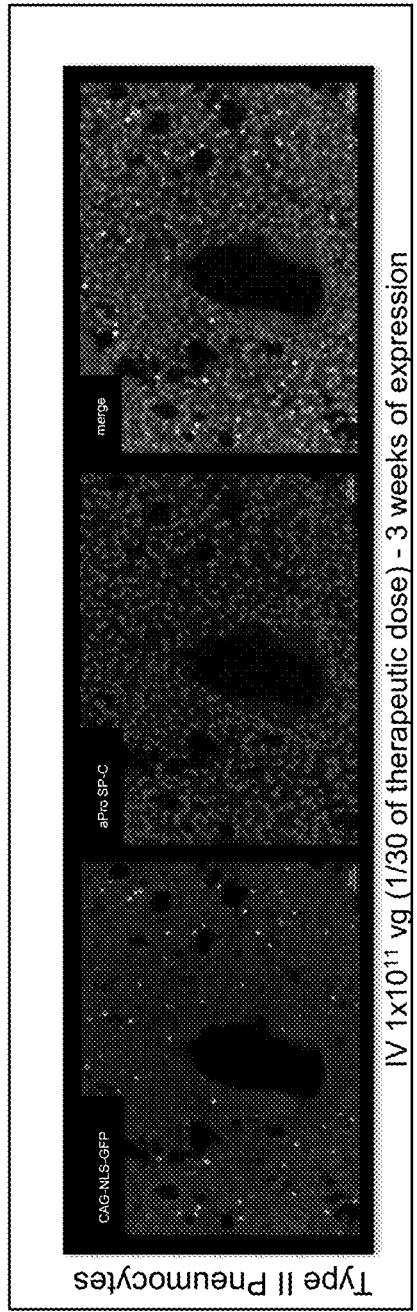
Figure 16D:
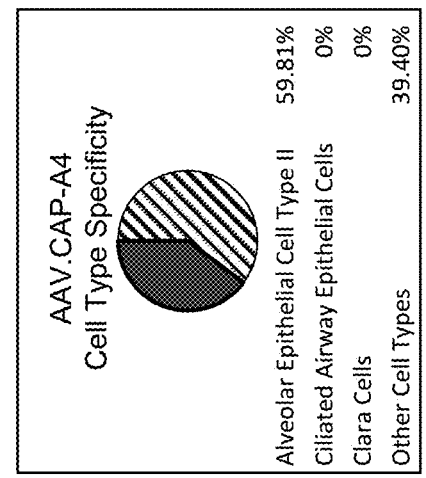

Following confirmation that AAV.CAP-A4 showed increased transduction of the lung, transduction efficiencies of AAV.CAP-A4, along with AAV9 and AAV5 as controls, were quantified across time in clinically relevant cell types following low-dose systemic injection. For these experiments, AAV.CAP-A4, AAV5, and AAV9 were injected into age-matched male mice and allowed to express for 3 weeks (n=3) or 6 months (n=3). In addition, a nuclear localization sequence (NLS) was cloned into a CAG-GFP expression cassette to restrict expression of the fluorescent reporter to the nucleus, aiding in co-localization with specific antibody staining. Following tissue preparation, serialized sections of the lungs from each of the variants were stained with antibodies for ciliated airway epithelial cells, clara cells, and alveolar epithelial type II (ATII) cells (FIG. 16A). Quantification shows that systemically injected AAV.CAP-A4 transduces submucosal cells at ~15 fold greater efficiency than AAV9, and ~30 fold greater than AAV5 (FIG. 16B). Similarly, transduction of ATII cells is ~30 fold greater than AAV9, and ~60 fold greater than AAV5 (FIG. 16C). Of the total number of cells transduced by AAV.CAP-A4, approximately 60% of them are ATII cells, with the other 40% being of an unknown, submucosal cell type (FIG. 3D). These results demonstrate that AAV.CAP-A4 provides unprecedented, non-invasive genetic access to submucosal cells in the lungs following systemic administration which, alone or in conjunction with delivery direct to the airways, may provide sufficient CFTR functionalization to reduce CF disease progression.

FIG. 4 shows 7-mer variant AAV capsid amino acid sequences and DNA sequences encoding the 7-mer variant AAV capsid amino acid sequences with a tropism specific to the heart. FIG. 5 shows 7-mer variant AAV capsid amino acid sequences and DNA sequences encoding the 7-mer variant AAV capsid amino acid sequences with a tropism specific to the intestine. FIG. 6 shows 7-mer variant AAV capsid amino acid sequences and DNA sequences encoding the 7-mer variant AAV capsid amino acid sequences with a tropism specific to the kidney. FIG. 7 shows 7-mer variant AAV capsid amino acid sequences and DNA sequences encoding the 7-mer variant AAV capsid amino acid sequences with a tropism specific to the liver. FIG. 8 shows 7-mer variant AAV capsid amino acid sequences and DNA sequences encoding the 7-mer variant AAV capsid amino acid sequences with a tropism specific to muscle. FIG. 9 shows 7-mer variant AAV capsid amino acid sequences and DNA sequences encoding the 7-mer variant AAV capsid amino acid sequences with a tropism specific to the pancreas. FIG. 10 shows 7-mer variant AAV capsid amino acid sequences and DNA sequences encoding the 7-mer variant AAV capsid amino acid sequences with a tropism specific to the spleen. FIG. 11 shows 7-mer variant AAV capsid amino acid sequences and DNA sequences encoding the 7-mer variant AAV capsid amino acid sequences with a tropism specific to the stomach. FIG. 12 shows 7-mer variant AAV capsid amino acid sequences and DNA sequences encoding the 7-mer variant AAV capsid amino acid sequences with a tropism specific to the testicle. FIG. 13 shows 7-mer variant AAV capsid amino acid sequences and DNA sequences encoding the 7-mer variant AAV capsid amino acid sequences with a tropism specific to lung. FIG. 14 shows 7-mer variant AAV capsid amino acid sequences and DNA sequences encoding the 7-mer variant AAV capsid amino acid sequences with a tropism specific to adipose tissue.

Figure 17C:
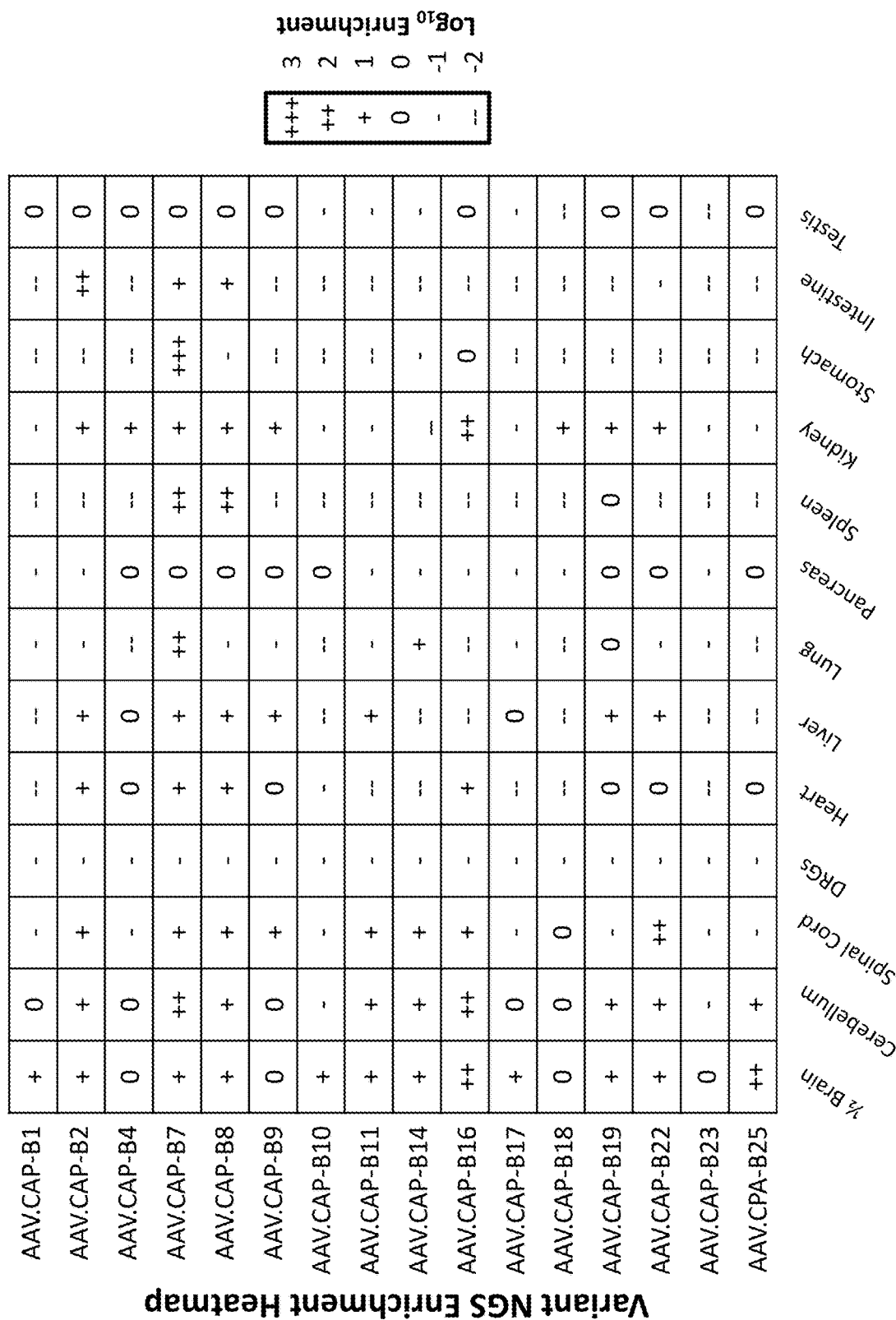
Figure 17D:
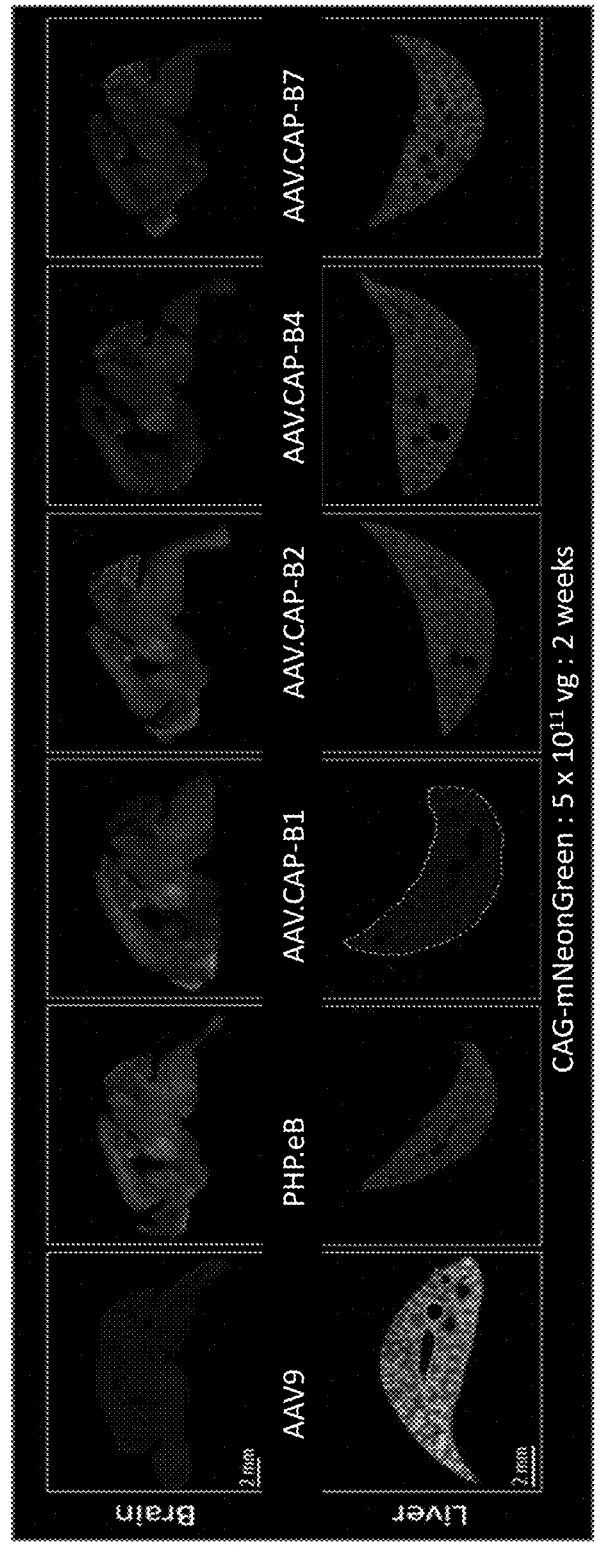
Figure 17E:
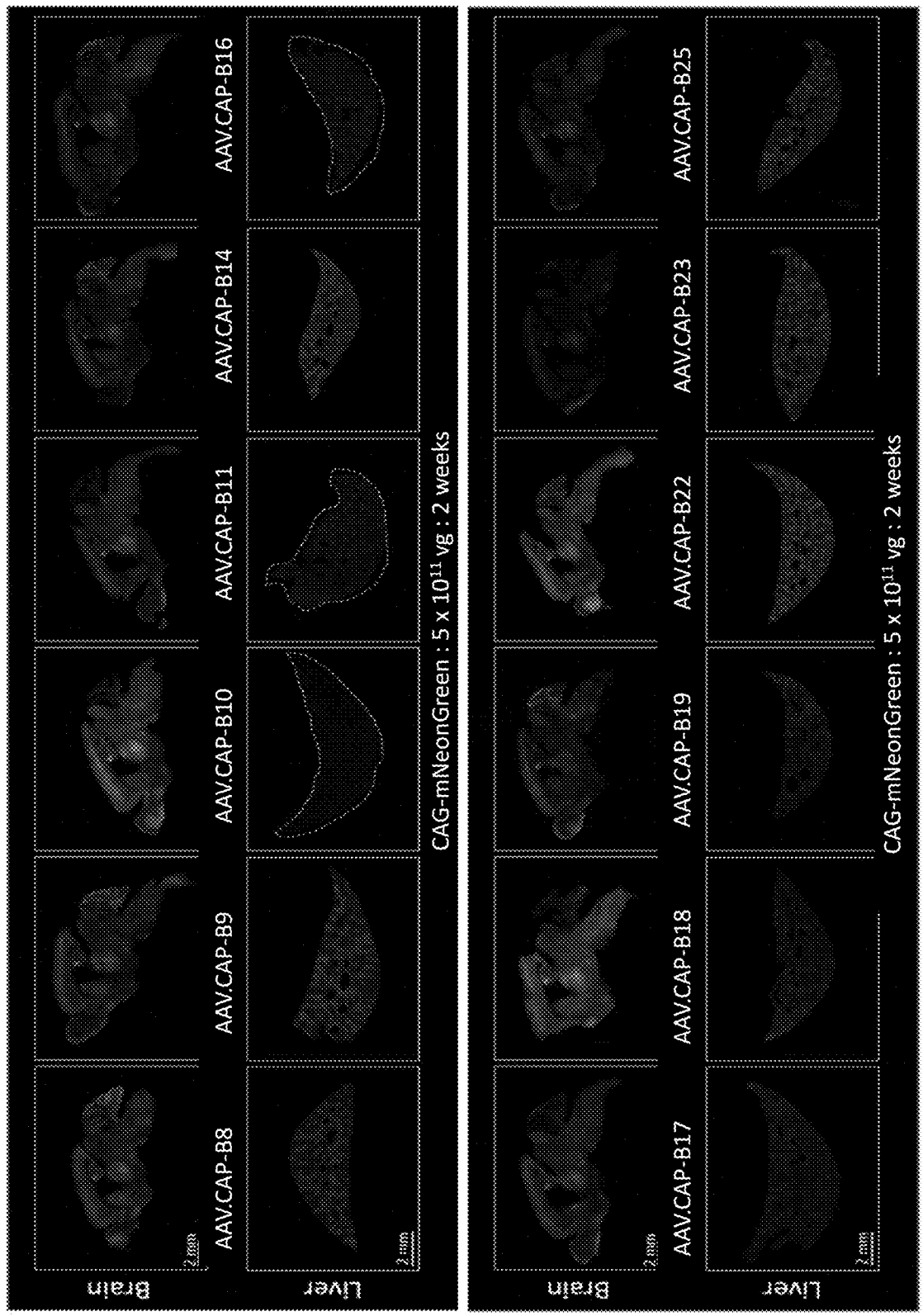

Example 4. AAV Capsid Variants with Tropism Bias Toward Central and Peripheral Nervous System and Against the Liver in Rodents Engineering AAV-PHP.eB Away from Peripheral Expression After the first round of selection, the recovered sequences were analyzed. A second round was synthesized, which contained approximately 82,000 unique variants enriched in the brain compared to peripheral organs. After a second round of selection which narrowed down the top performing variants by a couple orders of magnitude, a small subset of sequences to test were selected (FIG. 4b) that exhibited high levels of enrichment for the brain, and negative enrichment for the liver and other peripheral organs (FIG. 17C). This subset was tested individually in wild-type mice, injecting $5 \times 10^{11}$ viral genomes packaging CAG-mNeonGreen and allowing for two weeks of expression. The resulting expression in the brains and livers (FIG. 17D) correlated very closely with the next generation sequencing (NGS) enrichments, with variant AAV.CAP-B10 standing out as exhibiting higher fluorescence in the brain than PHP.eB and negligible liver transduction.

The above results match NGS enrichment findings for both brain and periphery. In this case, the insertion/substitution at the AA588 loop to make PHP.eB seems to confer a brain phenotype, while the substitutions at AA455 detarget that phenotype from the liver and other peripheral organs. Of the 82,000 variants that comprised the second round of selection, roughly 39,000 exhibited positive enrichment in the brain and negative enrichment in the liver. These results serve as a validation that the NGS results can be used as an accurate proxy of in vivo performance.

For the ~39,000 sequences that exhibited brain enrichment and liver de-targeting, the amino acid makeup was analyzed that resulted in this phenotype. The frequency at which amino acids were selected throughout the 7-mer substitution were analyzed and plotted their deviation from the mean as a heat map of enriched amino-acids at specific positions. These positively enriched amino acids de-target the capsid from the liver, while retaining CNS enrichment.

AAV.CAP-B10 Exhibits CNS-Specific Transduction

Figure 18A:
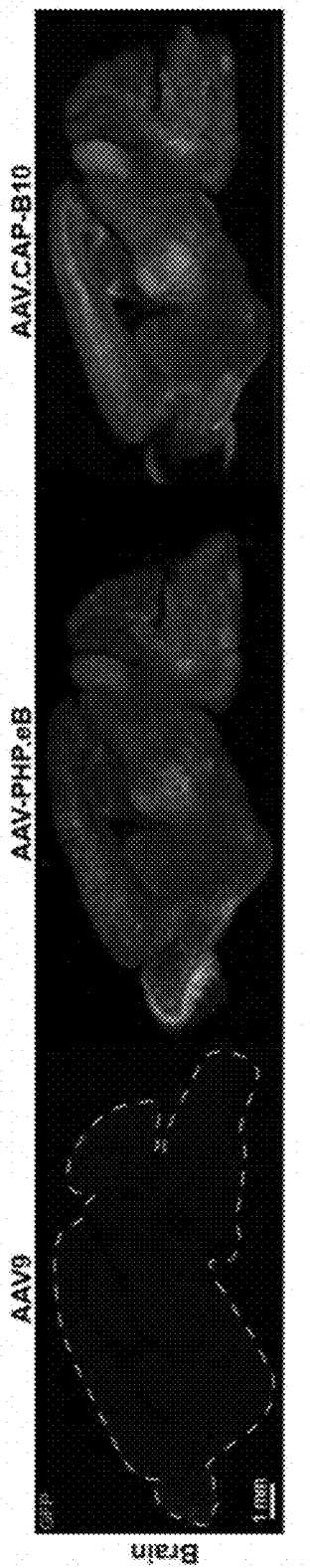
Figure 18B:
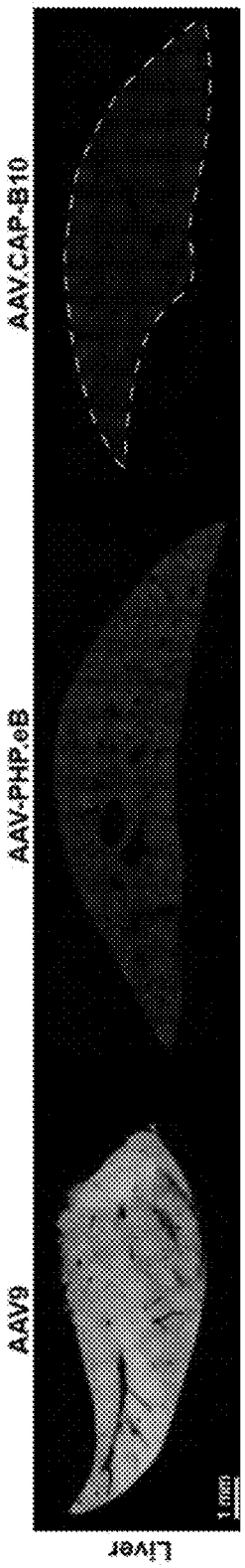

To fully characterize the performance of AAV.CAP-B10 in comparison with AAV9 and PHP.eB, nuclear localized CAG-EGFP were packaged and injected $1 \times 10^{11}$ viral genomes into animals Expression was measured after three weeks. This dose was chosen as an average dose for previous experiments utilizing systemic delivery to the brain. The results show an increase in the average number of cells transduced in the brain, as well as the average level of expression per cell, between AAV.CAP-B10 and PHP.eB, while both are very significantly higher than AAV9 (FIG. 18A-5C). In the spinal cord, AAV.CAP-B10 performs at roughly 60% of the efficiency of PHP.eB, yet still almost 20-fold higher than AAV9. Conversely, AAV.CAP-B10 is very significantly reduced in the liver compared to both PHP.eB (~50-fold) and AAV9 (>100-fold), and slightly, yet insignificantly, dimmer in brightness/cell compared to PHP.eB, while both are significantly dimmer than AAV9 (~10-fold) (FIG. 18B-18D). In the rest of the periphery, the results follow the same trend, with PHP.eB being lower than AAV9, and AAV.CAP-B10 being a fraction of PHP.eB (FIG. 18D).

AAV.CAP-B10 Exhibits Strong Neuronal Bias

Figure 19A:
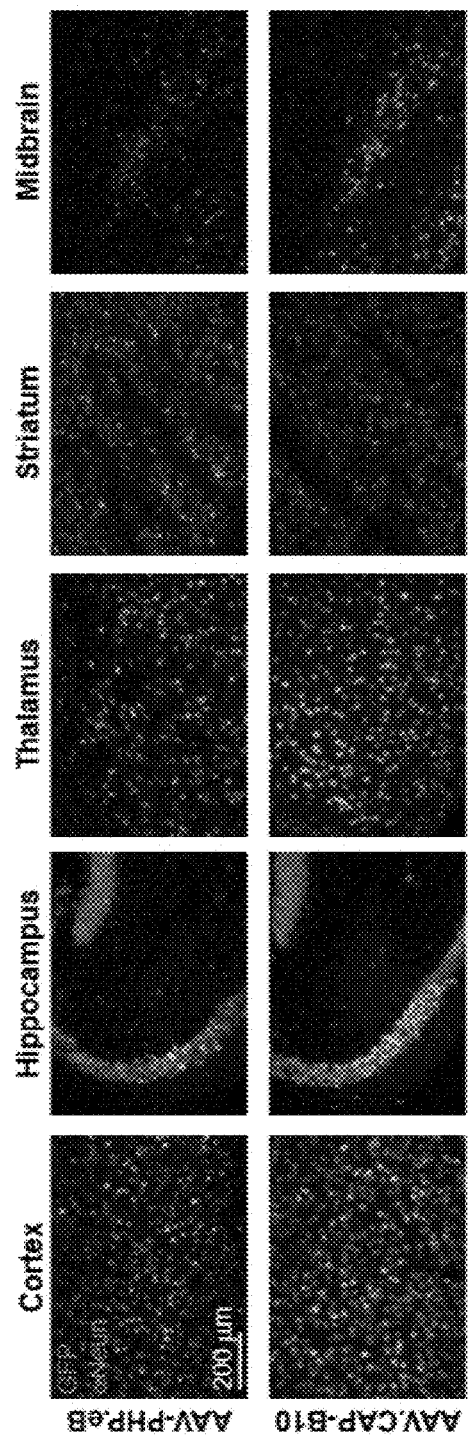
FIG. 19A-F shows that within the brain, AAV.CAP-B10 is strongly biased towards neurons. ssAAV-PHP.eB:CAG-NLSx2-EGFP or ssAAV.CAP-BB10:CAG-NLSx2-EGFP was intravenously injected into male adult mice at $1 \times 10^{11}$ vg/mouse. GFP fluorescence was assessed after three weeks of expression.
Figure 19B:
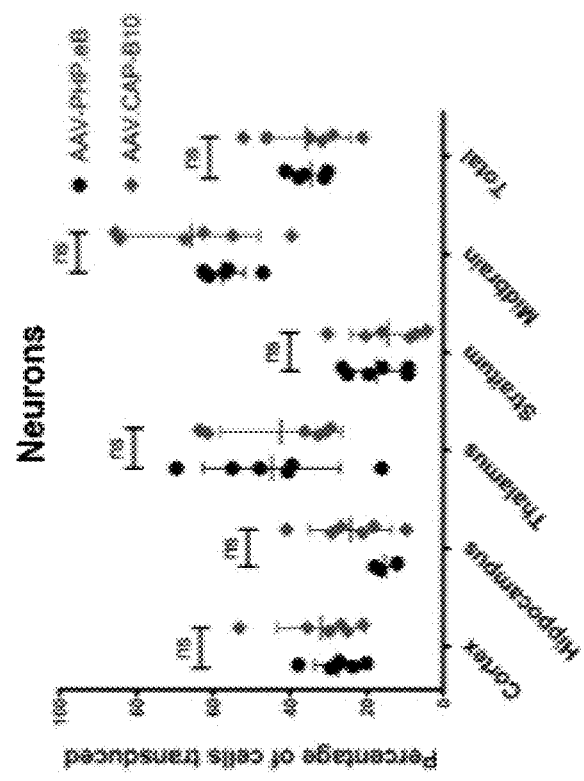
Figure 19C:
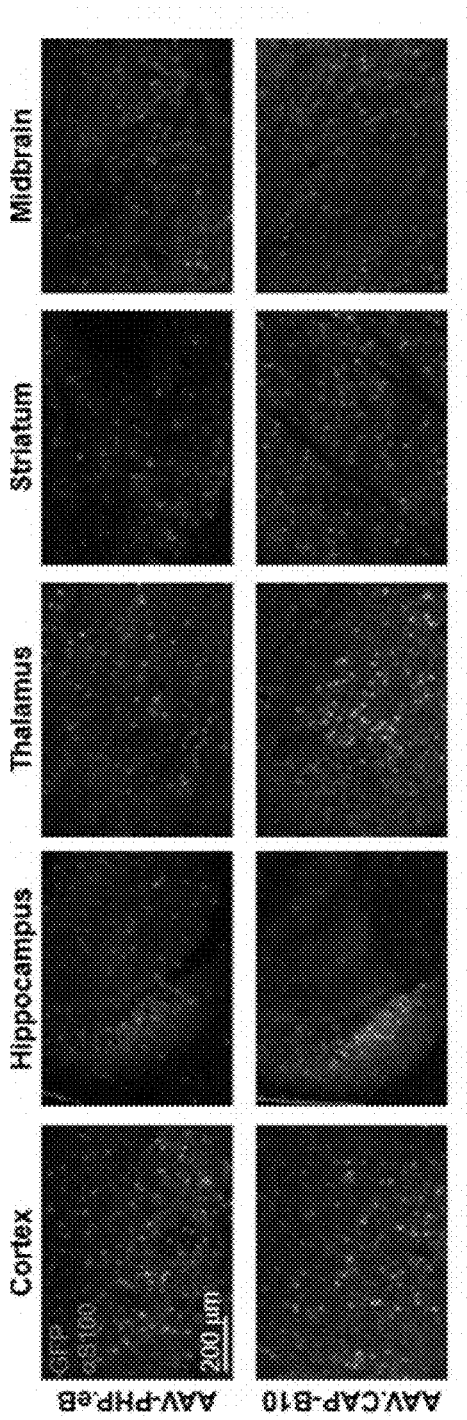
Figure 19D:
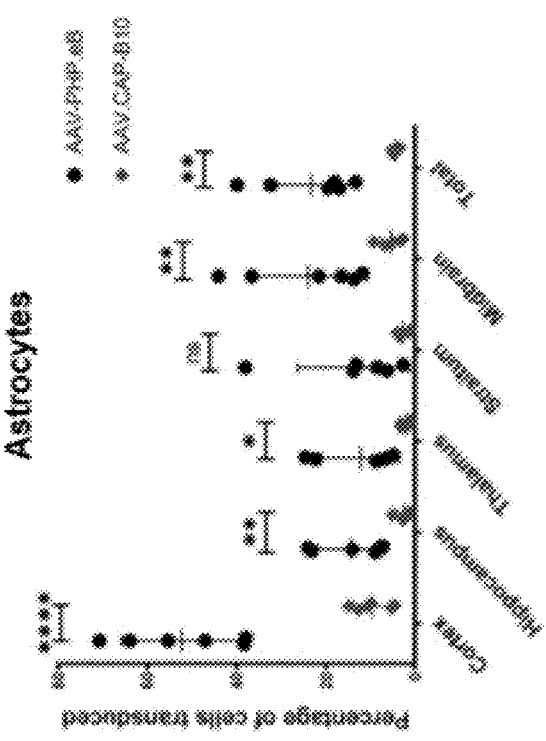
Figure 19E:
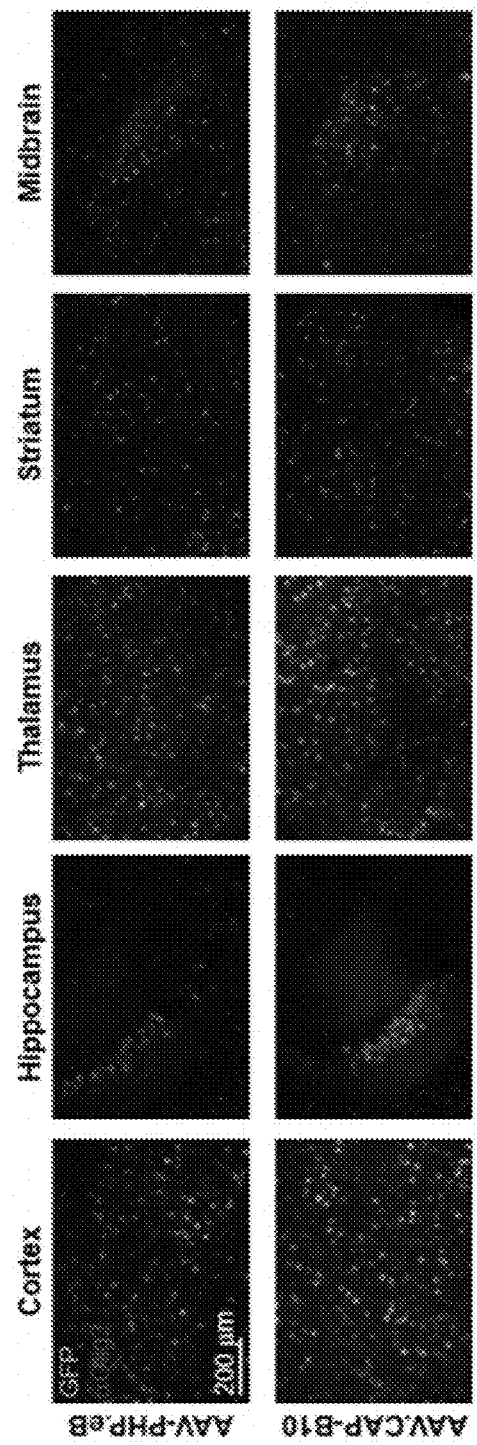
Figure 19F:
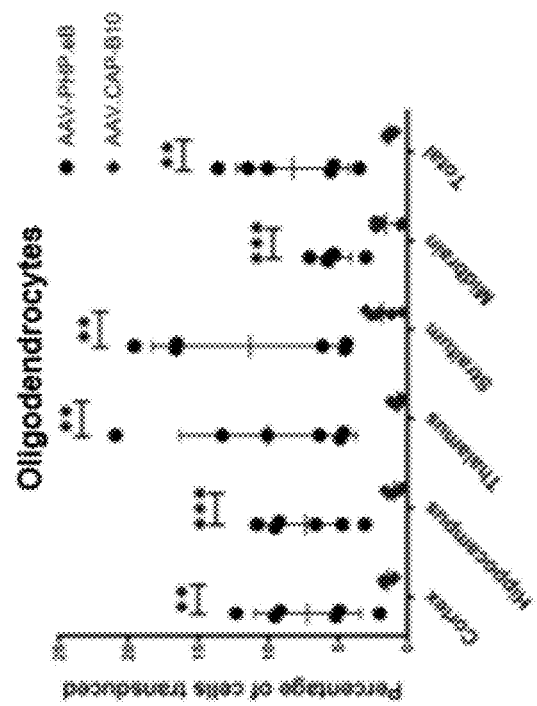
Figure 20B:
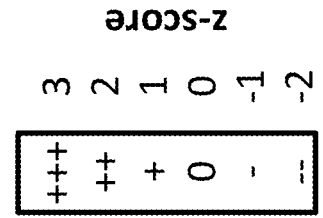
Figure 21:
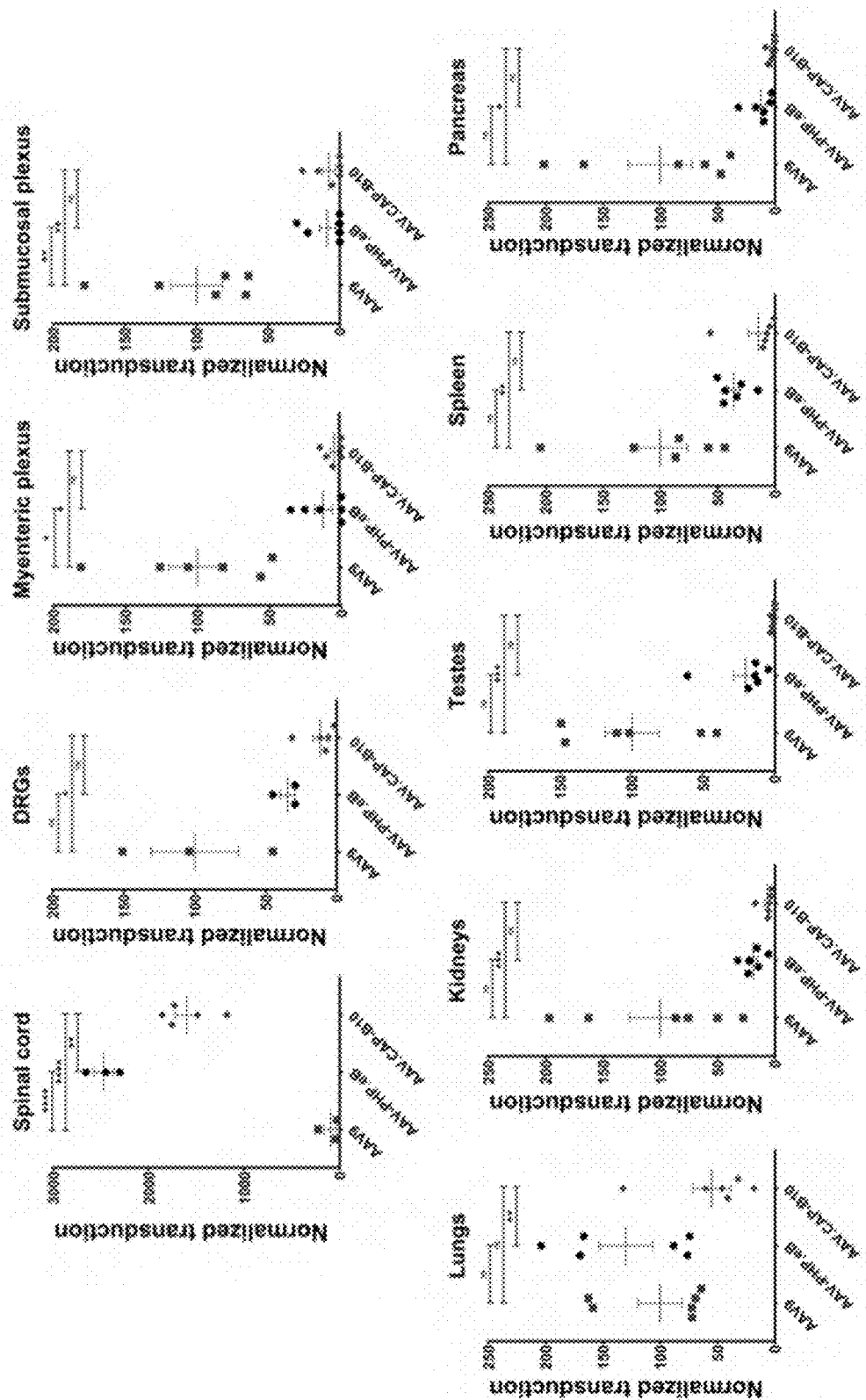
FIG. 21 shows that AAV.CAP-B10 is detargeted from peripheral organs. ssAAV9:CAG-NLSx2-EGFP, ssAAV-PHP.eB:CAG-NLSx2-EGFP or ssAAV.CAP-B10:CAG-NLSx2-EGFP was intravenously injected into male adult mice at 1×1011 vg/mouse. GFP fluorescence was assessed after three weeks of expression. Transduction efficiencies in peripheral tissues show a significant increase and decrease in spinal cord transduction for AAV.CAP-B10 when compared to AAV9 or AAV-PHP.eB, respectively. In the DRGs, AAV.CAP-B10 is significantly decreased when compared to AAV9 and non-significantly decreased when compared to AAV-PHP.eB. In the myenteric and submucosal plexi of the intestines, AAV.CAP-B10 is significantly decreased compared to AAV9 and non-significantly decreased compared to AAV-PHP.eB. In the lungs, AAV.CAP-B10 is significantly decreased when compared to AAV-PHP.eB and non-significantly decreased compared to AAV9. In the kidneys, spleen, pancreas and testes, AAV.CAP-B10 is significantly decreased when compared to AAV9 and non-significantly decreased compared to AAV-PHP.eB. For quantification: n=6 mice per group except for spinal cord and DRGs where n=3 mice for AAV9 and AAV-PHP.eB and n=5 mice for AAV.CAP-B10, mean±SE, ANOVA for spinal cord, Brown-Forsythe and Welch ANOVA tests for myenteric plexus and pancreas, Kruskal-Wallis test for DRGs, submucosal plexus, lungs, kidneys, spleen and testes (*$P \leq 0.05$; n.s., $P \geq 0.05$).
Figure 22B:
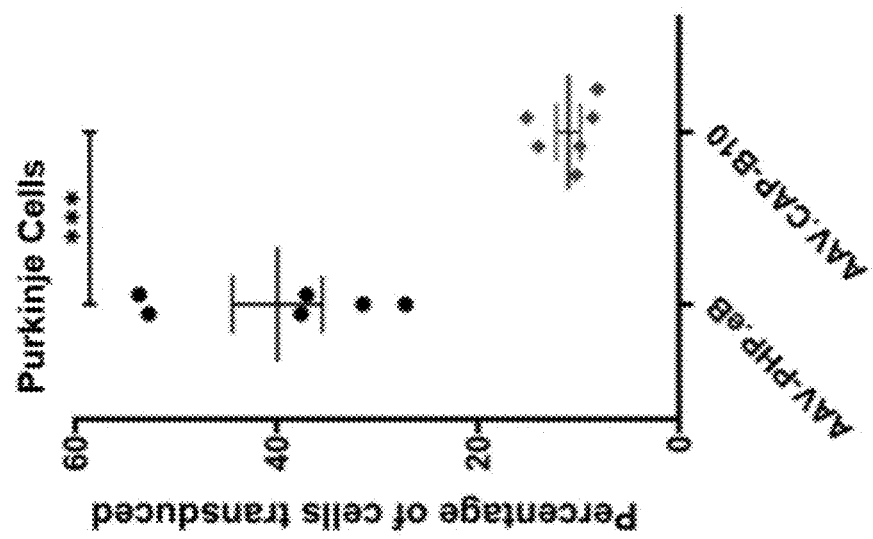
FIG. 22A-22B shows that AAV.CAP-B10 is significantly detargeted from purkinje cells in the cerebellum. ssAAV-PHP.eB:CAG-NLSx2-EGFP or ssAAVCAP-B10:CAG-NLSx2-EGFP was intravenously injected into male adult mice at $1 \times 10^{11}$ vg/mouse. GFP fluorescence was assessed after three weeks of expression.
Figure 22A:
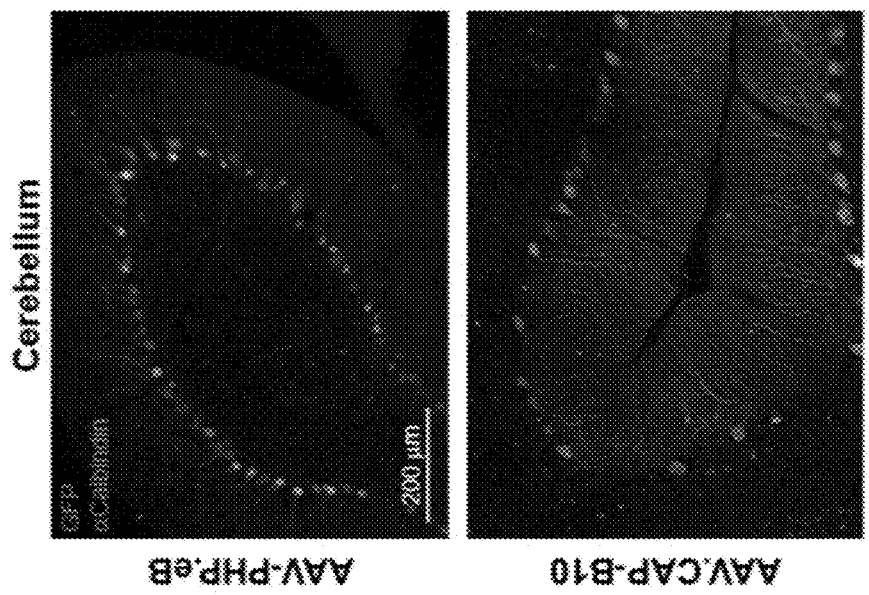
Figure 23E:
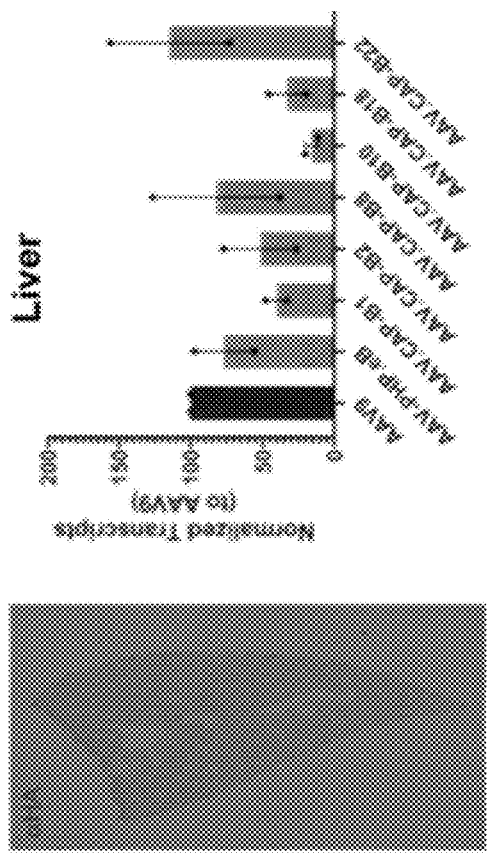
Figure 23F:
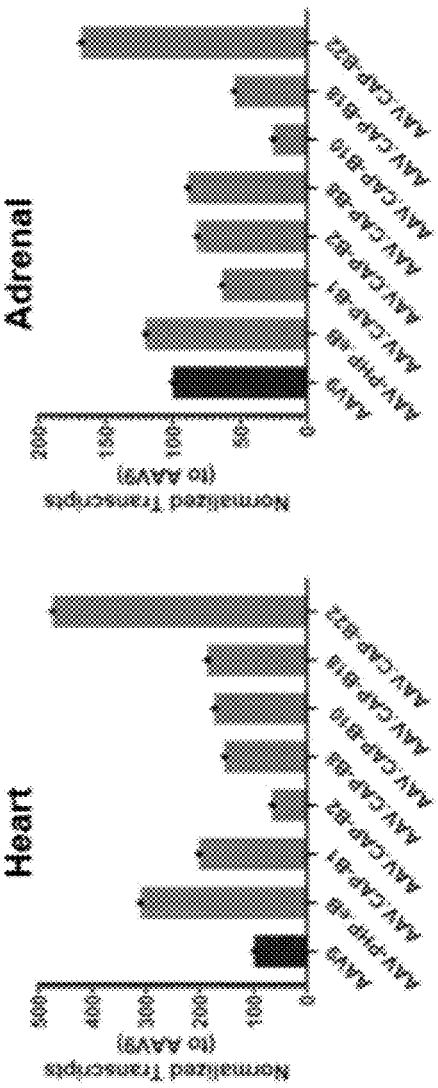

To further characterize what expression within the brain looked like for AAV.CAP-B10 compared to PHP.eB, neurons, astrocytes and oligodendrocytes, were stained and quantified for the efficiency of the viruses at targeting those cell-types in various regions of the brain. While AAV.CAP-B10 and PHP.eB transduced neurons at a similar efficiency across brain regions (FIG. 19A-19B), astrocytes and oligodendrocytes were targeted roughly 4-5-fold lower levels across the whole brain by AAV.CAP-B10 compared to PHP.eB (FIG. 19C, 19D, 19E, 19F). This result indicates a bias for neurons compared to other cell-types conferred by the AAV.CAP-B10 mutations, an interesting deviation from AAV9, which mostly targets astrocytes in the brain. An interesting indication from the NGS data for AAV.CAP-B10 (FIG. 15C) was the variant's negative enrichment in the cerebellum. When characterizing the expression of AAV.CAP-B10 compared to PHP.eB in the cerebellum, there was indeed a significant, roughly 4-fold, decrease in transduction of purkinje cells (FIG. 22).

FIG. 3 shows 7-mer variant AAV capsid amino acid sequences and DNA sequences encoding the 7-mer variant AAV capsid amino acid sequences with a tropism specific to the central nervous system (CNS), and detargeting the liver. FIG. 2 shows 7-mer variant AAV capsid amino acid sequences and DNA sequences encoding the 7-mer variant AAV capsid amino acid sequences with a tropism specific to the CNS.

Example 5. AAV Capsid Variants with Tropisms Bias Toward Central and Peripheral Nervous System and Against the Liver in Non-Human Primates Of primary concern for the therapeutic applicability of variants engineered in rodents is how well their transduction profiles translate to non-human primates (NHPs). As such, the NHP transduction profiles of a subset of the variants that had been validated in rodents were characterized, along with AAV9 and AAV-PHP.eB as controls. A pool of eight viruses, AAV9, AAV-PHP.eB, AAV.CAP-B1, AAV.CAP-B2, AAV.CAP-B8, AAV.CAP-B10, AAV.CAP-B18 and AAV.CAP-B22, were produced, each packaging an HA tagged frataxin under control of the ubiquitous CAG promoter. The use of frataxin was chosen as it is an endogenous protein expressed throughout the body and previous efforts to characterize NHP transduction of naturally occurring and engineered serotypes has found deleterious results potentially due to the packaging of an exogenous transgene like GFP. Each packaged FXN contained a separate 12-base RNA barcode to differentiate the contribution of one virus from the rest after sequencing. The eight viruses were pooled at equal ratios and injected into two adult marmosets at $1.2 \times 10^{14}$ vg/kg total. Following six weeks of expression, brains and livers were recovered, and coronal sections taken for RNA sequencing and immunohistochemistry.

AAV.CAP-B10 showed a greater than 6-fold increase in RNA levels in the brain and greater than 5-fold decrease in liver RNA levels compared to AAV9. Another selected variant, AAV.CAP-B22, showed a greater than 12-fold increase in brain RNA levels with no significant difference in liver RNA levels. Without being bound by any particular theory, these results show that AAV.CAP-B22 and AAV.CAP-B10 are promising variant capsids for the treatment of human disease of the brain. Although a select number of variants were tested in the present example, these finds also suggest that other modified AAV capsid proteins described herein with equal to, or greater, enrichment scores as AAV.CAP-B22 and AAV.CAP-B10 in any target in vivo environment, would also provide a promising therapeutic solution for human disease.

Example 6. Phase 1A Clinical Trial (Huntington's Disease)

A phase 1A clinical trial is performed to evaluate the safety, tolerability, pharmacokinetics, and pharmacodynamics of an one-time intravenous injection of test composition comprising viral vector including a modified AAV capsid protein with an amino acid sequence provided in any one of SEQ ID NOS: 2933, 88, 2466, 3943, 2672, 2743, 3064, 11958, 780, 2764, and 2741, or any of the amino acid sequences provided in Tables 3-4, or FIGS. 2-3, in subjects with late Huntington's Disease (HD). Eligible subjects are men and women between 21 and 65 years of age.

Inclusion Criteria: Eligible subjects are men and women between 21 and 65 years of age. Subjects that (1) sign and date International Classification of Functioning, Disability and Health (ICF); (2) male or female participant aged ≥21 and ≤65; (3) participants who submit medical report (PCR) attesting Huntington's disease with a number of CAG repeats on chromosome 4, greater than or equal to 40 and less than or equal to 50 (if the participant has not performed the examination and/or if he does not have the report available, a new exam should be done); (4) Score 5 points or more in motor assessment UHDRS scale (Unified Huntington's Disease Rating Scale) at the time of enrollment; (5) Score between 8 and 11 points in the functional capacity of the UHDRS scale at the time of enrollment.

Exclusion Criteria: (1) Any medical observation data (clinical and physical) that medical research judge as a risk for subject if enrollment at the study; (2) any laboratory exam data that medical research judge as a risk for subject if enrollment at the study; (3) history of epilepsy; (4)

diagnostic of major cognitive impairment; (5) active decompensated psychiatric disease; (6) current or prior history of neoplasia; (7) current history of gastrointestinal, hepatic, renal, endocrine, pulmonary, hematologic, immune, metabolic pathology or severe and uncontrolled cardiovascular disease; (8) diagnostic of any active infection, be it viral, bacterial, fungal, or caused by another pathogen; (9) participants who have contraindication to undergo any of the tests performed in this study, for example, have pacemakers or surgical clip; (10) history of alcohol or illegal drugs abusers; (11) history of 1 or more episodes of suicide in the two years before Visit V-4; (12) active smoker or have stopped smoking less than six months prior to enrollment; (13) test positive in at least one of the serological tests: HIV 1 and 2 (Anti-HIV-1,2), HTLV I and II, HBV (HBsAg, anti-HBc), HCV (anti-HCV-Ab) and VDRL (*Treponema pallidum*); (14) history of drug allergy, including contrasts for imaging, or bovine products; (15) in use or expected use of immunosuppressive drugs or prohibited medicines for the first three months after the first administration of the investigational product; (16) any clinical changes that is interpreted by the medical researcher as a risk to participant's enrollment.

Experimental:

Placebo. One-time injection of placebo at Week 0.

Test High Dose. One-time injection of test composition $2\times10^{10}$ vg at Week 0.

Test Middle Dose. One-time injection of test composition $6\times10^{9}$ vg at Week 0.

Test Low Dose. One-time injection of test composition $2\times10^{9}$ vg at Week 0.

Test Lowest Dose. One-time injection of test composition $2\times10^{8}$ vg at Week 0.

Primary Outcome Measures: Safety of the test composition by periodic monitoring changes at adverse events, vital signs, laboratory tests, ECG and incidence of benign and malignant neoplasms [Time Frame: five years]. The safety of the investigational product will be evaluated in detail from periodic evaluations contemplating monitoring changes of: (1) adverse events including type, frequency, intensity, seriousness, severity, and action taken related to the investigational product study; (2) vital signs (BP, HR, axillary temperature), physical and medical examination (BMI, weight, height, medical condition—cardiovascular, pulmonary, digestive, musculoskeletal and peripheral, with emphasis on the neurological assessment and others); (3) laboratory tests included hematologic, biochemical, urologic and serological analysis; (4) electrocardiogram (ECG) of 12 derivations; (5) and incidence and classification of benign and malignant neoplasms in the following organs/systems: CNS, lung, liver, spleen, pancreas, prostate, testicle, urinary, hematological and skeletal system through the laboratory tests, magnetic resonance imaging, computerized tomography and ultrasonography.

Secondary Outcome Measures: Preliminary efficacy of Cellavita HD by global clinical response (CIBIS) and UHDRS improvement [Time Frame: five years] will be evaluated by statistical comparison of the results of each UHDRS scale component: motor, cognitive and behavior. The global clinical response will be assessed by statistical comparison between baseline score observed by the Investigator before and after Cellavita HD treatment. Preliminary efficacy of Cellavita HD by comparison of the inflammatory markers [Time Frame: one year] will be evaluated by statistical comparison of the inflammatory markers included IL-4, IL-6, IL-10 (interleukin IL) and TNF-alpha (tumoral necrosis factor alpha). Immunological Response of Cellavita HD [Time Frame: one year]. The immunological response induced by Cellavita HD will be evaluated by statistical comparison between baseline results of CD4+ and CD8+ proliferation and the other evaluated times. Preliminary efficacy of Cellavita HD by comparison of the CNS assessment [Time Frame: one year]. Will be evaluated by statistical comparison of the CNS assessment through magnetic resonance image at cortical thickness measurements, volumes of different brain structures, especially the basal ganglia, with special attention to caudate and metabolic changes identified in proton spectroscopy. Risk of suicidal ideation by Hamilton Depression Rating Scale (HDRS) [Time Frame: five years] will be evaluated by suicidal domain. The classificatory punctuation may correspond to mild depression (score: 8 to 13), moderate depression (score: 19-22) and severe depression (score: >23).

While preferred embodiments of the present examples have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein may be employed in practicing the disclosure. It is intended that the following claims define the scope of the disclosure and that methods and structures within the scope of these claims and their equivalents be covered thereby.

SEQUENCE LISTING (46429 sequences)

SEQ ID NO: 1 - protein, 736 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSKTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 2 - protein, 724 aa, Artificial Sequence
  Description of Artificial Sequence: Synthetic polypeptide
MSFVDHPPDWLEEVGEGLREFLGLEAGPPKPKPNQQHQDQARGLVLPGYNYLGPGNGLDRGEPVNRADEVAREHDISYNEQLEAGDNPYLKYNHADAEFQEKLADDTSFGGNLGKAVFQAKKRVLEPFGLVEEGAKTAPTGKRIDDHFPKRKKARTEEDSKPSTSSDAEAGPSGSQQLQIPAQPASSLGADTMSAGGGGPLGDNNQGADGVGNASGDWHCDSTWMGDRVVTKSTRTWVLPSYNNHQYREIKSGSVDGSNANAYFGYSTPWGYFDFNRFHSHWSPRDWQRLINNYWGFRPRSLRVKIFNIQVKEVTVQDSTTTIANNLTSTVQVFTDDDYQLPYVVGNGTEGCLPAFPPQVFTLPQYGYATLNRDNTENPTERSSFFCLEYFPSKMLRTGNNFEFTYNFEEVPFHSSFAPSQNLFKLANPLVDQYLYRFVSTNNTGGVQFNKNLAGRYANTYKNWFPGPMGRTQGWNLGSGVNRASVSAFATTNRMELEGASYQVPPQPNGMTNNLQGSNTYALENTMIFNSQPANPGTTATYLEGNMLITSESETQPVNRVAYNVGGQMATNNQSSTTAPATGTYNLQEIVPGSVWMERDVYLQGPIWAKIPETGAHFHPSPAMGGFGLKHPPPMMLIKNTPVPGNITSFSDVPVSSFITQYSTGQVTVEMEWELKKENSKRWNPEIQYTNNYNDPQFVDFAPDSTGEYRTTRPIGTRYLTRPL

SEQ ID NO: 3 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 4 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSAQQAVRTSLAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 5 - protein, 743 aa, Artificial Sequence
  Description of Artificial Sequence: Synthetic polypeptide
MAADGYLPDWLEDNLSEGIREWWALKPGAPQPKANQQHQDNARGLVLPGYKYLGPGNGLDKGEPVNAADAAALEHDKAYDQQLKAGDNPYLKYNHADAEFQERLKEDTSFGGNLGRAVFQAKKRLLEPLGLVEEAAKTAPGKKRPVEQSPQEPDSSAGIGKSGAQPAKKRLNFGQTGDTESVPDPQPIGEPPAAPSGVGSLTMASGGGAPVADNNEGADGVGSSSGNWHCDSQWLGDRVITTSTRTWALPTYNNHLYKQISNSTSGGSSNDNAYFGYSTPWGYFDFNRFHCHFSPRDWQRLINNNWGFRPKRLNFKLFNIQVKEVTDNNGVKTIANNLTSTVQVFTDSDYQLPYVLGSAHEGCLPPFPADVFMIPQYGYLTLNDGSQAVGRSSFYCLEYFPSQMLRTGNNFQFSYEFENVPFHSSYAHSQSLDRLMNPLIDQYLYYLSRTINGSGQNQQTLKFSVAGPSNMAVQGRNYIPGPSYRQQRVSTTVTQNNNSEFAWPGASSWALNGRNSLMNPGPAMASHKEGEDRFFPLSGSLIFGKQGTGRDNVDADKVMITNEEEIKTTNPVATESYGQVATNHQSDGTLAVPFKAQAQTGWVQNQGILPGMVWQDRDVYLQGPIWAKIPHTDGNFHPSPLMGGFGMKHPPPQILIKNTPVPADPPTAFNKDKLNSFITQYSTGQVSVEIEWELQKENSKRWNPEIQYTSNYYKSNNVEFAVNTEGVYSEPRPIGTRYLTRNL

SEQ ID NO: 6 - DNA, 2211 bp, Adeno-associated virus 9
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaagcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 7 - DNA, 4404 bp, Adeno-associated virus - 5
cgcgacaggggggagagtgccacactctcaagcaagggggttttgtaagcagtgatgtcataatgatgtaatgcttattgtcacgcgatagttaatgattaacagtcatgtgatgtgttttatccaataggaagaaagcgcgcgtatgagttctcgcgagacttccggggtataaaagaccgagtgaacgagcccgccgccattctttgctctggactgctagaggaccctcgctgccatggctaccttctatgaagtcattgttcgcgtcccatttgacgtggaggaacatctgcctggaatttctgacagctttgtggactgggtaactggtcaaatttgggagctgcctccagagtcagatttaaatttgactctggttgaacagcctcagttgacggtggctgatagaattcgccgcgtgttcctgtacgagtggaacaaattttccaagcaggagtccaaattctttgtgcagtttgaaaagggatctgaatattttcatctgcacacgcttgtggagacctccggcatctcttccatggtcctcggccgctacgtgagtcagattcgcgcccagctggtgaaagtggtcttccagggaattgaaccccagatcaacgactgggtcgccatcaccaaggtaaagaagggcggagccaataaggtggtggattctgggtatattcccgcctacctgctgccgaaggtccaaccggagcttcagtgggcgtggacaaacctggacgagtataaattggccgccctgaatctggaggagcgcaaacggctcgtcgcgcagtttctggcagaatcctcgcagcgctcgcaggaggcggcttcgcagcgtgagttctcggctgacccggtcatcaaaagcaagacttcccagaaatacatggcgctcgtcaactggctcgtggagcacggcatcacttccgagaagcagtggatccaggaaaatcaggagagctacctctccttcaactccaccggcaactctcggagccagatcaaggccgcgctcgacaacgcgaccaaaattatgagtctgacaaaaagcgcggtggactacctcgtggggagctccgttcccgaggacatttcaaaaaacagaatctggcaaatttttgagatgaatggctacgacccggcctacgcgggatccatcctctacggctggtgtcagcgctccttcaacaagaggaacaccgtctggctctacggacccgccacgaccggcaagaccaacatcgcggaggccatcgcccacactgtgcccttttacggctgcgtgaactggaccaatgaaaactttccctttaatgactgtgtggacaaaatgctcatttggtgggaggagggaaagatgaccaacaaggtggttgaatccgccaaggccatcctggggggctcaaaggtgcgggtcgatcagaaatgtaaatcctctgttcaaattgattctacccctgtcattgtaacttccaatacaaacatgtgtgtggtggtggatgggaattccacgacctttgaacaccagcagccgctggaggaccgcatgttcaaatttgaactgactaagcggctcccgccagattttggcaagattactaagcaggaagtcaaggacttttttgcttgggcaaaggtcaatcaggtgccggtgactcacgagtttaaagttcccagggaattggcgggaactaaaggggcggagaaatctctaaaacgcccactgggtgacgtcaccaatactagctataaaagtctggagaagcgggccaggctctcatttgttcccgagacgcctcgcagttcagacgtgactgttgatcccgctcctctgcgaccgctcaattggaattcaaggtatgattgcaaatgtgactatcatgctcaatttgacaacatttctaacaaatgtgatgaatgtgaatatttgaatcggggcaaaaatggatgtatctgtcacaatgtaactcactgtcaaatttgtcatgggattcccccctgggaaaaggaaaacttgtcagattttggggattttgacgatgccaataaagaacagtaaataaagcgagtagtcatgtcttttgttgatcaccctccagattggttggaagaagttggtgaaggtcttcgcgagtttttgggccttgaagcgggcccaccgaaaccaaaacccaatcagcagcatcaagatcaagcccgtggtcttgtgctgcctggttataactatctcggacccggaaacggtctcgatcgaggagagcctgtcaacagggcagacgaggtcgcgcgagagcacgacatctcgtacaacgagcagcttgaggcgggagacaacccctacctcaagtacaaccacgcggacgccgagtttcaggagaagctcgccgacgacacatccttcgggggaaacctcggaaaggcagtctttcaggccaagaaaagggttctcgaaccttttggcctggttgaagagggtgctaagacggcccctaccggaaagcggatagacgaccactttccaaaaagaaagaaggctcggaccgaagaggactccaagccttccacctcgtcagacgccgaagctggacccagcggatcccagcagctgcaaatcccagcccaaccagcctcaagtttgggagctgatacaatgtctgcgggaggtggcggcccattgggcgacaataaccaaggtgccgatggagtgggcaatgcctcgggagattggcattgcgattccacgtggatgggggacagagtcgtcaccaagtccacccgaacctgggtgctgcccagctacaacaaccaccagtaccgagagatcaaaagcggctccgtcgacggaagcaacgccaacgcctactttggatacagcaccccctgggggtactttgactttaaccgcttccacagccactggagcccccgagactggcaaagactcatcaacaactactggggcttcagaccccggtccctcagagtcaaaatcttcaacattcaagtcaaagaggtcacggtgcaggactccaccaccaccatcgccaacaacctcacctccaccgtccaagtgtttacggacgacgactaccagctgccctacgtcgtcggcaacgggaccgagggatgcctgccggccttccctccgcaggtctttacgctgccgcagtacggttacgcgacgctgaaccgcgacaacacagaaaatcccaccgagaggagcagcttcttctgcctagagtactttcccagcaagatgctgagaacgggcaacaactttgagtttacctacaactttgaggaggtgcccttccactccagcttcgctcccagtcagaacctcttcaagctggccaacccgctggtggaccagtacttgtaccgcttcgtgagcacaaataacactggcggagtccagttcaacaagaacctggccgggagatacgccaacacctacaaaaactggttcccggggcccatgggccgaacccagggctggaacctgggctccggggtcaaccgcgccagtgtcagcgccttcgccacgaccaataggatggagctcgagggcgcgagttaccaggtgcccccgcagccgaacggcatgaccaacaacctccagggcagcaacacctatgccctggagaacactatgatcttcaacagccagccggcgaacccgggcaccaccgccacgtacctcgagggcaacatgctcatcaccagcgagagcgagacgcagccggtgaaccgcgtggcgtacaacgtcggcgggcagatggccaccaacaaccagagctccaccactgcccccgcgaccggcacgtacaacctccaggaaatcgtgcccggcagcgtgtggatggagagggacgtgtacctccaaggacccatctgggccaagatcccagagacgggggcgcactttcacccctctccggccatgggcggattcggactcaaacacccaccgcccatgatgctcatcaagaacacgcctgtgcccggaaatatcaccagcttctcggacgtgcccgtcagcagcttcatcacccagtacagcaccgggcaggtcaccgtggagatggagtgggagctcaagaaggaaaactccaagaggtggaacccagagatccagtacacaaacaactacaacgacccccagtttgtggactttgccccggacagcaccggggaatacagaaccaccagacctatcggaacccgataccttacccgacccctttaacccattcatgtcgcataccctcaataaaccgtgtattcgtgtcagtaaaatactgcctcttgtggtcattcaatgaataacagcttacaacatctacaaaacctccttgcttgagagtgtggcactctcccccctgtcgcgcg

SEQ ID NO: 8 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgcccaaactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 9 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctcaaagactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggaactggaagagacaacgtggatgcggacaaagtcatgataaccaacgaagaagaaattaaaactactaacccggtagcaacggagtcctatggacaagtggccacaaaccaccagagtgcccaacaggcggttaggacgtctttggcacaggcgcagaccggctgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 10 - DNA, 2232 bp, Artificial Sequence
  Description of Artificial Sequence: Synthetic polynucleotide
atggctgccgatggttatcttccagattggctcgaggacaaccttagtgaaggaattcgcgagtggtgggctttgaaacctggagcccctcaacccaaggcaaatcaacaacatcaagacaacgctcgaggtcttgtgcttccgggttacaaataccttggacccggcaacggactcgacaagggggagccggtcaacgcagcagacgcggcggccctcgagcacgacaaggcctacgaccagcagctcaaggccggagacaacccgtacctcaagtacaaccacgccgacgccgagttccaggagcggctcaaagaagatacgtcttttgggggcaacctcgggcgagcagtcttccaggccaaaaagaggcttcttgaacctcttggtctggttgaggaagcggctaagacggctcctggaaagaagaggcctgtagagcagtctcctcaggaaccggactcctccgcgggtattggcaaatcgggtgcacagcccgctaaaaagagactcaatttcggtcagactggcgacacagagtcagtcccagaccctcaaccaatcggagaacctcccgcagccccctcaggtgtgggatctcttacaatggcttcaggtggtggcgcaccagtggcagacaataacgaaggtgccgatggagtgggtagttcctcgggaaattggcattgcgattcccaatggctgggggacagagtcatcaccaccagcacccgaacctgggccctgcccacctacaacaatcacctctacaagcaaatctccaacagcacatctggaggatcttcaaatgacaacgcctacttcggctacagcaccccctgggggtattttgacttcaacagattccactgccacttctcaccacgtgactggcagcgactcatcaacaacaactggggattccggcctaagcgactcaacttcaagctcttcaacattcaggtcaaagaggttacggacaacaatggagtcaagaccatcgccaataaccttaccagcacggtccaggtcttcacggactcagactatcagctcccgtacgtgctcgggtcggctcacgagggctgcctcccgccgttcccagcggacgttttcatgattcctcagtacgggtatctgacgcttaatgatggaagccaggccgtgggtcgttcgtccttttactgcctggaatatttcccgtcgcaaatgctaagaacgggtaacaacttccagttcagctacgagtttgagaacgtacctttccatagcagctacgctcacagccaaagcctggaccgactaatgaatccactcatcgaccaatacttgtactatctctctagaactattaacggttctggacagaatcaacaaacgctaaaattcagtgtggccggacccagcaacatggctgtccagggaagaaactacatacctggacccagctaccgacaacaacgtgtctcaaccactgtgactcaaaacaacaacagcgaatttgcttggcctggagcttcttcttgggctctcaatggacgtaatagcttgatgaatcctggacctgctatggccagccacaaagaaggagaggaccgtttctttcctttgtctggatctttaatttttggcaaacaaggtaccggcagagacaacgtggatgcggacaaagtcatgataaccaacgaagaagaaattaaaactactaacccggtagcaacggagtcctatggacaagtggccacaaaccaccagagtgatgggactttggcggtgccttttaaggcacaggcgcagaccggttgggttcaaaaccaaggaatacttccgggtatggtttggcaggacagagatgtgtacctgcaaggacccatttgggccaaaattcctcacacggacggcaactttcacccttctccgctgatgggagggtttggaatgaagcacccgcctcctcagatcctcatcaaaaacacacctgtacctgcggatcctccaacggccttcaacaaggacaagctgaactctttcatcacccagtattctactggccaagtcagcgtggagatcgagtgggagctgcagaaggaaaacagcaagcgctggaacccggagatccagtacacttccaactattacaagtctaataatgttgaatttgctgttaatactgaaggtgtatatagtgaaccccgccccattggcaccagatacctgactcgtaatctgtaa

SEQ ID NO: 11 - protein, 7 aa, Artificial Sequence
  Description of Artificial Sequence: Synthetic peptide
SGLKGTG

SEQ ID NO: 12 - protein, 7 aa, Artificial Sequence
  Description of Artificial Sequence: Synthetic peptide
VGGTQGK

SEQ ID NO: 13 - protein, 7 aa, Artificial Sequence
  Description of Artificial Sequence: Synthetic peptide
SMDSRPG

SEQ ID NO: 14 - protein, 7 aa, Artificial Sequence
  Description of Artificial Sequence: Synthetic peptide
GSSPSKA

SEQ ID NO: 15 - protein, 7 aa, Artificial Sequence
  Description of Artificial Sequence: Synthetic peptide
TGTANPL

SEQ ID NO: 16 - protein, 7 aa, Artificial Sequence
  Description of Artificial Sequence: Synthetic peptide
SQGAKPV

SEQ ID NO: 17 - protein, 7 aa, Artificial Sequence
  Description of Artificial Sequence: Synthetic peptide
QGEKNTM

SEQ ID NO: 18 - protein, 7 aa, Artificial Sequence
  Description of Artificial Sequence: Synthetic peptide
TSGNSSK

SEQ ID NO: 19 - protein, 7 aa, Artificial Sequence
  Description of Artificial Sequence: Synthetic peptide
TTSKPGT

SEQ ID NO: 20 - protein, 7 aa, Artificial Sequence
  Description of Artificial Sequence: Synthetic peptide
SQGKGGS

SEQ ID NO: 21 - protein, 7 aa, Artificial Sequence
  Description of Artificial Sequence: Synthetic peptide
GSIKGEA

SEQ ID NO: 22 - protein, 7 aa, Artificial Sequence
  Description of Artificial Sequence: Synthetic peptide
NSGTTGN

SEQ ID NO: 23 - protein, 7 aa, Artificial Sequence
  Description of Artificial Sequence: Synthetic peptide
ERTKETL

SEQ ID NO: 24 - protein, 7 aa, Artificial Sequence
  Description of Artificial Sequence: Synthetic peptide
DHGKGNQ

SEQ ID NO: 25 - protein, 7 aa, Artificial Sequence
  Description of Artificial Sequence: Synthetic peptide
DGQQRSS

SEQ ID NO: 26 - protein, 7 aa, Artificial Sequence
  Description of Artificial Sequence: Synthetic peptide
SGNSTNK

SEQ ID NO: 27 - protein, 7 aa, Artificial Sequence
  Description of Artificial Sequence: Synthetic peptide
GVEQRSG

SEQ ID NO: 28 - protein, 7 aa, Artificial Sequence
  Description of Artificial Sequence: Synthetic peptide
NGGKSSS

SEQ ID NO: 29 - protein, 7 aa, Artificial Sequence
  Description of Artificial Sequence: Synthetic peptide
STNKSNL

SEQ ID NO: 30 - protein, 7 aa, Artificial Sequence
  Description of Artificial Sequence: Synthetic peptide
DGQGNGK

SEQ ID NO: 31 - protein, 7 aa, Artificial Sequence
  Description of Artificial Sequence: Synthetic peptide
GEGKGQS

SEQ ID NO: 32 - protein, 7 aa, Artificial Sequence
  Description of Artificial Sequence: Synthetic peptide
GVNSSGR

SEQ ID NO: 33 - protein, 7 aa, Artificial Sequence
  Description of Artificial Sequence: Synthetic peptide
DTGTPIK

SEQ ID NO: 34 - protein, 7 aa, Artificial Sequence
  Description of Artificial Sequence: Synthetic peptide
GSSGSMK

SEQ ID NO: 35 - protein, 7 aa, Artificial Sequence
  Description of Artificial Sequence: Synthetic peptide
GNSSKQF

SEQ ID NO: 36 - protein, 7 aa, Artificial Sequence
  Description of Artificial Sequence: Synthetic peptide
ETGNKGG

SEQ ID NO: 37 - protein, 7 aa, Artificial Sequence
  Description of Artificial Sequence: Synthetic peptide
SGVEKQA

SEQ ID NO: 38 - protein, 7 aa, Artificial Sequence
  Description of Artificial Sequence: Synthetic peptide
DNLGQSK

SEQ ID NO: 39 - protein, 7 aa, Artificial Sequence
  Description of Artificial Sequence: Synthetic peptide
LGTQSAK

SEQ ID NO: 40 - protein, 7 aa, Artificial Sequence
  Description of Artificial Sequence: Synthetic peptide
NGDNSTR

SEQ ID NO: 41 - protein, 7 aa, Artificial Sequence
  Description of Artificial Sequence: Synthetic peptide
TTGSPSQ

SEQ ID NO: 42 - protein, 7 aa, Artificial Sequence
  Description of Artificial Sequence: Synthetic peptide
NSSGTPS

SEQ ID NO: 43 - protein, 7 aa, Artificial Sequence
  Description of Artificial Sequence: Synthetic peptide
SASSTPH

SEQ ID NO: 44 - protein, 7 aa, Artificial Sequence
  Description of Artificial Sequence: Synthetic peptide
GQGNGLS

SEQ ID NO: 45 - protein, 7 aa, Artificial Sequence
  Description of Artificial Sequence: Synthetic peptide
GTGKSQA

SEQ ID NO: 46 - protein, 7 aa, Artificial Sequence
  Description of Artificial Sequence: Synthetic peptide
SDNKSQH

SEQ ID NO: 47 - protein, 7 aa, Artificial Sequence
  Description of Artificial Sequence: Synthetic peptide
GVVQGAR

SEQ ID NO: 48 - protein, 7 aa, Artificial Sequence
  Description of Artificial Sequence: Synthetic peptide
DGGQARS

SEQ ID NO: 49 - protein, 7 aa, Artificial Sequence
  Description of Artificial Sequence: Synthetic peptide
NGAQKVN

SEQ ID NO: 50 - protein, 7 aa, Artificial Sequence
  Description of Artificial Sequence: Synthetic peptide
TSDSKTT

SEQ ID NO: 51 - protein, 7 aa, Artificial Sequence
  Description of Artificial Sequence: Synthetic peptide
GYNKDSG

SEQ ID NO: 52 - protein, 7 aa, Artificial Sequence
  Description of Artificial Sequence: Synthetic peptide
GGVGAAG

SEQ ID NO: 53 - protein, 7 aa, Artificial Sequence
  Description of Artificial Sequence: Synthetic peptide
NVSHNGG

SEQ ID NO: 54 - protein, 7 aa, Artificial Sequence
  Description of Artificial Sequence: Synthetic peptide
SSTGTNH

SEQ ID NO: 55 - protein, 7 aa, Artificial Sequence
  Description of Artificial Sequence: Synthetic peptide
GTGKDRV

SEQ ID NO: 56 - protein, 7 aa, Artificial Sequence
  Description of Artificial Sequence: Synthetic peptide
DGNMANK

SEQ ID NO: 57 - protein, 7 aa, Artificial Sequence
  Description of Artificial Sequence: Synthetic peptide
TLNNKGL

SEQ ID NO: 58 - protein, 7 aa, Artificial Sequence
  Description of Artificial Sequence: Synthetic peptide
TDASKVS

SEQ ID NO: 59 - protein, 7 aa, Artificial Sequence
  Description of Artificial Sequence: Synthetic peptide
NTGKNGL

SEQ ID NO: 60 - protein, 7 aa, Artificial Sequence
  Description of Artificial Sequence: Synthetic peptide
SGTSKNV

SEQ ID NO: 61 - protein, 7 aa, Artificial Sequence
  Description of Artificial Sequence: Synthetic peptide
DHASTNK

SEQ ID NO: 62 - protein, 7 aa, Artificial Sequence
  Description of Artificial Sequence: Synthetic peptide
GNSSTPK

SEQ ID NO: 63 - protein, 7 aa, Artificial Sequence
  Description of Artificial Sequence: Synthetic peptide
TESQKIV

SEQ ID NO: 64 - protein, 7 aa, Artificial Sequence
  Description of Artificial Sequence: Synthetic peptide
EGGKGPA

SEQ ID NO: 65 - protein, 7 aa, Artificial Sequence
  Description of Artificial Sequence: Synthetic peptide
GNGSKAV

SEQ ID NO: 66 - protein, 7 aa, Artificial Sequence
  Description of Artificial Sequence: Synthetic peptide
TGQSSTS

SEQ ID NO: 67 - protein, 7 aa, Artificial Sequence
  Description of Artificial Sequence: Synthetic peptide
AGSKTSA

SEQ ID NO: 68 - protein, 7 aa, Artificial Sequence
  Description of Artificial Sequence: Synthetic peptide
SNRDKAS

SEQ ID NO: 69 - protein, 7 aa, Artificial Sequence
  Description of Artificial Sequence: Synthetic peptide
GSGNQTG

SEQ ID NO: 70 - protein, 7 aa, Artificial Sequence
  Description of Artificial Sequence: Synthetic peptide
GTGSKPY

SEQ ID NO: 71 - protein, 7 aa, Artificial Sequence
  Description of Artificial Sequence: Synthetic peptide
SASGKNT

SEQ ID NO: 72 - protein, 7 aa, Artificial Sequence
  Description of Artificial Sequence: Synthetic peptide
LGDGKPV

SEQ ID NO: 73 - protein, 7 aa, Artificial Sequence
  Description of Artificial Sequence: Synthetic peptide
SGVTGVA

SEQ ID NO: 74 - protein, 7 aa, Artificial Sequence
  Description of Artificial Sequence: Synthetic peptide
ERSSPTS

SEQ ID NO: 75 - protein, 7 aa, Artificial Sequence
  Description of Artificial Sequence: Synthetic peptide
DGTTRST

SEQ ID NO: 76 - protein, 7 aa, Artificial Sequence
  Description of Artificial Sequence: Synthetic peptide
TTNKGAS

SEQ ID NO: 77 - protein, 7 aa, Artificial Sequence
  Description of Artificial Sequence: Synthetic peptide
AGSGNTS

SEQ ID NO: 78 - protein, 7 aa, Artificial Sequence
  Description of Artificial Sequence: Synthetic peptide
QAGNGSK

SEQ ID NO: 79 - protein, 7 aa, Artificial Sequence
  Description of Artificial Sequence: Synthetic peptide
QQGKQSV

SEQ ID NO: 80 - protein, 7 aa, Artificial Sequence
  Description of Artificial Sequence: Synthetic peptide
TNGSKPL

SEQ ID NO: 81 - protein, 7 aa, Artificial Sequence
  Description of Artificial Sequence: Synthetic peptide
TDRSKSP

SEQ ID NO: 82 - protein, 7 aa, Artificial Sequence
  Description of Artificial Sequence: Synthetic peptide
DRTEKSN

SEQ ID NO: 83 - protein, 7 aa, Artificial Sequence
  Description of Artificial Sequence: Synthetic peptide
GGGQKSS

SEQ ID NO: 84 - protein, 7 aa, Artificial Sequence
  Description of Artificial Sequence: Synthetic peptide
STNSKSA

SEQ ID NO: 85 - protein, 7 aa, Artificial Sequence
  Description of Artificial Sequence: Synthetic peptide
SNTKSAG

SEQ ID NO: 86 - protein, 7 aa, Artificial Sequence
  Description of Artificial Sequence: Synthetic peptide
QGTNATV

SEQ ID NO: 87 - protein, 7 aa, Artificial Sequence
  Description of Artificial Sequence: Synthetic peptide
NTTRESG

SEQ ID NO: 88 - protein, 7 aa, Artificial Sequence
  Description of Artificial Sequence: Synthetic peptide
GSGKTAA

SEQ ID NO: 89 - protein, 7 aa, Artificial Sequence
  Description of Artificial Sequence: Synthetic peptide
GSQSPSS

SEQ ID NO: 90 - protein, 7 aa, Artificial Sequence
  Description of Artificial Sequence: Synthetic peptide
DQHSARN

SEQ ID NO: 91 - protein, 7 aa, Artificial Sequence
  Description of Artificial Sequence: Synthetic peptide
QATTKPS

SEQ ID NO: 92 - protein, 7 aa, Artificial Sequence
  Description of Artificial Sequence: Synthetic peptide
TTGSAAV

SEQ ID NO: 93 - protein, 7 aa, Artificial Sequence
  Description of Artificial Sequence: Synthetic peptide
TTTKANA

SEQ ID NO: 94 - protein, 7 aa, Artificial Sequence
  Description of Artificial Sequence: Synthetic peptide
SQSQTNS

SEQ ID NO: 95 - protein, 7 aa, Artificial Sequence
  Description of Artificial Sequence: Synthetic peptide
QTSEAGR

SEQ ID NO: 96 - protein, 7 aa, Artificial Sequence
  Description of Artificial Sequence: Synthetic peptide
SSQQSAK

SEQ ID NO: 97 - protein, 7 aa, Artificial Sequence
  Description of Artificial Sequence: Synthetic peptide
GNGKTLQ

SEQ ID NO: 98 - protein, 7 aa, Artificial Sequence
  Description of Artificial Sequence: Synthetic peptide
GIPKGSQ

SEQ ID NO: 99 - protein, 7 aa, Artificial Sequence
  Description of Artificial Sequence: Synthetic peptide
GTGGSAQ

SEQ ID NO: 100 - protein, 7 aa, Artificial Sequence
  Description of Artificial Sequence: Synthetic peptide
SASQKVQ

SEQ ID NO: 101 - protein, 7 aa, Artificial Sequence
  Description of Artificial Sequence: Synthetic peptide
GSGHDRT

SEQ ID NO: 102 - protein, 7 aa, Artificial Sequence
  Description of Artificial Sequence: Synthetic peptide
ATDKSSK

SEQ ID NO: 103 - protein, 7 aa, Artificial Sequence
  Description of Artificial Sequence: Synthetic peptide
ERGESQK

SEQ ID NO: 104 - protein, 7 aa, Artificial Sequence
  Description of Artificial Sequence: Synthetic peptide
DNTASPR

SEQ ID NO: 105 - protein, 7 aa, Artificial Sequence
  Description of Artificial Sequence: Synthetic peptide
AAGAPGK

SEQ ID NO: 106 - protein, 7 aa, Artificial Sequence
  Description of Artificial Sequence: Synthetic peptide
MTSSSAK

SEQ ID NO: 107 - protein, 7 aa, Artificial Sequence
  Description of Artificial Sequence: Synthetic peptide
TQSSPPK

SEQ ID NO: 108 - protein, 7 aa, Artificial Sequence
  Description of Artificial Sequence: Synthetic peptide
DGSTANR

SEQ ID NO: 109 - protein, 7 aa, Artificial Sequence
  Description of Artificial Sequence: Synthetic peptide
QGSATTL

SEQ ID NO: 110 - protein, 7 aa, Artificial Sequence
  Description of Artificial Sequence: Synthetic peptide
QNGSDRT

SEQ ID NO: 111 - protein, 7 aa, Artificial Sequence
  Description of Artificial Sequence: Synthetic peptide
NSASNAK

SEQ ID NO: 112 - protein, 7 aa, Artificial Sequence
  Description of Artificial Sequence: Synthetic peptide
QTSKTAS

SEQ ID NO: 113 - protein, 7 aa, Artificial Sequence
  Description of Artificial Sequence: Synthetic peptide
QNGNGHR

SEQ ID NO: 114 - protein, 7 aa, Artificial Sequence
  Description of Artificial Sequence: Synthetic peptide
GSGTSAV

SEQ ID NO: 115 - protein, 7 aa, Artificial Sequence
  Description of Artificial Sequence: Synthetic peptide
GNTPSSV

SEQ ID NO: 116 - protein, 7 aa, Artificial Sequence
  Description of Artificial Sequence: Synthetic peptide
GTQKENT

SEQ ID NO: 117 - protein, 7 aa, Artificial Sequence
  Description of Artificial Sequence: Synthetic peptide
ARDSSVL

SEQ ID NO: 118 - protein, 7 aa, Artificial Sequence
  Description of Artificial Sequence: Synthetic peptide
EGNSNHT

SEQ ID NO: 119 - protein, 7 aa, Artificial Sequence
  Description of Artificial Sequence: Synthetic peptide
GTGSKPS

SEQ ID NO: 120 - protein, 7 aa, Artificial Sequence
  Description of Artificial Sequence: Synthetic peptide
ATGSTNN

SEQ ID NO: 121 - protein, 7 aa, Artificial Sequence
  Description of Artificial Sequence: Synthetic peptide
GGSRPSE

SEQ ID NO: 122 - protein, 7 aa, Artificial Sequence
  Description of Artificial Sequence: Synthetic peptide
LGSKTSA

SEQ ID NO: 123 - protein, 7 aa, Artificial Sequence
  Description of Artificial Sequence: Synthetic peptide
GQNSKPA

SEQ ID NO: 124 - protein, 7 aa, Artificial Sequence
  Description of Artificial Sequence: Synthetic peptide
STNTKST

SEQ ID NO: 125 - protein, 7 aa, Artificial Sequence
  Description of Artificial Sequence: Synthetic peptide
QGTSNGS

SEQ ID NO: 126 - protein, 7 aa, Artificial Sequence
  Description of Artificial Sequence: Synthetic peptide
QANDKMG

SEQ ID NO: 127 - protein, 7 aa, Artificial Sequence
  Description of Artificial Sequence: Synthetic peptide
RNGNEVK

SEQ ID NO: 128 - protein, 7 aa, Artificial Sequence
  Description of Artificial Sequence: Synthetic peptide
SAPGSSK

SEQ ID NO: 129 - protein, 7 aa, Artificial Sequence
  Description of Artificial Sequence: Synthetic peptide
TASSKHE

SEQ ID NO: 130 - protein, 7 aa, Artificial Sequence
  Description of Artificial Sequence: Synthetic peptide
GGGDKSK

SEQ ID NO: 131 - protein, 7 aa, Artificial Sequence
  Description of Artificial Sequence: Synthetic peptide
SGGAHPS

SEQ ID NO: 132 - protein, 7 aa, Artificial Sequence
  Description of Artificial Sequence: Synthetic peptide
TSGTNNV

SEQ ID NO: 133 - protein, 7 aa, Artificial Sequence
  Description of Artificial Sequence: Synthetic peptide
STASTPS

SEQ ID NO: 134 - protein, 7 aa, Artificial Sequence
  Description of Artificial Sequence: Synthetic peptide
QGTGSTT

SEQ ID NO: 135 - protein, 7 aa, Artificial Sequence
  Description of Artificial Sequence: Synthetic peptide
QGGGSPT

SEQ ID NO: 136 - protein, 7 aa, Artificial Sequence
  Description of Artificial Sequence: Synthetic peptide
EAGSKSQ

SEQ ID NO: 137 - protein, 7 aa, Artificial Sequence
  Description of Artificial Sequence: Synthetic peptide
GGNGKDR

SEQ ID NO: 138 - protein, 7 aa, Artificial Sequence
  Description of Artificial Sequence: Synthetic peptide
VSGNGNS

SEQ ID NO: 139 - protein, 7 aa, Artificial Sequence
  Description of Artificial Sequence: Synthetic peptide
GQGKDKS

SEQ ID NO: 140 - protein, 7 aa, Artificial Sequence
  Description of Artificial Sequence: Synthetic peptide
TSSSPHT

SEQ ID NO: 141 - protein, 7 aa, Artificial Sequence
  Description of Artificial Sequence: Synthetic peptide
DSSSSNR

SEQ ID NO: 142 - protein, 7 aa, Artificial Sequence
  Description of Artificial Sequence: Synthetic peptide
DGQKGAS

SEQ ID NO: 143 - protein, 7 aa, Artificial Sequence
  Description of Artificial Sequence: Synthetic peptide
SQTKSSN

SEQ ID NO: 144 - protein, 7 aa, Artificial Sequence
  Description of Artificial Sequence: Synthetic peptide
SSTGKSV

SEQ ID NO: 145 - protein, 7 aa, Artificial Sequence
  Description of Artificial Sequence: Synthetic peptide
TTKSQAQ

SEQ ID NO: 146 - protein, 7 aa, Artificial Sequence
  Description of Artificial Sequence: Synthetic peptide
SGNKSSQ

SEQ ID NO: 147 - protein, 7 aa, Artificial Sequence
  Description of Artificial Sequence: Synthetic peptide
SGRTGAG

SEQ ID NO: 148 - protein, 7 aa, Artificial Sequence
  Description of Artificial Sequence: Synthetic peptide
DSSTKPM

SEQ ID NO: 149 - protein, 7 aa, Artificial Sequence
  Description of Artificial Sequence: Synthetic peptide
TSSPQSK

SEQ ID NO: 150 - protein, 7 aa, Artificial Sequence
  Description of Artificial Sequence: Synthetic peptide
TTSTTPK

SEQ ID NO: 151 - protein, 7 aa, Artificial Sequence
  Description of Artificial Sequence: Synthetic peptide
NSSDKGK

SEQ ID NO: 152 - protein, 7 aa, Artificial Sequence
  Description of Artificial Sequence: Synthetic peptide
GTQGTGT

SEQ ID NO: 153 - protein, 7 aa, Artificial Sequence
  Description of Artificial Sequence: Synthetic peptide
EHEGKPI

SEQ ID NO: 154 - protein, 7 aa, Artificial Sequence
  Description of Artificial Sequence: Synthetic peptide
SAVSSNK

SEQ ID NO: 155 - protein, 7 aa, Artificial Sequence
  Description of Artificial Sequence: Synthetic peptide
ADANKQS

SEQ ID NO: 156 - protein, 7 aa, Artificial Sequence
  Description of Artificial Sequence: Synthetic peptide
DQVNKPV

SEQ ID NO: 157 - protein, 7 aa, Artificial Sequence
  Description of Artificial Sequence: Synthetic peptide
EGTTPSR

SEQ ID NO: 158 - protein, 7 aa, Artificial Sequence
  Description of Artificial Sequence: Synthetic peptide
GGAKSSE

SEQ ID NO: 159 - protein, 7 aa, Artificial Sequence
  Description of Artificial Sequence: Synthetic peptide
SGAGTAT

SEQ ID NO: 160 - protein, 7 aa, Artificial Sequence
  Description of Artificial Sequence: Synthetic peptide
EGHKGAG

SEQ ID NO: 161 - protein, 7 aa, Artificial Sequence
  Description of Artificial Sequence: Synthetic peptide
SSNTSTA

SEQ ID NO: 162 - protein, 7 aa, Artificial Sequence
  Description of Artificial Sequence: Synthetic peptide
STSSKSQ

SEQ ID NO: 163 - protein, 7 aa, Artificial Sequence
  Description of Artificial Sequence: Synthetic peptide
ASSKPGV

SEQ ID NO: 164 - protein, 7 aa, Artificial Sequence
  Description of Artificial Sequence: Synthetic peptide
EGSKTSS

SEQ ID NO: 165 - protein, 7 aa, Artificial Sequence
  Description of Artificial Sequence: Synthetic peptide
DGVSKTR

SEQ ID NO: 166 - protein, 7 aa, Artificial Sequence
  Description of Artificial Sequence: Synthetic peptide
GAGSSSK

SEQ ID NO: 167 - protein, 7 aa, Artificial Sequence
  Description of Artificial Sequence: Synthetic peptide
GGTSKSS

SEQ ID NO: 168 - protein, 7 aa, Artificial Sequence
  Description of Artificial Sequence: Synthetic peptide
LGSSKNV

SEQ ID NO: 169 - protein, 7 aa, Artificial Sequence
  Description of Artificial Sequence: Synthetic peptide
NSSGKSS

SEQ ID NO: 170 - protein, 7 aa, Artificial Sequence
  Description of Artificial Sequence: Synthetic peptide
TGMKDAK

SEQ ID NO: 171 - protein, 7 aa, Artificial Sequence
  Description of Artificial Sequence: Synthetic peptide
ADHGKVT

SEQ ID NO: 172 - protein, 7 aa, Artificial Sequence
  Description of Artificial Sequence: Synthetic peptide
GAEGSVK

SEQ ID NO: 173 - protein, 7 aa, Artificial Sequence
  Description of Artificial Sequence: Synthetic peptide
QGSSQVT

SEQ ID NO: 174 - protein, 7 aa, Artificial Sequence
  Description of Artificial Sequence: Synthetic peptide
NSKTGSA

SEQ ID NO: 175 - protein, 7 aa, Artificial Sequence
  Description of Artificial Sequence: Synthetic peptide
TSDRVST

SEQ ID NO: 176 - protein, 7 aa, Artificial Sequence
  Description of Artificial Sequence: Synthetic peptide
TGERKLE

SEQ ID NO: 177 - protein, 7 aa, Artificial Sequence
  Description of Artificial Sequence: Synthetic peptide
TPTQTPV

SEQ ID NO: 178 - protein, 7 aa, Artificial Sequence
  Description of Artificial Sequence: Synthetic peptide
SGNTSNH

SEQ ID NO: 179 - protein, 7 aa, Artificial Sequence
  Description of Artificial Sequence: Synthetic peptide
GGANERS

SEQ ID NO: 180 - protein, 7 aa, Artificial Sequence
  Description of Artificial Sequence: Synthetic peptide
TGSQSMQ

SEQ ID NO: 181 - protein, 7 aa, Artificial Sequence
  Description of Artificial Sequence: Synthetic peptide
HGTERAS

SEQ ID NO: 182 - protein, 7 aa, Artificial Sequence
  Description of Artificial Sequence: Synthetic peptide
QSDTGNK

SEQ ID NO: 183 - protein, 7 aa, Artificial Sequence
  Description of Artificial Sequence: Synthetic peptide
GAGERSK

SEQ ID NO: 184 - protein, 7 aa, Artificial Sequence
  Description of Artificial Sequence: Synthetic peptide
TGGQTST

SEQ ID NO: 185 - protein, 7 aa, Artificial Sequence
  Description of Artificial Sequence: Synthetic peptide
GETRTQS

SEQ ID NO: 186 - protein, 7 aa, Artificial Sequence
  Description of Artificial Sequence: Synthetic peptide
SGANHPS

SEQ ID NO: 187 - protein, 7 aa, Artificial Sequence
  Description of Artificial Sequence: Synthetic peptide
GASKGSD

SEQ ID NO: 188 - protein, 7 aa, Artificial Sequence
  Description of Artificial Sequence: Synthetic peptide
AQTSKTE

SEQ ID NO: 189 - protein, 7 aa, Artificial Sequence
  Description of Artificial Sequence: Synthetic peptide
GSGSPTR

SEQ ID NO: 190 - protein, 7 aa, Artificial Sequence
  Description of Artificial Sequence: Synthetic peptide
GLSKPSS

SEQ ID NO: 191 - protein, 7 aa, Artificial Sequence
  Description of Artificial Sequence: Synthetic peptide
GTTTRDG

SEQ ID NO: 192 - protein, 7 aa, Artificial Sequence
  Description of Artificial Sequence: Synthetic peptide
QGQTKPS

SEQ ID NO: 193 - protein, 7 aa, Artificial Sequence
  Description of Artificial Sequence: Synthetic peptide
GADKNVR

SEQ ID NO: 194 - protein, 7 aa, Artificial Sequence
  Description of Artificial Sequence: Synthetic peptide
SSSPQRV

SEQ ID NO: 195 - protein, 7 aa, Artificial Sequence
  Description of Artificial Sequence: Synthetic peptide
GNAGSVK

SEQ ID NO: 196 - protein, 7 aa, Artificial Sequence
  Description of Artificial Sequence: Synthetic peptide
NTGQHAT

SEQ ID NO: 197 - protein, 7 aa, Artificial Sequence
  Description of Artificial Sequence: Synthetic peptide
GQGSPKA

SEQ ID NO: 198 - protein, 7 aa, Artificial Sequence
  Description of Artificial Sequence: Synthetic peptide
QGDKHST

SEQ ID NO: 199 - protein, 7 aa, Artificial Sequence
  Description of Artificial Sequence: Synthetic peptide
GTGTKQV

SEQ ID NO: 200 - protein, 7 aa, Artificial Sequence
  Description of Artificial Sequence: Synthetic peptide
NCSGQNQ

SEQ ID NO: 201 - protein, 7 aa, Artificial Sequence
  Description of Artificial Sequence: Synthetic peptide
LTAKGTN

SEQ ID NO: 202 - protein, 7 aa, Artificial Sequence
  Description of Artificial Sequence: Synthetic peptide
RSSKEAG

SEQ ID NO: 203 - protein, 7 aa, Artificial Sequence
  Description of Artificial Sequence: Synthetic peptide
SGASPSS

SEQ ID NO: 204 - protein, 7 aa, Artificial Sequence
  Description of Artificial Sequence: Synthetic peptide
GKDSKPF

SEQ ID NO: 205 - protein, 7 aa, Artificial Sequence
  Description of Artificial Sequence: Synthetic peptide
GNAKSAL

SEQ ID NO: 206 - protein, 7 aa, Artificial Sequence
  Description of Artificial Sequence: Synthetic peptide
DGSQKFS

SEQ ID NO: 207 - protein, 7 aa, Artificial Sequence
  Description of Artificial Sequence: Synthetic peptide
DPSTQPK

SEQ ID NO: 208 - protein, 7 aa, Artificial Sequence
  Description of Artificial Sequence: Synthetic peptide
GGTPSLG

SEQ ID NO: 209 - protein, 7 aa, Artificial Sequence
  Description of Artificial Sequence: Synthetic peptide
MSRSPTE

SEQ ID NO: 210 - protein, 7 aa, Artificial Sequence
  Description of Artificial Sequence: Synthetic peptide
SNGNSPR

SEQ ID NO: 211 - protein, 7 aa, Artificial Sequence
  Description of Artificial Sequence: Synthetic peptide
STTAPPQ

SEQ ID NO: 212 - protein, 7 aa, Artificial Sequence
  Description of Artificial Sequence: Synthetic peptide
TVSANQK

SEQ ID NO: 213 - protein, 7 aa, Artificial Sequence
  Description of Artificial Sequence: Synthetic peptide
SQGKGSL

SEQ ID NO: 214 - protein, 7 aa, Artificial Sequence
  Description of Artificial Sequence: Synthetic peptide
VGTGKDG

SEQ ID NO: 215 - protein, 7 aa, Artificial Sequence
  Description of Artificial Sequence: Synthetic peptide
GSGNKTT

SEQ ID NO: 216 - protein, 7 aa, Artificial Sequence
  Description of Artificial Sequence: Synthetic peptide
NSGGGAK

SEQ ID NO: 217 - protein, 7 aa, Artificial Sequence
  Description of Artificial Sequence: Synthetic peptide
SGSKSLG

SEQ ID NO: 218 - protein, 7 aa, Artificial Sequence
  Description of Artificial Sequence: Synthetic peptide
SGGSKGS

SEQ ID NO: 219 - protein, 7 aa, Artificial Sequence
  Description of Artificial Sequence: Synthetic peptide
VGEQRGT

SEQ ID NO: 220 - protein, 7 aa, Artificial Sequence
  Description of Artificial Sequence: Synthetic peptide
RSDGKMA

SEQ ID NO: 221 - protein, 7 aa, Artificial Sequence
  Description of Artificial Sequence: Synthetic peptide
SKGSSNE

SEQ ID NO: 222 - protein, 7 aa, Artificial Sequence
  Description of Artificial Sequence: Synthetic peptide
GRDGKPT

SEQ ID NO: 223 - protein, 7 aa, Artificial Sequence
  Description of Artificial Sequence: Synthetic peptide
SGGTPSN

SEQ ID NO: 224 - protein, 7 aa, Artificial Sequence
  Description of Artificial Sequence: Synthetic peptide
SSSTKAV

SEQ ID NO: 225 - protein, 7 aa, Artificial Sequence
  Description of Artificial Sequence: Synthetic peptide
RSQKPSE

SEQ ID NO: 226 - protein, 7 aa, Artificial Sequence
  Description of Artificial Sequence: Synthetic peptide
SQPDPRT

SEQ ID NO: 227 - protein, 7 aa, Artificial Sequence
  Description of Artificial Sequence: Synthetic peptide
DRREAST

SEQ ID NO: 228 - protein, 7 aa, Artificial Sequence
  Description of Artificial Sequence: Synthetic peptide
DQSGTTR

SEQ ID NO: 229 - protein, 7 aa, Artificial Sequence
  Description of Artificial Sequence: Synthetic peptide
SSDKGRN

SEQ ID NO: 230 - protein, 7 aa, Artificial Sequence
  Description of Artificial Sequence: Synthetic peptide
KGASHNE

SEQ ID NO: 231 - protein, 7 aa, Artificial Sequence
  Description of Artificial Sequence: Synthetic peptide
SSSKQAQ

SEQ ID NO: 232 - protein, 7 aa, Artificial Sequence
  Description of Artificial Sequence: Synthetic peptide
QMEKSNS

SEQ ID NO: 233 - protein, 7 aa, Artificial Sequence
  Description of Artificial Sequence: Synthetic peptide
AAASQSS

SEQ ID NO: 234 - protein, 7 aa, Artificial Sequence
  Description of Artificial Sequence: Synthetic peptide
TRNQTSS

SEQ ID NO: 235 - protein, 7 aa, Artificial Sequence
  Description of Artificial Sequence: Synthetic peptide
DTSHKAS

SEQ ID NO: 236 - protein, 7 aa, Artificial Sequence
  Description of Artificial Sequence: Synthetic peptide
DSNTKMV

SEQ ID NO: 237 - protein, 7 aa, Artificial Sequence
  Description of Artificial Sequence: Synthetic peptide
SVSTGNK

SEQ ID NO: 238 - protein, 7 aa, Artificial Sequence
  Description of Artificial Sequence: Synthetic peptide
HAGNNNA

SEQ ID NO: 239 - protein, 7 aa, Artificial Sequence
  Description of Artificial Sequence: Synthetic peptide
STGSPGN

SEQ ID NO: 240 - protein, 7 aa, Artificial Sequence
  Description of Artificial Sequence: Synthetic peptide
DHPSGKH

SEQ ID NO: 241 - protein, 7 aa, Artificial Sequence
  Description of Artificial Sequence: Synthetic peptide
DNTKAGM

SEQ ID NO: 242 - protein, 7 aa, Artificial Sequence
  Description of Artificial Sequence: Synthetic peptide
QGSSKMT

SEQ ID NO: 243 - protein, 7 aa, Artificial Sequence
  Description of Artificial Sequence: Synthetic peptide
ENRSTSV

SEQ ID NO: 244 - protein, 7 aa, Artificial Sequence
  Description of Artificial Sequence: Synthetic peptide
SGDRGVQ

SEQ ID NO: 245 - protein, 7 aa, Artificial Sequence
  Description of Artificial Sequence: Synthetic peptide
NSEATPR

SEQ ID NO: 246 - protein, 7 aa, Artificial Sequence
  Description of Artificial Sequence: Synthetic peptide
MGTERNV

SEQ ID NO: 247 - protein, 7 aa, Artificial Sequence
  Description of Artificial Sequence: Synthetic peptide
GGTSSPT

SEQ ID NO: 248 - protein, 7 aa, Artificial Sequence
  Description of Artificial Sequence: Synthetic peptide
AVGSKSN

SEQ ID NO: 249 - protein, 7 aa, Artificial Sequence
  Description of Artificial Sequence: Synthetic peptide
AGTNKAS

SEQ ID NO: 250 - protein, 7 aa, Artificial Sequence
  Description of Artificial Sequence: Synthetic peptide
STGKTNT

SEQ ID NO: 251 - protein, 7 aa, Artificial Sequence
  Description of Artificial Sequence: Synthetic peptide
DPSKTAL

SEQ ID NO: 252 - protein, 7 aa, Artificial Sequence
  Description of Artificial Sequence: Synthetic peptide
GTSGKSI

SEQ ID NO: 253 - protein, 7 aa, Artificial Sequence
  Description of Artificial Sequence: Synthetic peptide
GSGSPIK

SEQ ID NO: 254 - protein, 7 aa, Artificial Sequence
  Description of Artificial Sequence: Synthetic peptide
GGSQTKI

SEQ ID NO: 255 - protein, 7 aa, Artificial Sequence
  Description of Artificial Sequence: Synthetic peptide
NTGTSAR

SEQ ID NO: 256 - protein, 7 aa, Artificial Sequence
  Description of Artificial Sequence: Synthetic peptide
TGNTSQS

SEQ ID NO: 257 - protein, 7 aa, Artificial Sequence
  Description of Artificial Sequence: Synthetic peptide
GRGSGSS

SEQ ID NO: 258 - protein, 7 aa, Artificial Sequence
  Description of Artificial Sequence: Synthetic peptide
SGERNPV

SEQ ID NO: 259 - protein, 7 aa, Artificial Sequence
  Description of Artificial Sequence: Synthetic peptide
ESKPSSV

SEQ ID NO: 260 - protein, 7 aa, Artificial Sequence
  Description of Artificial Sequence: Synthetic peptide
TTSGKPP

SEQ ID NO: 261 - protein, 7 aa, Artificial Sequence
  Description of Artificial Sequence: Synthetic peptide
GNGHAPT

SEQ ID NO: 262 - protein, 7 aa, Artificial Sequence
  Description of Artificial Sequence: Synthetic peptide
SQASKPI

SEQ ID NO: 263 - protein, 7 aa, Artificial Sequence
  Description of Artificial Sequence: Synthetic peptide
QGDSNAR

SEQ ID NO: 264 - protein, 7 aa, Artificial Sequence
  Description of Artificial Sequence: Synthetic peptide
FPATKQG

SEQ ID NO: 265 - protein, 7 aa, Artificial Sequence
  Description of Artificial Sequence: Synthetic peptide
GSAASVK

SEQ ID NO: 266 - protein, 7 aa, Artificial Sequence
  Description of Artificial Sequence: Synthetic peptide
TGAGGTA

SEQ ID NO: 267 - protein, 7 aa, Artificial Sequence
  Description of Artificial Sequence: Synthetic peptide
QQTGPTH

SEQ ID NO: 268 - protein, 7 aa, Artificial Sequence
  Description of Artificial Sequence: Synthetic peptide
TREGKGI

SEQ ID NO: 269 - protein, 7 aa, Artificial Sequence
  Description of Artificial Sequence: Synthetic peptide
SSTTTGG

SEQ ID NO: 270 - protein, 7 aa, Artificial Sequence
  Description of Artificial Sequence: Synthetic peptide
GQGNSTK

SEQ ID NO: 271 - protein, 7 aa, Artificial Sequence
  Description of Artificial Sequence: Synthetic peptide
GSMSPSR

SEQ ID NO: 272 - protein, 7 aa, Artificial Sequence
  Description of Artificial Sequence: Synthetic peptide
SSQTTAK

SEQ ID NO: 273 - protein, 7 aa, Artificial Sequence
  Description of Artificial Sequence: Synthetic peptide
GNGGSNR

SEQ ID NO: 274 - protein, 7 aa, Artificial Sequence
  Description of Artificial Sequence: Synthetic peptide
NSGKSPV

SEQ ID NO: 275 - protein, 7 aa, Artificial Sequence
  Description of Artificial Sequence: Synthetic peptide
GDNKSSY

SEQ ID NO: 276 - protein, 7 aa, Artificial Sequence
  Description of Artificial Sequence: Synthetic peptide
EGKSDHA

SEQ ID NO: 277 - protein, 7 aa, Artificial Sequence
  Description of Artificial Sequence: Synthetic peptide
NNGAKAG

SEQ ID NO: 278 - protein, 7 aa, Artificial Sequence
  Description of Artificial Sequence: Synthetic peptide
GSKPGTS

SEQ ID NO: 279 - protein, 7 aa, Artificial Sequence
  Description of Artificial Sequence: Synthetic peptide
AQTKSSV

SEQ ID NO: 280 - protein, 7 aa, Artificial Sequence
  Description of Artificial Sequence: Synthetic peptide
STGSHPA

SEQ ID NO: 281 - protein, 7 aa, Artificial Sequence
  Description of Artificial Sequence: Synthetic peptide
SMSSKSA

SEQ ID NO: 282 - protein, 7 aa, Artificial Sequence
  Description of Artificial Sequence: Synthetic peptide
VSTSKAG

SEQ ID NO: 283 - protein, 7 aa, Artificial Sequence
  Description of Artificial Sequence: Synthetic peptide
TSGTANS

SEQ ID NO: 284 - protein, 7 aa, Artificial Sequence
  Description of Artificial Sequence: Synthetic peptide
IGGSGSA

SEQ ID NO: 285 - protein, 7 aa, Artificial Sequence
  Description of Artificial Sequence: Synthetic peptide
GQNKGAS

SEQ ID NO: 286 - protein, 7 aa, Artificial Sequence
  Description of Artificial Sequence: Synthetic peptide
DRAGSSV

SEQ ID NO: 287 - protein, 7 aa, Artificial Sequence
  Description of Artificial Sequence: Synthetic peptide
EGRGTSS

SEQ ID NO: 288 - protein, 7 aa, Artificial Sequence
  Description of Artificial Sequence: Synthetic peptide
HSSSKSS

SEQ ID NO: 289 - protein, 7 aa, Artificial Sequence
  Description of Artificial Sequence: Synthetic peptide
TNSQTHG

SEQ ID NO: 290 - protein, 7 aa, Artificial Sequence
  Description of Artificial Sequence: Synthetic peptide
NGGKPNA

SEQ ID NO: 291 - protein, 7 aa, Artificial Sequence
  Description of Artificial Sequence: Synthetic peptide
NGASKSS

SEQ ID NO: 292 - protein, 7 aa, Artificial Sequence
  Description of Artificial Sequence: Synthetic peptide
QTGEKAR

SEQ ID NO: 293 - protein, 7 aa, Artificial Sequence
  Description of Artificial Sequence: Synthetic peptide
DDTKSNS

SEQ ID NO: 294 - protein, 7 aa, Artificial Sequence
  Description of Artificial Sequence: Synthetic peptide
VQGNPIS

SEQ ID NO: 295 - protein, 7 aa, Artificial Sequence
  Description of Artificial Sequence: Synthetic peptide
SKSTTPT

SEQ ID NO: 296 - protein, 7 aa, Artificial Sequence
  Description of Artificial Sequence: Synthetic peptide
SSNGVMK

SEQ ID NO: 297 - protein, 7 aa, Artificial Sequence
  Description of Artificial Sequence: Synthetic peptide
AGSKGKD

SEQ ID NO: 298 - protein, 7 aa, Artificial Sequence
  Description of Artificial Sequence: Synthetic peptide
DPDKSRS

SEQ ID NO: 299 - protein, 7 aa, Artificial Sequence
  Description of Artificial Sequence: Synthetic peptide
SPSGDHR

SEQ ID NO: 300 - protein, 7 aa, Artificial Sequence
  Description of Artificial Sequence: Synthetic peptide
LPTANSS

SEQ ID NO: 301 - protein, 7 aa, Artificial Sequence
  Description of Artificial Sequence: Synthetic peptide
SSDQARA

SEQ ID NO: 302 - protein, 7 aa, Artificial Sequence
  Description of Artificial Sequence: Synthetic peptide
SGVNTPT

SEQ ID NO: 303 - protein, 7 aa, Artificial Sequence
  Description of Artificial Sequence: Synthetic peptide
SSGREAS

SEQ ID NO: 304 - protein, 7 aa, Artificial Sequence
  Description of Artificial Sequence: Synthetic peptide
GSSKGPS

SEQ ID NO: 305 - protein, 7 aa, Artificial Sequence
  Description of Artificial Sequence: Synthetic peptide
GGSGSVK

SEQ ID NO: 306 - protein, 7 aa, Artificial Sequence
  Description of Artificial Sequence: Synthetic peptide
GEHKPSN

SEQ ID NO: 307 - protein, 7 aa, Artificial Sequence
  Description of Artificial Sequence: Synthetic peptide
LSAKEGS

SEQ ID NO: 308 - protein, 7 aa, Artificial Sequence
  Description of Artificial Sequence: Synthetic peptide
MSSGSQG

SEQ ID NO: 309 - protein, 7 aa, Artificial Sequence
  Description of Artificial Sequence: Synthetic peptide
HNNSKVE

SEQ ID NO: 310 - protein, 7 aa, Artificial Sequence
  Description of Artificial Sequence: Synthetic peptide
TSGPALK

SEQ ID NO: 311 - protein, 7 aa, Artificial Sequence
  Description of Artificial Sequence: Synthetic peptide
LDSKPVH

SEQ ID NO: 312 - protein, 7 aa, Artificial Sequence
  Description of Artificial Sequence: Synthetic peptide
SGLKDQA

SEQ ID NO: 313 - protein, 7 aa, Artificial Sequence
  Description of Artificial Sequence: Synthetic peptide
VNNTKNV

SEQ ID NO: 314 - protein, 7 aa, Artificial Sequence
  Description of Artificial Sequence: Synthetic peptide
GGATATR

SEQ ID NO: 315 - protein, 7 aa, Artificial Sequence
  Description of Artificial Sequence: Synthetic peptide
GSSGSPS

SEQ ID NO: 316 - protein, 7 aa, Artificial Sequence
  Description of Artificial Sequence: Synthetic peptide
TRGGSST

SEQ ID NO: 317 - protein, 7 aa, Artificial Sequence
  Description of Artificial Sequence: Synthetic peptide
VGTTHLS

SEQ ID NO: 318 - protein, 7 aa, Artificial Sequence
  Description of Artificial Sequence: Synthetic peptide
DGGASNK

SEQ ID NO: 319 - protein, 7 aa, Artificial Sequence
  Description of Artificial Sequence: Synthetic peptide
KSATPSN

SEQ ID NO: 320 - protein, 7 aa, Artificial Sequence
  Description of Artificial Sequence: Synthetic peptide
GTIDKGH

SEQ ID NO: 321 - protein, 7 aa, Artificial Sequence
  Description of Artificial Sequence: Synthetic peptide
KDQSPTH

SEQ ID NO: 322 - protein, 7 aa, Artificial Sequence
  Description of Artificial Sequence: Synthetic peptide
TRSQTSV

SEQ ID NO: 323 - protein, 7 aa, Artificial Sequence
  Description of Artificial Sequence: Synthetic peptide
TRENKSL

SEQ ID NO: 324 - protein, 7 aa, Artificial Sequence
  Description of Artificial Sequence: Synthetic peptide
EPGSHKN

SEQ ID NO: 325 - protein, 7 aa, Artificial Sequence
  Description of Artificial Sequence: Synthetic peptide
VGQSSSN

SEQ ID NO: 326 - protein, 7 aa, Artificial Sequence
  Description of Artificial Sequence: Synthetic peptide
DNKDKVL

SEQ ID NO: 327 - protein, 7 aa, Artificial Sequence
  Description of Artificial Sequence: Synthetic peptide
TNSKSAV

SEQ ID NO: 328 - protein, 7 aa, Artificial Sequence
  Description of Artificial Sequence: Synthetic peptide
STAKGSN

SEQ ID NO: 329 - protein, 7 aa, Artificial Sequence
  Description of Artificial Sequence: Synthetic peptide
AGSKVTT

SEQ ID NO: 330 - protein, 7 aa, Artificial Sequence
  Description of Artificial Sequence: Synthetic peptide
NRESSTV

SEQ ID NO: 331 - protein, 7 aa, Artificial Sequence
  Description of Artificial Sequence: Synthetic peptide
ELPAGKS

SEQ ID NO: 332 - protein, 7 aa, Artificial Sequence
  Description of Artificial Sequence: Synthetic peptide
TTGQSVG

SEQ ID NO: 333 - protein, 7 aa, Artificial Sequence
  Description of Artificial Sequence: Synthetic peptide
ASGSHNS

SEQ ID NO: 334 - protein, 7 aa, Artificial Sequence
  Description of Artificial Sequence: Synthetic peptide
NASTKSG

SEQ ID NO: 335 - protein, 7 aa, Artificial Sequence
  Description of Artificial Sequence: Synthetic peptide
GGSPTAQ

SEQ ID NO: 336 - protein, 7 aa, Artificial Sequence
  Description of Artificial Sequence: Synthetic peptide
NTPSKAS

SEQ ID NO: 337 - protein, 7 aa, Artificial Sequence
  Description of Artificial Sequence: Synthetic peptide
NGSASNR

SEQ ID NO: 338 - protein, 7 aa, Artificial Sequence
  Description of Artificial Sequence: Synthetic peptide
SVSGGQG

SEQ ID NO: 339 - protein, 7 aa, Artificial Sequence
  Description of Artificial Sequence: Synthetic peptide
MSKPTNV

SEQ ID NO: 340 - protein, 7 aa, Artificial Sequence
  Description of Artificial Sequence: Synthetic peptide
QPAATPN

SEQ ID NO: 341 - protein, 7 aa, Artificial Sequence
  Description of Artificial Sequence: Synthetic peptide
EPVKSTI

SEQ ID NO: 342 - protein, 7 aa, Artificial Sequence
  Description of Artificial Sequence: Synthetic peptide
EQSKQSK

SEQ ID NO: 343 - protein, 7 aa, Artificial Sequence
  Description of Artificial Sequence: Synthetic peptide
GTSQSSN

SEQ ID NO: 344 - protein, 7 aa, Artificial Sequence
  Description of Artificial Sequence: Synthetic peptide
GNSGSGV

SEQ ID NO: 345 - protein, 7 aa, Artificial Sequence
  Description of Artificial Sequence: Synthetic peptide
LGSGQVQ

SEQ ID NO: 346 - protein, 7 aa, Artificial Sequence
  Description of Artificial Sequence: Synthetic peptide
DAGHKST

SEQ ID NO: 347 - protein, 7 aa, Artificial Sequence
  Description of Artificial Sequence: Synthetic peptide
GDGGAQK

SEQ ID NO: 348 - protein, 7 aa, Artificial Sequence
  Description of Artificial Sequence: Synthetic peptide
SGNKPIS

SEQ ID NO: 349 - protein, 7 aa, Artificial Sequence
  Description of Artificial Sequence: Synthetic peptide
VSGAKPL

SEQ ID NO: 350 - protein, 7 aa, Artificial Sequence
  Description of Artificial Sequence: Synthetic peptide
NASKSSA

SEQ ID NO: 351 - protein, 7 aa, Artificial Sequence
  Description of Artificial Sequence: Synthetic peptide
GIGGHNS

SEQ ID NO: 352 - protein, 7 aa, Artificial Sequence
  Description of Artificial Sequence: Synthetic peptide
GGQSKPT

SEQ ID NO: 353 - protein, 7 aa, Artificial Sequence
  Description of Artificial Sequence: Synthetic peptide
QGDKSSY

SEQ ID NO: 354 - protein, 7 aa, Artificial Sequence
  Description of Artificial Sequence: Synthetic peptide
QGPKSDN

SEQ ID NO: 355 - protein, 7 aa, Artificial Sequence
  Description of Artificial Sequence: Synthetic peptide
EASSGGR

SEQ ID NO: 356 - protein, 7 aa, Artificial Sequence
  Description of Artificial Sequence: Synthetic peptide
ANTGTTQ

SEQ ID NO: 357 - protein, 7 aa, Artificial Sequence
  Description of Artificial Sequence: Synthetic peptide
DSNSTTR

SEQ ID NO: 358 - protein, 7 aa, Artificial Sequence
  Description of Artificial Sequence: Synthetic peptide
GEARPTN

SEQ ID NO: 359 - protein, 7 aa, Artificial Sequence
  Description of Artificial Sequence: Synthetic peptide
SLNKNNM

SEQ ID NO: 360 - protein, 7 aa, Artificial Sequence
  Description of Artificial Sequence: Synthetic peptide
GRANGST

SEQ ID NO: 361 - protein, 7 aa, Artificial Sequence
  Description of Artificial Sequence: Synthetic peptide
QSNTAHA

SEQ ID NO: 362 - protein, 7 aa, Artificial Sequence
  Description of Artificial Sequence: Synthetic peptide
QGTSKSS

SEQ ID NO: 363 - protein, 7 aa, Artificial Sequence
  Description of Artificial Sequence: Synthetic peptide
TGGSKSS

SEQ ID NO: 364 - protein, 7 aa, Artificial Sequence
  Description of Artificial Sequence: Synthetic peptide
QVAKPAS

SEQ ID NO: 365 - protein, 7 aa, Artificial Sequence
  Description of Artificial Sequence: Synthetic peptide
VANPPSQ

SEQ ID NO: 366 - protein, 7 aa, Artificial Sequence
  Description of Artificial Sequence: Synthetic peptide
ATTKATE

SEQ ID NO: 367 - protein, 7 aa, Artificial Sequence
  Description of Artificial Sequence: Synthetic peptide
QTASTNK

SEQ ID NO: 368 - protein, 7 aa, Artificial Sequence
  Description of Artificial Sequence: Synthetic peptide
SGSVPST

SEQ ID NO: 369 - protein, 7 aa, Artificial Sequence
  Description of Artificial Sequence: Synthetic peptide
SQPKAGS

SEQ ID NO: 370 - protein, 7 aa, Artificial Sequence
  Description of Artificial Sequence: Synthetic peptide
TVSTATK

SEQ ID NO: 371 - protein, 7 aa, Artificial Sequence
  Description of Artificial Sequence: Synthetic peptide
RDNTKTG

SEQ ID NO: 372 - protein, 7 aa, Artificial Sequence
  Description of Artificial Sequence: Synthetic peptide
MNNTNSK

SEQ ID NO: 373 - protein, 7 aa, Artificial Sequence
  Description of Artificial Sequence: Synthetic peptide
AGTSHAQ

SEQ ID NO: 374 - protein, 7 aa, Artificial Sequence
  Description of Artificial Sequence: Synthetic peptide
SGKNAVA

SEQ ID NO: 375 - protein, 7 aa, Artificial Sequence
  Description of Artificial Sequence: Synthetic peptide
TGSQHNS

SEQ ID NO: 376 - protein, 7 aa, Artificial Sequence
  Description of Artificial Sequence: Synthetic peptide
VGNGQGR

SEQ ID NO: 377 - protein, 7 aa, Artificial Sequence
  Description of Artificial Sequence: Synthetic peptide
EVGGHSK

SEQ ID NO: 378 - protein, 7 aa, Artificial Sequence
  Description of Artificial Sequence: Synthetic peptide
SPDKANV

SEQ ID NO: 379 - protein, 7 aa, Artificial Sequence
  Description of Artificial Sequence: Synthetic peptide
GVKNTTG

SEQ ID NO: 380 - protein, 7 aa, Artificial Sequence
  Description of Artificial Sequence: Synthetic peptide
TTGSKPS

SEQ ID NO: 381 - protein, 7 aa, Artificial Sequence
  Description of Artificial Sequence: Synthetic peptide
GSNTSSG

SEQ ID NO: 382 - protein, 7 aa, Artificial Sequence
  Description of Artificial Sequence: Synthetic peptide
KGSSTVG

SEQ ID NO: 383 - protein, 7 aa, Artificial Sequence
  Description of Artificial Sequence: Synthetic peptide
AAGTPSN

SEQ ID NO: 384 - protein, 7 aa, Artificial Sequence
  Description of Artificial Sequence: Synthetic peptide
SQVKGGS

SEQ ID NO: 385 - protein, 7 aa, Artificial Sequence
  Description of Artificial Sequence: Synthetic peptide
GNSHESK

SEQ ID NO: 386 - protein, 7 aa, Artificial Sequence
  Description of Artificial Sequence: Synthetic peptide
GNGATTL

SEQ ID NO: 387 - protein, 7 aa, Artificial Sequence
  Description of Artificial Sequence: Synthetic peptide
KNHPKNE

SEQ ID NO: 388 - protein, 7 aa, Artificial Sequence
  Description of Artificial Sequence: Synthetic peptide
QGSKGAN

SEQ ID NO: 389 - protein, 7 aa, Artificial Sequence
  Description of Artificial Sequence: Synthetic peptide
QGNSNQS

SEQ ID NO: 390 - protein, 7 aa, Artificial Sequence
  Description of Artificial Sequence: Synthetic peptide
SSGSHPS

SEQ ID NO: 391 - protein, 7 aa, Artificial Sequence
  Description of Artificial Sequence: Synthetic peptide
SSSKPGT

SEQ ID NO: 392 - protein, 7 aa, Artificial Sequence
  Description of Artificial Sequence: Synthetic peptide
GNQTKPL

SEQ ID NO: 393 - protein, 7 aa, Artificial Sequence
  Description of Artificial Sequence: Synthetic peptide
SGTNTTS

SEQ ID NO: 394 - protein, 7 aa, Artificial Sequence
  Description of Artificial Sequence: Synthetic peptide
GAHENSK

SEQ ID NO: 395 - protein, 7 aa, Artificial Sequence
  Description of Artificial Sequence: Synthetic peptide
EGESRKG

SEQ ID NO: 396 - protein, 7 aa, Artificial Sequence
  Description of Artificial Sequence: Synthetic peptide
GSEDKRI

SEQ ID NO: 397 - protein, 7 aa, Artificial Sequence
  Description of Artificial Sequence: Synthetic peptide
DSSSRST

SEQ ID NO: 398 - protein, 7 aa, Artificial Sequence
  Description of Artificial Sequence: Synthetic peptide
TGSQPQH

SEQ ID NO: 399 - protein, 7 aa, Artificial Sequence
  Description of Artificial Sequence: Synthetic peptide
MTDTKPA

SEQ ID NO: 400 - protein, 7 aa, Artificial Sequence
  Description of Artificial Sequence: Synthetic peptide
QVSKASL

SEQ ID NO: 401 - protein, 7 aa, Artificial Sequence
  Description of Artificial Sequence: Synthetic peptide
STGGTGK

SEQ ID NO: 402 - protein, 7 aa, Artificial Sequence
  Description of Artificial Sequence: Synthetic peptide
QSDKPIS

SEQ ID NO: 403 - protein, 7 aa, Artificial Sequence
  Description of Artificial Sequence: Synthetic peptide
AGGASQV

SEQ ID NO: 404 - protein, 7 aa, Artificial Sequence
  Description of Artificial Sequence: Synthetic peptide
SRGGSQA

SEQ ID NO: 405 - protein, 7 aa, Artificial Sequence
  Description of Artificial Sequence: Synthetic peptide
TMNGKPT

SEQ ID NO: 406 - protein, 7 aa, Artificial Sequence
  Description of Artificial Sequence: Synthetic peptide
GPTQGTG

SEQ ID NO: 407 - protein, 7 aa, Artificial Sequence
  Description of Artificial Sequence: Synthetic peptide
SGVTKGS

SEQ ID NO: 408 - protein, 7 aa, Artificial Sequence
  Description of Artificial Sequence: Synthetic peptide
ETGRPAT

SEQ ID NO: 409 - protein, 7 aa, Artificial Sequence
  Description of Artificial Sequence: Synthetic peptide
LGSKESS

SEQ ID NO: 410 - protein, 7 aa, Artificial Sequence
  Description of Artificial Sequence: Synthetic peptide
NTGEKQS

SEQ ID NO: 411 - protein, 7 aa, Artificial Sequence
  Description of Artificial Sequence: Synthetic peptide
ASAGSQS

SEQ ID NO: 412 - protein, 7 aa, Artificial Sequence
  Description of Artificial Sequence: Synthetic peptide
VTSEKNA

SEQ ID NO: 413 - protein, 7 aa, Artificial Sequence
  Description of Artificial Sequence: Synthetic peptide
TGSNSVS

SEQ ID NO: 414 - protein, 7 aa, Artificial Sequence
  Description of Artificial Sequence: Synthetic peptide
ERTSSVV

SEQ ID NO: 415 - protein, 7 aa, Artificial Sequence
  Description of Artificial Sequence: Synthetic peptide
GPSNPSS

SEQ ID NO: 416 - protein, 7 aa, Artificial Sequence
  Description of Artificial Sequence: Synthetic peptide
SSSSKPA

SEQ ID NO: 417 - protein, 7 aa, Artificial Sequence
  Description of Artificial Sequence: Synthetic peptide
QDRTPSV

SEQ ID NO: 418 - protein, 7 aa, Artificial Sequence
  Description of Artificial Sequence: Synthetic peptide
STTREAV

SEQ ID NO: 419 - protein, 7 aa, Artificial Sequence
  Description of Artificial Sequence: Synthetic peptide
TTNKSSV

SEQ ID NO: 420 - protein, 7 aa, Artificial Sequence
  Description of Artificial Sequence: Synthetic peptide
TISQNPA

SEQ ID NO: 421 - protein, 7 aa, Artificial Sequence
  Description of Artificial Sequence: Synthetic peptide
STERNNH

SEQ ID NO: 422 - protein, 7 aa, Artificial Sequence
  Description of Artificial Sequence: Synthetic peptide
TRTPAST

SEQ ID NO: 423 - protein, 7 aa, Artificial Sequence
  Description of Artificial Sequence: Synthetic peptide
AGVDRSH

SEQ ID NO: 424 - protein, 7 aa, Artificial Sequence
  Description of Artificial Sequence: Synthetic peptide
NTSGTGS

SEQ ID NO: 425 - protein, 7 aa, Artificial Sequence
  Description of Artificial Sequence: Synthetic peptide
GRGKDSV

SEQ ID NO: 426 - protein, 7 aa, Artificial Sequence
  Description of Artificial Sequence: Synthetic peptide
LTSTAPK

SEQ ID NO: 427 - protein, 7 aa, Artificial Sequence
  Description of Artificial Sequence: Synthetic peptide
QSVNTPK

SEQ ID NO: 428 - protein, 7 aa, Artificial Sequence
  Description of Artificial Sequence: Synthetic peptide
TKSQTPV

SEQ ID NO: 429 - protein, 7 aa, Artificial Sequence
  Description of Artificial Sequence: Synthetic peptide
SSQSATK

SEQ ID NO: 430 - protein, 7 aa, Artificial Sequence
  Description of Artificial Sequence: Synthetic peptide
KGGGSTN

SEQ ID NO: 431 - protein, 7 aa, Artificial Sequence
  Description of Artificial Sequence: Synthetic peptide
TNSGAGI

SEQ ID NO: 432 - protein, 7 aa, Artificial Sequence
  Description of Artificial Sequence: Synthetic peptide
DNSVKSV

SEQ ID NO: 433 - protein, 7 aa, Artificial Sequence
  Description of Artificial Sequence: Synthetic peptide
SINSGSK

SEQ ID NO: 434 - protein, 7 aa, Artificial Sequence
  Description of Artificial Sequence: Synthetic peptide
STTGASK

SEQ ID NO: 435 - protein, 7 aa, Artificial Sequence
  Description of Artificial Sequence: Synthetic peptide
GGGGSSV

SEQ ID NO: 436 - protein, 7 aa, Artificial Sequence
  Description of Artificial Sequence: Synthetic peptide
GMSNPSN

SEQ ID NO: 437 - protein, 7 aa, Artificial Sequence
  Description of Artificial Sequence: Synthetic peptide
QSNSSLS

SEQ ID NO: 438 - protein, 7 aa, Artificial Sequence
  Description of Artificial Sequence: Synthetic peptide
QSGKSAD

SEQ ID NO: 439 - protein, 7 aa, Artificial Sequence
  Description of Artificial Sequence: Synthetic peptide
QTGERHV

SEQ ID NO: 440 - protein, 7 aa, Artificial Sequence
  Description of Artificial Sequence: Synthetic peptide
NSATRPV

SEQ ID NO: 441 - protein, 7 aa, Artificial Sequence
  Description of Artificial Sequence: Synthetic peptide
VSTNKNV

SEQ ID NO: 442 - protein, 7 aa, Artificial Sequence
  Description of Artificial Sequence: Synthetic peptide
SNGTKQT

SEQ ID NO: 443 - protein, 7 aa, Artificial Sequence
  Description of Artificial Sequence: Synthetic peptide
NDSPTAR

SEQ ID NO: 444 - protein, 7 aa, Artificial Sequence
  Description of Artificial Sequence: Synthetic peptide
LRQQVSE

SEQ ID NO: 445 - protein, 7 aa, Artificial Sequence
  Description of Artificial Sequence: Synthetic peptide
NTGEGAK

SEQ ID NO: 446 - protein, 7 aa, Artificial Sequence
  Description of Artificial Sequence: Synthetic peptide
TGTAHPS

SEQ ID NO: 447 - protein, 7 aa, Artificial Sequence
  Description of Artificial Sequence: Synthetic peptide
TGSPSSA

SEQ ID NO: 448 - protein, 7 aa, Artificial Sequence
  Description of Artificial Sequence: Synthetic peptide
GKDNSKN

SEQ ID NO: 449 - protein, 7 aa, Artificial Sequence
  Description of Artificial Sequence: Synthetic peptide
NSGQQNG

SEQ ID NO: 450 - protein, 7 aa, Artificial Sequence
  Description of Artificial Sequence: Synthetic peptide
SSSNASH

SEQ ID NO: 451 - protein, 7 aa, Artificial Sequence
  Description of Artificial Sequence: Synthetic peptide
NNAATQS

SEQ ID NO: 452 - protein, 7 aa, Artificial Sequence
  Description of Artificial Sequence: Synthetic peptide
TPERAGS

SEQ ID NO: 453 - protein, 7 aa, Artificial Sequence
  Description of Artificial Sequence: Synthetic peptide
QSGKSTT

SEQ ID NO: 454 - protein, 7 aa, Artificial Sequence
  Description of Artificial Sequence: Synthetic peptide
TIGKPGA

SEQ ID NO: 455 - protein, 7 aa, Artificial Sequence
  Description of Artificial Sequence: Synthetic peptide
ISGKAST

SEQ ID NO: 456 - protein, 7 aa, Artificial Sequence
  Description of Artificial Sequence: Synthetic peptide
ENSNKFT

SEQ ID NO: 457 - protein, 7 aa, Artificial Sequence
  Description of Artificial Sequence: Synthetic peptide
GHTNNPL

SEQ ID NO: 458 - protein, 7 aa, Artificial Sequence
  Description of Artificial Sequence: Synthetic peptide
SSDGRGT

SEQ ID NO: 459 - protein, 7 aa, Artificial Sequence
  Description of Artificial Sequence: Synthetic peptide
APVQQGG

SEQ ID NO: 460 - protein, 7 aa, Artificial Sequence
  Description of Artificial Sequence: Synthetic peptide
TIGGKPD

SEQ ID NO: 461 - protein, 7 aa, Artificial Sequence
  Description of Artificial Sequence: Synthetic peptide
GTASSQS

SEQ ID NO: 462 - protein, 7 aa, Artificial Sequence
  Description of Artificial Sequence: Synthetic peptide
DMAKERS

SEQ ID NO: 463 - protein, 7 aa, Artificial Sequence
  Description of Artificial Sequence: Synthetic peptide
DANSKGK

SEQ ID NO: 464 - protein, 7 aa, Artificial Sequence
  Description of Artificial Sequence: Synthetic peptide
SGERSTT

SEQ ID NO: 465 - protein, 7 aa, Artificial Sequence
  Description of Artificial Sequence: Synthetic peptide
EHSSSVK

SEQ ID NO: 466 - protein, 7 aa, Artificial Sequence
  Description of Artificial Sequence: Synthetic peptide
SSGSPGK

SEQ ID NO: 467 - protein, 7 aa, Artificial Sequence
  Description of Artificial Sequence: Synthetic peptide
GKSTSGG

SEQ ID NO: 468 - protein, 7 aa, Artificial Sequence
  Description of Artificial Sequence: Synthetic peptide
TGVNSPH

SEQ ID NO: 469 - protein, 7 aa, Artificial Sequence
  Description of Artificial Sequence: Synthetic peptide
GSSAHPK

SEQ ID NO: 470 - protein, 7 aa, Artificial Sequence
  Description of Artificial Sequence: Synthetic peptide
SGTEKAR

SEQ ID NO: 471 - protein, 7 aa, Artificial Sequence
  Description of Artificial Sequence: Synthetic peptide
SPSSNPQ

SEQ ID NO: 472 - protein, 7 aa, Artificial Sequence
  Description of Artificial Sequence: Synthetic peptide
TANKTTL

SEQ ID NO: 473 - protein, 7 aa, Artificial Sequence
  Description of Artificial Sequence: Synthetic peptide
TGTKPLG

SEQ ID NO: 474 - protein, 7 aa, Artificial Sequence
  Description of Artificial Sequence: Synthetic peptide
SNQKTSI

SEQ ID NO: 475 - protein, 7 aa, Artificial Sequence
  Description of Artificial Sequence: Synthetic peptide
SLNDHSK

SEQ ID NO: 476 - protein, 7 aa, Artificial Sequence
  Description of Artificial Sequence: Synthetic peptide
HSSEQGK

SEQ ID NO: 477 - protein, 7 aa, Artificial Sequence
  Description of Artificial Sequence: Synthetic peptide
NQGKTAE

SEQ ID NO: 478 - protein, 7 aa, Artificial Sequence
  Description of Artificial Sequence: Synthetic peptide
RAEGKNV

SEQ ID NO: 479 - protein, 7 aa, Artificial Sequence
  Description of Artificial Sequence: Synthetic peptide
TGASSGS

SEQ ID NO: 480 - protein, 7 aa, Artificial Sequence
  Description of Artificial Sequence: Synthetic peptide
RENKPDS

SEQ ID NO: 481 - protein, 7 aa, Artificial Sequence
  Description of Artificial Sequence: Synthetic peptide
ESRSPSH

SEQ ID NO: 482 - protein, 7 aa, Artificial Sequence
  Description of Artificial Sequence: Synthetic peptide
VSGKQIS

SEQ ID NO: 483 - protein, 7 aa, Artificial Sequence
  Description of Artificial Sequence: Synthetic peptide
LSGKAPN

SEQ ID NO: 484 - protein, 7 aa, Artificial Sequence
  Description of Artificial Sequence: Synthetic peptide
GTTGERA

SEQ ID NO: 485 - protein, 7 aa, Artificial Sequence
  Description of Artificial Sequence: Synthetic peptide
VASSKTT

SEQ ID NO: 486 - protein, 7 aa, Artificial Sequence
  Description of Artificial Sequence: Synthetic peptide
TDRTPSM

SEQ ID NO: 487 - protein, 7 aa, Artificial Sequence
  Description of Artificial Sequence: Synthetic peptide
SAESVNK

SEQ ID NO: 488 - protein, 7 aa, Artificial Sequence
  Description of Artificial Sequence: Synthetic peptide
VRGQTTS

SEQ ID NO: 489 - protein, 7 aa, Artificial Sequence
  Description of Artificial Sequence: Synthetic peptide
GQGTKVT

SEQ ID NO: 490 - protein, 7 aa, Artificial Sequence
  Description of Artificial Sequence: Synthetic peptide
TRSQPTT

SEQ ID NO: 491 - protein, 7 aa, Artificial Sequence
  Description of Artificial Sequence: Synthetic peptide
QRVTESH

SEQ ID NO: 492 - protein, 7 aa, Artificial Sequence
  Description of Artificial Sequence: Synthetic peptide
QGDKPRL

SEQ ID NO: 493 - protein, 7 aa, Artificial Sequence
  Description of Artificial Sequence: Synthetic peptide
ASKPSNI

SEQ ID NO: 494 - protein, 7 aa, Artificial Sequence
  Description of Artificial Sequence: Synthetic peptide
ETARPNQ

SEQ ID NO: 495 - protein, 7 aa, Artificial Sequence
  Description of Artificial Sequence: Synthetic peptide
QSTSKTS

SEQ ID NO: 496 - protein, 7 aa, Artificial Sequence
  Description of Artificial Sequence: Synthetic peptide
SSDTKIS

SEQ ID NO: 497 - protein, 7 aa, Artificial Sequence
  Description of Artificial Sequence: Synthetic peptide
NGTDRTT

SEQ ID NO: 498 - protein, 7 aa, Artificial Sequence
  Description of Artificial Sequence: Synthetic peptide
TQKPTNG

SEQ ID NO: 499 - protein, 7 aa, Artificial Sequence
  Description of Artificial Sequence: Synthetic peptide
QQGEAFK

SEQ ID NO: 500 - protein, 7 aa, Artificial Sequence
  Description of Artificial Sequence: Synthetic peptide
DGQPPTK

SEQ ID NO: 501 - protein, 7 aa, Artificial Sequence
  Description of Artificial Sequence: Synthetic peptide
SNGQKQD

SEQ ID NO: 502 - protein, 7 aa, Artificial Sequence
  Description of Artificial Sequence: Synthetic peptide
STSTKSG

SEQ ID NO: 503 - protein, 7 aa, Artificial Sequence
  Description of Artificial Sequence: Synthetic peptide
SGGGSPV

SEQ ID NO: 504 - protein, 7 aa, Artificial Sequence
  Description of Artificial Sequence: Synthetic peptide
SVSKSSI

SEQ ID NO: 505 - protein, 7 aa, Artificial Sequence
  Description of Artificial Sequence: Synthetic peptide
QVGSDHR

SEQ ID NO: 506 - protein, 7 aa, Artificial Sequence
  Description of Artificial Sequence: Synthetic peptide
GSNGSRG

SEQ ID NO: 507 - protein, 7 aa, Artificial Sequence
  Description of Artificial Sequence: Synthetic peptide
ASSQKVV

SEQ ID NO: 508 - protein, 7 aa, Artificial Sequence
  Description of Artificial Sequence: Synthetic peptide
SPHQAGT

SEQ ID NO: 509 - protein, 7 aa, Artificial Sequence
  Description of Artificial Sequence: Synthetic peptide
GGSERAK

SEQ ID NO: 510 - protein, 7 aa, Artificial Sequence
  Description of Artificial Sequence: Synthetic peptide
AGGGKAT

SEQ ID NO: 511 - protein, 7 aa, Artificial Sequence
  Description of Artificial Sequence: Synthetic peptide
GMSAGTG

SEQ ID NO: 512 - protein, 7 aa, Artificial Sequence
  Description of Artificial Sequence: Synthetic peptide
SQSKSAL

SEQ ID NO: 513 - protein, 7 aa, Artificial Sequence
  Description of Artificial Sequence: Synthetic peptide
SHQTGSG

SEQ ID NO: 514 - protein, 7 aa, Artificial Sequence
  Description of Artificial Sequence: Synthetic peptide
GGKSPAH

SEQ ID NO: 515 - protein, 7 aa, Artificial Sequence
  Description of Artificial Sequence: Synthetic peptide
RMNKTSE

SEQ ID NO: 516 - protein, 7 aa, Artificial Sequence
  Description of Artificial Sequence: Synthetic peptide
ARDTKAS

SEQ ID NO: 517 - protein, 7 aa, Artificial Sequence
  Description of Artificial Sequence: Synthetic peptide
NGNKHAS

SEQ ID NO: 518 - protein, 7 aa, Artificial Sequence
  Description of Artificial Sequence: Synthetic peptide
LTQKSPS

SEQ ID NO: 519 - protein, 7 aa, Artificial Sequence
  Description of Artificial Sequence: Synthetic peptide
DATSKFA

SEQ ID NO: 520 - protein, 7 aa, Artificial Sequence
  Description of Artificial Sequence: Synthetic peptide
SLGKTAS

SEQ ID NO: 521 - protein, 7 aa, Artificial Sequence
  Description of Artificial Sequence: Synthetic peptide
SSASSNQ

SEQ ID NO: 522 - protein, 7 aa, Artificial Sequence
  Description of Artificial Sequence: Synthetic peptide
GNHSPPK

SEQ ID NO: 523 - protein, 7 aa, Artificial Sequence
  Description of Artificial Sequence: Synthetic peptide
QTAKPGV

SEQ ID NO: 524 - protein, 7 aa, Artificial Sequence
  Description of Artificial Sequence: Synthetic peptide
NSTTKVS

SEQ ID NO: 525 - protein, 7 aa, Artificial Sequence
  Description of Artificial Sequence: Synthetic peptide
GTGGTLS

SEQ ID NO: 526 - protein, 7 aa, Artificial Sequence
  Description of Artificial Sequence: Synthetic peptide
HSASPTV

SEQ ID NO: 527 - protein, 7 aa, Artificial Sequence
  Description of Artificial Sequence: Synthetic peptide
TPQKDAK

SEQ ID NO: 528 - protein, 7 aa, Artificial Sequence
  Description of Artificial Sequence: Synthetic peptide
QTATVPK

SEQ ID NO: 529 - protein, 7 aa, Artificial Sequence
  Description of Artificial Sequence: Synthetic peptide
DGGTSRV

SEQ ID NO: 530 - protein, 7 aa, Artificial Sequence
  Description of Artificial Sequence: Synthetic peptide
SESKANA

SEQ ID NO: 531 - protein, 7 aa, Artificial Sequence
  Description of Artificial Sequence: Synthetic peptide
ATHQPAT

SEQ ID NO: 532 - protein, 7 aa, Artificial Sequence
  Description of Artificial Sequence: Synthetic peptide
LQAKASG

SEQ ID NO: 533 - protein, 7 aa, Artificial Sequence
  Description of Artificial Sequence: Synthetic peptide
KGNSSTT

SEQ ID NO: 534 - protein, 7 aa, Artificial Sequence
  Description of Artificial Sequence: Synthetic peptide
AADRSST

SEQ ID NO: 535 - protein, 7 aa, Artificial Sequence
  Description of Artificial Sequence: Synthetic peptide
SPSPTPK

SEQ ID NO: 536 - protein, 7 aa, Artificial Sequence
  Description of Artificial Sequence: Synthetic peptide
SGNGKVT

SEQ ID NO: 537 - protein, 7 aa, Artificial Sequence
  Description of Artificial Sequence: Synthetic peptide
EQGNNKH

SEQ ID NO: 538 - protein, 7 aa, Artificial Sequence
  Description of Artificial Sequence: Synthetic peptide
GGSKQAS

SEQ ID NO: 539 - protein, 7 aa, Artificial Sequence
  Description of Artificial Sequence: Synthetic peptide
QRGATNG

SEQ ID NO: 540 - protein, 7 aa, Artificial Sequence
  Description of Artificial Sequence: Synthetic peptide
GKTNQQS

SEQ ID NO: 541 - protein, 7 aa, Artificial Sequence
  Description of Artificial Sequence: Synthetic peptide
TNGKSSS

SEQ ID NO: 542 - protein, 7 aa, Artificial Sequence
  Description of Artificial Sequence: Synthetic peptide
QDGKGQQ

SEQ ID NO: 543 - protein, 7 aa, Artificial Sequence
  Description of Artificial Sequence: Synthetic peptide
SRQNANS

SEQ ID NO: 544 - protein, 7 aa, Artificial Sequence
  Description of Artificial Sequence: Synthetic peptide
HGSSSKT

SEQ ID NO: 545 - protein, 7 aa, Artificial Sequence
  Description of Artificial Sequence: Synthetic peptide
NGSGQNQ

SEQ ID NO: 546 - protein, 7 aa, Artificial Sequence
  Description of Artificial Sequence: Synthetic peptide
GNVNGTG

SEQ ID NO: 547 - protein, 7 aa, Artificial Sequence
  Description of Artificial Sequence: Synthetic peptide
ATGKSSL

SEQ ID NO: 548 - protein, 7 aa, Artificial Sequence
  Description of Artificial Sequence: Synthetic peptide
NQGTKVQ

SEQ ID NO: 549 - protein, 7 aa, Artificial Sequence
  Description of Artificial Sequence: Synthetic peptide
TATDKTY

SEQ ID NO: 550 - protein, 7 aa, Artificial Sequence
  Description of Artificial Sequence: Synthetic peptide
VTGKSQM

SEQ ID NO: 551 - protein, 7 aa, Artificial Sequence
  Description of Artificial Sequence: Synthetic peptide
SQVQKVG

SEQ ID NO: 552 - protein, 7 aa, Artificial Sequence
  Description of Artificial Sequence: Synthetic peptide
DPISAKN

SEQ ID NO: 553 - protein, 7 aa, Artificial Sequence
  Description of Artificial Sequence: Synthetic peptide
SRNNTTT

SEQ ID NO: 554 - protein, 7 aa, Artificial Sequence
  Description of Artificial Sequence: Synthetic peptide
EGSNKTL

SEQ ID NO: 555 - protein, 7 aa, Artificial Sequence
  Description of Artificial Sequence: Synthetic peptide
VAKSTTL

SEQ ID NO: 556 - protein, 7 aa, Artificial Sequence
  Description of Artificial Sequence: Synthetic peptide
SNGAPTR

SEQ ID NO: 557 - protein, 7 aa, Artificial Sequence
  Description of Artificial Sequence: Synthetic peptide
QGTNSQV

SEQ ID NO: 558 - protein, 7 aa, Artificial Sequence
  Description of Artificial Sequence: Synthetic peptide
YPPSKGS

SEQ ID NO: 559 - protein, 7 aa, Artificial Sequence
  Description of Artificial Sequence: Synthetic peptide
SGSGGSQ

SEQ ID NO: 560 - protein, 7 aa, Artificial Sequence
  Description of Artificial Sequence: Synthetic peptide
STTQGPT

SEQ ID NO: 561 - protein, 7 aa, Artificial Sequence
  Description of Artificial Sequence: Synthetic peptide
AVANVNT

SEQ ID NO: 562 - protein, 7 aa, Artificial Sequence
  Description of Artificial Sequence: Synthetic peptide
LGSQQSK

SEQ ID NO: 563 - protein, 7 aa, Artificial Sequence
  Description of Artificial Sequence: Synthetic peptide
TSDTRGM

SEQ ID NO: 564 - protein, 7 aa, Artificial Sequence
  Description of Artificial Sequence: Synthetic peptide
SNASPGS

SEQ ID NO: 565 - protein, 7 aa, Artificial Sequence
  Description of Artificial Sequence: Synthetic peptide
GSTGQSK

SEQ ID NO: 566 - protein, 7 aa, Artificial Sequence
  Description of Artificial Sequence: Synthetic peptide
KAQSSAG

SEQ ID NO: 567 - protein, 7 aa, Artificial Sequence
  Description of Artificial Sequence: Synthetic peptide
GVGSKGV

SEQ ID NO: 568 - protein, 7 aa, Artificial Sequence
  Description of Artificial Sequence: Synthetic peptide
SSGTANL

SEQ ID NO: 569 - protein, 7 aa, Artificial Sequence
  Description of Artificial Sequence: Synthetic peptide
VINGKSD

SEQ ID NO: 570 - protein, 7 aa, Artificial Sequence
  Description of Artificial Sequence: Synthetic peptide
QGRDPQS

SEQ ID NO: 571 - protein, 7 aa, Artificial Sequence
  Description of Artificial Sequence: Synthetic peptide
ALENPSK

SEQ ID NO: 572 - protein, 7 aa, Artificial Sequence
  Description of Artificial Sequence: Synthetic peptide
AGSGPQL

SEQ ID NO: 573 - protein, 7 aa, Artificial Sequence
  Description of Artificial Sequence: Synthetic peptide
EGTSSHT

SEQ ID NO: 574 - protein, 7 aa, Artificial Sequence
  Description of Artificial Sequence: Synthetic peptide
DTPSPIK

SEQ ID NO: 575 - protein, 7 aa, Artificial Sequence
  Description of Artificial Sequence: Synthetic peptide
LSTNKSV

SEQ ID NO: 576 - protein, 7 aa, Artificial Sequence
  Description of Artificial Sequence: Synthetic peptide
SIGSPSR

SEQ ID NO: 577 - protein, 7 aa, Artificial Sequence
  Description of Artificial Sequence: Synthetic peptide
TGNKTAS

SEQ ID NO: 578 - protein, 7 aa, Artificial Sequence
  Description of Artificial Sequence: Synthetic peptide
SHNSSTS

SEQ ID NO: 579 - protein, 7 aa, Artificial Sequence
  Description of Artificial Sequence: Synthetic peptide
SNSTHPA

SEQ ID NO: 580 - protein, 7 aa, Artificial Sequence
  Description of Artificial Sequence: Synthetic peptide
SQAVPSK

SEQ ID NO: 581 - protein, 7 aa, Artificial Sequence
  Description of Artificial Sequence: Synthetic peptide
QINNKTA

SEQ ID NO: 582 - protein, 7 aa, Artificial Sequence
  Description of Artificial Sequence: Synthetic peptide
TSGSGMK

SEQ ID NO: 583 - protein, 7 aa, Artificial Sequence
  Description of Artificial Sequence: Synthetic peptide
TGTKQLS

SEQ ID NO: 584 - protein, 7 aa, Artificial Sequence
  Description of Artificial Sequence: Synthetic peptide
TQGSNPP

SEQ ID NO: 585 - protein, 7 aa, Artificial Sequence
  Description of Artificial Sequence: Synthetic peptide
TQPSTHV

SEQ ID NO: 586 - protein, 7 aa, Artificial Sequence
  Description of Artificial Sequence: Synthetic peptide
ADSKPTS

SEQ ID NO: 587 - protein, 7 aa, Artificial Sequence
  Description of Artificial Sequence: Synthetic peptide
GNGREAS

SEQ ID NO: 588 - protein, 7 aa, Artificial Sequence
  Description of Artificial Sequence: Synthetic peptide
STSQKSV

SEQ ID NO: 589 - protein, 7 aa, Artificial Sequence
  Description of Artificial Sequence: Synthetic peptide
GTSPQVK

SEQ ID NO: 590 - protein, 7 aa, Artificial Sequence
  Description of Artificial Sequence: Synthetic peptide
TTGSHSA

SEQ ID NO: 591 - protein, 7 aa, Artificial Sequence
  Description of Artificial Sequence: Synthetic peptide
GTASGTR

SEQ ID NO: 592 - protein, 7 aa, Artificial Sequence
  Description of Artificial Sequence: Synthetic peptide
HNTSKQG

SEQ ID NO: 593 - protein, 7 aa, Artificial Sequence
  Description of Artificial Sequence: Synthetic peptide
DITQKSK

SEQ ID NO: 594 - protein, 7 aa, Artificial Sequence
  Description of Artificial Sequence: Synthetic peptide
VTRSNSV

SEQ ID NO: 595 - protein, 7 aa, Artificial Sequence
  Description of Artificial Sequence: Synthetic peptide
EGAKPAF

SEQ ID NO: 596 - protein, 7 aa, Artificial Sequence
  Description of Artificial Sequence: Synthetic peptide
AMSSGNK

SEQ ID NO: 597 - protein, 7 aa, Artificial Sequence
  Description of Artificial Sequence: Synthetic peptide
VANNGNA

SEQ ID NO: 598 - protein, 7 aa, Artificial Sequence
  Description of Artificial Sequence: Synthetic peptide
NSTSGTK

SEQ ID NO: 599 - protein, 7 aa, Artificial Sequence
  Description of Artificial Sequence: Synthetic peptide
GSGGGQS

SEQ ID NO: 600 - protein, 7 aa, Artificial Sequence
  Description of Artificial Sequence: Synthetic peptide
ATSGTSH

SEQ ID NO: 601 - protein, 7 aa, Artificial Sequence
  Description of Artificial Sequence: Synthetic peptide
GPSPQGK

SEQ ID NO: 602 - protein, 7 aa, Artificial Sequence
  Description of Artificial Sequence: Synthetic peptide
AGDSSGR

SEQ ID NO: 603 - protein, 7 aa, Artificial Sequence
  Description of Artificial Sequence: Synthetic peptide
TVSDTNK

SEQ ID NO: 604 - protein, 7 aa, Artificial Sequence
  Description of Artificial Sequence: Synthetic peptide
DNGKAQN

SEQ ID NO: 605 - protein, 7 aa, Artificial Sequence
  Description of Artificial Sequence: Synthetic peptide
QGERSLA

SEQ ID NO: 606 - protein, 7 aa, Artificial Sequence
  Description of Artificial Sequence: Synthetic peptide
SGENNRV

SEQ ID NO: 607 - protein, 7 aa, Artificial Sequence
  Description of Artificial Sequence: Synthetic peptide
LQNQKDG

SEQ ID NO: 608 - protein, 7 aa, Artificial Sequence
  Description of Artificial Sequence: Synthetic peptide
ASTGASK

SEQ ID NO: 609 - protein, 7 aa, Artificial Sequence
  Description of Artificial Sequence: Synthetic peptide
GSGKDRN

SEQ ID NO: 610 - protein, 7 aa, Artificial Sequence
  Description of Artificial Sequence: Synthetic peptide
GTGVSNK

SEQ ID NO: 611 - protein, 7 aa, Artificial Sequence
  Description of Artificial Sequence: Synthetic peptide
GNAAKPQ

SEQ ID NO: 612 - protein, 7 aa, Artificial Sequence
  Description of Artificial Sequence: Synthetic peptide
SGDSKRH

SEQ ID NO: 613 - protein, 7 aa, Artificial Sequence
  Description of Artificial Sequence: Synthetic peptide
TSTSKNT

SEQ ID NO: 614 - protein, 7 aa, Artificial Sequence
  Description of Artificial Sequence: Synthetic peptide
GSTGNNS

SEQ ID NO: 615 - protein, 7 aa, Artificial Sequence
  Description of Artificial Sequence: Synthetic peptide
SGSSGGR

SEQ ID NO: 616 - protein, 7 aa, Artificial Sequence
  Description of Artificial Sequence: Synthetic peptide
FGTKGGE

SEQ ID NO: 617 - protein, 7 aa, Artificial Sequence
  Description of Artificial Sequence: Synthetic peptide
STGVKPM

SEQ ID NO: 618 - protein, 7 aa, Artificial Sequence
  Description of Artificial Sequence: Synthetic peptide
NSVGKSG

SEQ ID NO: 619 - protein, 7 aa, Artificial Sequence
  Description of Artificial Sequence: Synthetic peptide
GIAGPKS

SEQ ID NO: 620 - protein, 7 aa, Artificial Sequence
  Description of Artificial Sequence: Synthetic peptide
SKPTSGG

SEQ ID NO: 621 - protein, 7 aa, Artificial Sequence
  Description of Artificial Sequence: Synthetic peptide
SASTKSV

SEQ ID NO: 622 - protein, 7 aa, Artificial Sequence
  Description of Artificial Sequence: Synthetic peptide
GTSQKPH

SEQ ID NO: 623 - protein, 7 aa, Artificial Sequence
  Description of Artificial Sequence: Synthetic peptide
GNGSPTS

SEQ ID NO: 624 - protein, 7 aa, Artificial Sequence
  Description of Artificial Sequence: Synthetic peptide
NSGATKN

SEQ ID NO: 625 - protein, 7 aa, Artificial Sequence
  Description of Artificial Sequence: Synthetic peptide
DTAQHNR

SEQ ID NO: 626 - protein, 7 aa, Artificial Sequence
  Description of Artificial Sequence: Synthetic peptide
QRTGSNS

SEQ ID NO: 627 - protein, 7 aa, Artificial Sequence
  Description of Artificial Sequence: Synthetic peptide
LKDSKPL

SEQ ID NO: 628 - protein, 7 aa, Artificial Sequence
  Description of Artificial Sequence: Synthetic peptide
SPTNSPH

SEQ ID NO: 629 - protein, 7 aa, Artificial Sequence
  Description of Artificial Sequence: Synthetic peptide
NGTQKSH

SEQ ID NO: 630 - protein, 7 aa, Artificial Sequence
  Description of Artificial Sequence: Synthetic peptide
TVGKPSS

SEQ ID NO: 631 - protein, 7 aa, Artificial Sequence
  Description of Artificial Sequence: Synthetic peptide
GRGESSK

SEQ ID NO: 632 - protein, 7 aa, Artificial Sequence
  Description of Artificial Sequence: Synthetic peptide
VTQSASK

SEQ ID NO: 633 - protein, 7 aa, Artificial Sequence
  Description of Artificial Sequence: Synthetic peptide
GNGTKTI

SEQ ID NO: 634 - protein, 7 aa, Artificial Sequence
  Description of Artificial Sequence: Synthetic peptide
VQQDPVR

SEQ ID NO: 635 - protein, 7 aa, Artificial Sequence
  Description of Artificial Sequence: Synthetic peptide
RRETTNT

SEQ ID NO: 636 - protein, 7 aa, Artificial Sequence
  Description of Artificial Sequence: Synthetic peptide
AGNNTHT

SEQ ID NO: 637 - protein, 7 aa, Artificial Sequence
  Description of Artificial Sequence: Synthetic peptide
SQNAPHN

SEQ ID NO: 638 - protein, 7 aa, Artificial Sequence
  Description of Artificial Sequence: Synthetic peptide
SLQPPSK

SEQ ID NO: 639 - protein, 7 aa, Artificial Sequence
  Description of Artificial Sequence: Synthetic peptide
RGDSRRE

SEQ ID NO: 640 - protein, 7 aa, Artificial Sequence
  Description of Artificial Sequence: Synthetic peptide
FGKGSNT

SEQ ID NO: 641 - protein, 7 aa, Artificial Sequence
  Description of Artificial Sequence: Synthetic peptide
APATKPS

SEQ ID NO: 642 - protein, 7 aa, Artificial Sequence
  Description of Artificial Sequence: Synthetic peptide
EPTGRNN

SEQ ID NO: 643 - protein, 7 aa, Artificial Sequence
  Description of Artificial Sequence: Synthetic peptide
LRSKEST

SEQ ID NO: 644 - protein, 7 aa, Artificial Sequence
  Description of Artificial Sequence: Synthetic peptide
DGAGKPT

SEQ ID NO: 645 - protein, 7 aa, Artificial Sequence
  Description of Artificial Sequence: Synthetic peptide
VQTGASK

SEQ ID NO: 646 - protein, 7 aa, Artificial Sequence
  Description of Artificial Sequence: Synthetic peptide
GASNGHG

SEQ ID NO: 647 - protein, 7 aa, Artificial Sequence
  Description of Artificial Sequence: Synthetic peptide
MDKPTVV

SEQ ID NO: 648 - protein, 7 aa, Artificial Sequence
  Description of Artificial Sequence: Synthetic peptide
DPQPTAK

SEQ ID NO: 649 - protein, 7 aa, Artificial Sequence
  Description of Artificial Sequence: Synthetic peptide
DSSPTLK

SEQ ID NO: 650 - protein, 7 aa, Artificial Sequence
  Description of Artificial Sequence: Synthetic peptide
GLRGQNT

SEQ ID NO: 651 - protein, 7 aa, Artificial Sequence
  Description of Artificial Sequence: Synthetic peptide
SASDRAS

SEQ ID NO: 652 - protein, 7 aa, Artificial Sequence
  Description of Artificial Sequence: Synthetic peptide
GTTGART

SEQ ID NO: 653 - protein, 7 aa, Artificial Sequence
  Description of Artificial Sequence: Synthetic peptide
DGTSSLR

SEQ ID NO: 654 - protein, 7 aa, Artificial Sequence
  Description of Artificial Sequence: Synthetic peptide
RDGASQA

SEQ ID NO: 655 - protein, 7 aa, Artificial Sequence
  Description of Artificial Sequence: Synthetic peptide
TGGSKAT

SEQ ID NO: 656 - protein, 7 aa, Artificial Sequence
  Description of Artificial Sequence: Synthetic peptide
MHDKATA

SEQ ID NO: 657 - protein, 7 aa, Artificial Sequence
  Description of Artificial Sequence: Synthetic peptide
GASSPRN

SEQ ID NO: 658 - protein, 7 aa, Artificial Sequence
  Description of Artificial Sequence: Synthetic peptide
SGNNNSK

SEQ ID NO: 659 - protein, 7 aa, Artificial Sequence
  Description of Artificial Sequence: Synthetic peptide
NGGRAPV

SEQ ID NO: 660 - protein, 7 aa, Artificial Sequence
  Description of Artificial Sequence: Synthetic peptide
STVASPK

SEQ ID NO: 661 - protein, 7 aa, Artificial Sequence
  Description of Artificial Sequence: Synthetic peptide
VNNGKPS

SEQ ID NO: 662 - protein, 7 aa, Artificial Sequence
  Description of Artificial Sequence: Synthetic peptide
GGVKHSD

SEQ ID NO: 663 - protein, 7 aa, Artificial Sequence
  Description of Artificial Sequence: Synthetic peptide
RNSQASG

SEQ ID NO: 664 - protein, 7 aa, Artificial Sequence
  Description of Artificial Sequence: Synthetic peptide
SNQSGSK

SEQ ID NO: 665 - protein, 7 aa, Artificial Sequence
  Description of Artificial Sequence: Synthetic peptide
AMNNKAE

SEQ ID NO: 666 - protein, 7 aa, Artificial Sequence
  Description of Artificial Sequence: Synthetic peptide
ASNNPRT

SEQ ID NO: 667 - protein, 7 aa, Artificial Sequence
  Description of Artificial Sequence: Synthetic peptide
EGQSPQS

SEQ ID NO: 668 - protein, 7 aa, Artificial Sequence
  Description of Artificial Sequence: Synthetic peptide
TGSGNSS

SEQ ID NO: 669 - protein, 7 aa, Artificial Sequence
  Description of Artificial Sequence: Synthetic peptide
SGSANLT

SEQ ID NO: 670 - protein, 7 aa, Artificial Sequence
  Description of Artificial Sequence: Synthetic peptide
MGQASNI

SEQ ID NO: 671 - protein, 7 aa, Artificial Sequence
  Description of Artificial Sequence: Synthetic peptide
LGNQSPK

SEQ ID NO: 672 - protein, 7 aa, Artificial Sequence
  Description of Artificial Sequence: Synthetic peptide
GSDRSSG

SEQ ID NO: 673 - protein, 7 aa, Artificial Sequence
  Description of Artificial Sequence: Synthetic peptide
VVNKASS

SEQ ID NO: 674 - protein, 7 aa, Artificial Sequence
  Description of Artificial Sequence: Synthetic peptide
TGRPSPT

SEQ ID NO: 675 - protein, 7 aa, Artificial Sequence
  Description of Artificial Sequence: Synthetic peptide
SSGDKRH

SEQ ID NO: 676 - protein, 7 aa, Artificial Sequence
  Description of Artificial Sequence: Synthetic peptide
DSAAKMS

SEQ ID NO: 677 - protein, 7 aa, Artificial Sequence
  Description of Artificial Sequence: Synthetic peptide
GTSTPVT

SEQ ID NO: 678 - protein, 7 aa, Artificial Sequence
  Description of Artificial Sequence: Synthetic peptide
TVGKVNS

SEQ ID NO: 679 - protein, 7 aa, Artificial Sequence
  Description of Artificial Sequence: Synthetic peptide
VGNSQPP

SEQ ID NO: 680 - protein, 7 aa, Artificial Sequence
  Description of Artificial Sequence: Synthetic peptide
TGVSKPV

SEQ ID NO: 681 - protein, 7 aa, Artificial Sequence
  Description of Artificial Sequence: Synthetic peptide
SEKTANS

SEQ ID NO: 682 - protein, 7 aa, Artificial Sequence
  Description of Artificial Sequence: Synthetic peptide
SSGTSAG

SEQ ID NO: 683 - protein, 7 aa, Artificial Sequence
  Description of Artificial Sequence: Synthetic peptide
GRSGTNA

SEQ ID NO: 684 - protein, 7 aa, Artificial Sequence
  Description of Artificial Sequence: Synthetic peptide
VAQSPTS

SEQ ID NO: 685 - protein, 7 aa, Artificial Sequence
  Description of Artificial Sequence: Synthetic peptide
HGSSSGK

SEQ ID NO: 686 - protein, 7 aa, Artificial Sequence
  Description of Artificial Sequence: Synthetic peptide
NPSGSTG

SEQ ID NO: 687 - protein, 7 aa, Artificial Sequence
  Description of Artificial Sequence: Synthetic peptide
QAENSRN

SEQ ID NO: 688 - protein, 7 aa, Artificial Sequence
  Description of Artificial Sequence: Synthetic peptide
TSSTNFS

SEQ ID NO: 689 - protein, 7 aa, Artificial Sequence
  Description of Artificial Sequence: Synthetic peptide
TGSQSSG

SEQ ID NO: 690 - protein, 7 aa, Artificial Sequence
  Description of Artificial Sequence: Synthetic peptide
SGVTKSS

SEQ ID NO: 691 - protein, 7 aa, Artificial Sequence
  Description of Artificial Sequence: Synthetic peptide
QGSKSVL

SEQ ID NO: 692 - protein, 7 aa, Artificial Sequence
  Description of Artificial Sequence: Synthetic peptide
AGASVNA

SEQ ID NO: 693 - protein, 7 aa, Artificial Sequence
  Description of Artificial Sequence: Synthetic peptide
SRDSPPK

SEQ ID NO: 694 - protein, 7 aa, Artificial Sequence
  Description of Artificial Sequence: Synthetic peptide
RSDNKAS

SEQ ID NO: 695 - protein, 7 aa, Artificial Sequence
  Description of Artificial Sequence: Synthetic peptide
QVQKSSS

SEQ ID NO: 696 - protein, 7 aa, Artificial Sequence
  Description of Artificial Sequence: Synthetic peptide
GSVTNSG

SEQ ID NO: 697 - protein, 7 aa, Artificial Sequence
  Description of Artificial Sequence: Synthetic peptide
GGASPSR

SEQ ID NO: 698 - protein, 7 aa, Artificial Sequence
  Description of Artificial Sequence: Synthetic peptide
LQANKSQ

SEQ ID NO: 699 - protein, 7 aa, Artificial Sequence
  Description of Artificial Sequence: Synthetic peptide
GRSGENS

SEQ ID NO: 700 - protein, 7 aa, Artificial Sequence
  Description of Artificial Sequence: Synthetic peptide
NESNRQS

SEQ ID NO: 701 - protein, 7 aa, Artificial Sequence
  Description of Artificial Sequence: Synthetic peptide
TIGKGGS

SEQ ID NO: 702 - protein, 7 aa, Artificial Sequence
  Description of Artificial Sequence: Synthetic peptide
GTGSGSR

SEQ ID NO: 703 - protein, 7 aa, Artificial Sequence
  Description of Artificial Sequence: Synthetic peptide
ISGSNSK

SEQ ID NO: 704 - protein, 7 aa, Artificial Sequence
  Description of Artificial Sequence: Synthetic peptide
ENSTAPK

SEQ ID NO: 705 - protein, 7 aa, Artificial Sequence
  Description of Artificial Sequence: Synthetic peptide
GGSGTMK

SEQ ID NO: 706 - protein, 7 aa, Artificial Sequence
  Description of Artificial Sequence: Synthetic peptide
AGASPNH

SEQ ID NO: 707 - protein, 7 aa, Artificial Sequence
  Description of Artificial Sequence: Synthetic peptide
DQSTKGS

SEQ ID NO: 708 - protein, 7 aa, Artificial Sequence
  Description of Artificial Sequence: Synthetic peptide
GDLTSTK

SEQ ID NO: 709 - protein, 7 aa, Artificial Sequence
  Description of Artificial Sequence: Synthetic peptide
AGKSTVN

SEQ ID NO: 710 - protein, 7 aa, Artificial Sequence
  Description of Artificial Sequence: Synthetic peptide
ATHAPQS

SEQ ID NO: 711 - protein, 7 aa, Artificial Sequence
  Description of Artificial Sequence: Synthetic peptide
ATKPSQG

SEQ ID NO: 712 - protein, 7 aa, Artificial Sequence
  Description of Artificial Sequence: Synthetic peptide
TDSGASK

SEQ ID NO: 713 - protein, 7 aa, Artificial Sequence
  Description of Artificial Sequence: Synthetic peptide
TTGSKGM

SEQ ID NO: 714 - protein, 7 aa, Artificial Sequence
  Description of Artificial Sequence: Synthetic peptide
TGANNLK

SEQ ID NO: 715 - protein, 7 aa, Artificial Sequence
  Description of Artificial Sequence: Synthetic peptide
SRSTKPE

SEQ ID NO: 716 - protein, 7 aa, Artificial Sequence
  Description of Artificial Sequence: Synthetic peptide
GSGGSKS

SEQ ID NO: 717 - protein, 7 aa, Artificial Sequence
  Description of Artificial Sequence: Synthetic peptide
TSGSPNS

SEQ ID NO: 718 - protein, 7 aa, Artificial Sequence
  Description of Artificial Sequence: Synthetic peptide
SMGKSAV

SEQ ID NO: 719 - protein, 7 aa, Artificial Sequence
  Description of Artificial Sequence: Synthetic peptide
SAAGSPT

SEQ ID NO: 720 - protein, 7 aa, Artificial Sequence
  Description of Artificial Sequence: Synthetic peptide
TQNSPNG

SEQ ID NO: 721 - protein, 7 aa, Artificial Sequence
  Description of Artificial Sequence: Synthetic peptide
SSSQKPS

SEQ ID NO: 722 - protein, 7 aa, Artificial Sequence
  Description of Artificial Sequence: Synthetic peptide
KGAPNNS

SEQ ID NO: 723 - protein, 7 aa, Artificial Sequence
  Description of Artificial Sequence: Synthetic peptide
TRDVKAG

SEQ ID NO: 724 - protein, 7 aa, Artificial Sequence
  Description of Artificial Sequence: Synthetic peptide
HRESKST

SEQ ID NO: 725 - protein, 7 aa, Artificial Sequence
  Description of Artificial Sequence: Synthetic peptide
GSDKNRG

SEQ ID NO: 726 - protein, 7 aa, Artificial Sequence
  Description of Artificial Sequence: Synthetic peptide
ISNKSSN

SEQ ID NO: 727 - protein, 7 aa, Artificial Sequence
  Description of Artificial Sequence: Synthetic peptide
GNSGPSK

SEQ ID NO: 728 - protein, 7 aa, Artificial Sequence
  Description of Artificial Sequence: Synthetic peptide
QGNDRKV

SEQ ID NO: 729 - protein, 7 aa, Artificial Sequence
  Description of Artificial Sequence: Synthetic peptide
APDTKPT

SEQ ID NO: 730 - protein, 7 aa, Artificial Sequence
  Description of Artificial Sequence: Synthetic peptide
QGKTGSV

SEQ ID NO: 731 - protein, 7 aa, Artificial Sequence
  Description of Artificial Sequence: Synthetic peptide
ANTTASV

SEQ ID NO: 732 - protein, 7 aa, Artificial Sequence
  Description of Artificial Sequence: Synthetic peptide
TNSSSHM

SEQ ID NO: 733 - protein, 7 aa, Artificial Sequence
  Description of Artificial Sequence: Synthetic peptide
GAGREGA

SEQ ID NO: 734 - protein, 7 aa, Artificial Sequence
  Description of Artificial Sequence: Synthetic peptide
DSSTRPL

SEQ ID NO: 735 - protein, 7 aa, Artificial Sequence
  Description of Artificial Sequence: Synthetic peptide
TPGSKTM

SEQ ID NO: 736 - protein, 7 aa, Artificial Sequence
  Description of Artificial Sequence: Synthetic peptide
ESATKSS

SEQ ID NO: 737 - protein, 7 aa, Artificial Sequence
  Description of Artificial Sequence: Synthetic peptide
NQDAKQY

SEQ ID NO: 738 - protein, 7 aa, Artificial Sequence
  Description of Artificial Sequence: Synthetic peptide
SVGNSNK

SEQ ID NO: 739 - protein, 7 aa, Artificial Sequence
  Description of Artificial Sequence: Synthetic peptide
SQGDKTT

SEQ ID NO: 740 - protein, 7 aa, Artificial Sequence
  Description of Artificial Sequence: Synthetic peptide
NRNGTSG

SEQ ID NO: 741 - protein, 7 aa, Artificial Sequence
  Description of Artificial Sequence: Synthetic peptide
QSSGKGG

SEQ ID NO: 742 - protein, 7 aa, Artificial Sequence
  Description of Artificial Sequence: Synthetic peptide
GASQKTV

SEQ ID NO: 743 - protein, 7 aa, Artificial Sequence
  Description of Artificial Sequence: Synthetic peptide
NGTTTGG

SEQ ID NO: 744 - protein, 7 aa, Artificial Sequence
  Description of Artificial Sequence: Synthetic peptide
VPSKTST

SEQ ID NO: 745 - protein, 7 aa, Artificial Sequence
  Description of Artificial Sequence: Synthetic peptide
TPSNRTE

SEQ ID NO: 746 - protein, 7 aa, Artificial Sequence
  Description of Artificial Sequence: Synthetic peptide
GRDKGTG

SEQ ID NO: 747 - protein, 7 aa, Artificial Sequence
  Description of Artificial Sequence: Synthetic peptide
TSPGKPV

SEQ ID NO: 748 - protein, 7 aa, Artificial Sequence
  Description of Artificial Sequence: Synthetic peptide
GRTNEPK

SEQ ID NO: 749 - protein, 7 aa, Artificial Sequence
  Description of Artificial Sequence: Synthetic peptide
GSSSPIK

SEQ ID NO: 750 - protein, 7 aa, Artificial Sequence
  Description of Artificial Sequence: Synthetic peptide
TQAVKSI

SEQ ID NO: 751 - protein, 7 aa, Artificial Sequence
  Description of Artificial Sequence: Synthetic peptide
SSGSGAG

SEQ ID NO: 752 - protein, 7 aa, Artificial Sequence
  Description of Artificial Sequence: Synthetic peptide
QTTPASG

SEQ ID NO: 753 - protein, 7 aa, Artificial Sequence
  Description of Artificial Sequence: Synthetic peptide
QAQTDKS

SEQ ID NO: 754 - protein, 7 aa, Artificial Sequence
  Description of Artificial Sequence: Synthetic peptide
HNNSKER

SEQ ID NO: 755 - protein, 7 aa, Artificial Sequence
  Description of Artificial Sequence: Synthetic peptide
AHGSNPQ

SEQ ID NO: 756 - protein, 7 aa, Artificial Sequence
  Description of Artificial Sequence: Synthetic peptide
GTENAGR

SEQ ID NO: 757 - protein, 7 aa, Artificial Sequence
  Description of Artificial Sequence: Synthetic peptide
GPSTSGA

SEQ ID NO: 758 - protein, 7 aa, Artificial Sequence
  Description of Artificial Sequence: Synthetic peptide
QNKSVAS

SEQ ID NO: 759 - protein, 7 aa, Artificial Sequence
  Description of Artificial Sequence: Synthetic peptide
GNQKPPT

SEQ ID NO: 760 - protein, 7 aa, Artificial Sequence
  Description of Artificial Sequence: Synthetic peptide
SAHVKGS

SEQ ID NO: 761 - protein, 7 aa, Artificial Sequence
  Description of Artificial Sequence: Synthetic peptide
GVATSAS

SEQ ID NO: 762 - protein, 7 aa, Artificial Sequence
  Description of Artificial Sequence: Synthetic peptide
SGHSPVN

SEQ ID NO: 763 - protein, 7 aa, Artificial Sequence
  Description of Artificial Sequence: Synthetic peptide
SNDSARK

SEQ ID NO: 764 - protein, 7 aa, Artificial Sequence
  Description of Artificial Sequence: Synthetic peptide
NASTKAL

SEQ ID NO: 765 - protein, 7 aa, Artificial Sequence
  Description of Artificial Sequence: Synthetic peptide
TNMKPSS

SEQ ID NO: 766 - protein, 7 aa, Artificial Sequence
  Description of Artificial Sequence: Synthetic peptide
ASAQVSK

SEQ ID NO: 767 - protein, 7 aa, Artificial Sequence
  Description of Artificial Sequence: Synthetic peptide
GTSKSAA

SEQ ID NO: 768 - protein, 7 aa, Artificial Sequence
  Description of Artificial Sequence: Synthetic peptide
TPDSKGK

SEQ ID NO: 769 - protein, 7 aa, Artificial Sequence
  Description of Artificial Sequence: Synthetic peptide
QQNSDTK

SEQ ID NO: 770 - protein, 7 aa, Artificial Sequence
  Description of Artificial Sequence: Synthetic peptide
DRSPGTA

SEQ ID NO: 771 - protein, 7 aa, Artificial Sequence
  Description of Artificial Sequence: Synthetic peptide
AGGGGVN

SEQ ID NO: 772 - protein, 7 aa, Artificial Sequence
  Description of Artificial Sequence: Synthetic peptide
LTQKQSG

SEQ ID NO: 773 - protein, 7 aa, Artificial Sequence
  Description of Artificial Sequence: Synthetic peptide
ERSTSSA

SEQ ID NO: 774 - protein, 7 aa, Artificial Sequence
  Description of Artificial Sequence: Synthetic peptide
HRGDSQA

SEQ ID NO: 775 - protein, 7 aa, Artificial Sequence
  Description of Artificial Sequence: Synthetic peptide
NSHTTPQ

SEQ ID NO: 776 - protein, 7 aa, Artificial Sequence
  Description of Artificial Sequence: Synthetic peptide
GTNTPRA

SEQ ID NO: 777 - protein, 7 aa, Artificial Sequence
  Description of Artificial Sequence: Synthetic peptide
GGVQSSK

SEQ ID NO: 778 - protein, 7 aa, Artificial Sequence
  Description of Artificial Sequence: Synthetic peptide
GSNRSSE

SEQ ID NO: 779 - protein, 7 aa, Artificial Sequence
  Description of Artificial Sequence: Synthetic peptide
DRATSAQ

SEQ ID NO: 780 - protein, 7 aa, Artificial Sequence
  Description of Artificial Sequence: Synthetic peptide
NQSGTKG

SEQ ID NO: 781 - protein, 7 aa, Artificial Sequence
  Description of Artificial Sequence: Synthetic peptide
SGSGPTR

SEQ ID NO: 782 - protein, 7 aa, Artificial Sequence
  Description of Artificial Sequence: Synthetic peptide
SQTKSLT

SEQ ID NO: 783 - protein, 7 aa, Artificial Sequence
  Description of Artificial Sequence: Synthetic peptide
QSKPGGS

SEQ ID NO: 784 - protein, 7 aa, Artificial Sequence
  Description of Artificial Sequence: Synthetic peptide
QAVPTAG

SEQ ID NO: 785 - protein, 7 aa, Artificial Sequence
  Description of Artificial Sequence: Synthetic peptide
SGTEVIK

SEQ ID NO: 786 - protein, 7 aa, Artificial Sequence
  Description of Artificial Sequence: Synthetic peptide
SLTKPQT

SEQ ID NO: 787 - protein, 7 aa, Artificial Sequence
  Description of Artificial Sequence: Synthetic peptide
HGERTNN

SEQ ID NO: 788 - protein, 7 aa, Artificial Sequence
  Description of Artificial Sequence: Synthetic peptide
GNNKTLM

SEQ ID NO: 789 - protein, 7 aa, Artificial Sequence
  Description of Artificial Sequence: Synthetic peptide
TTGEKRP

SEQ ID NO: 790 - protein, 7 aa, Artificial Sequence
  Description of Artificial Sequence: Synthetic peptide
EMISKSK

SEQ ID NO: 791 - protein, 7 aa, Artificial Sequence
  Description of Artificial Sequence: Synthetic peptide
EHRSPSI

SEQ ID NO: 792 - protein, 7 aa, Artificial Sequence
  Description of Artificial Sequence: Synthetic peptide
GLETRAQ

SEQ ID NO: 793 - protein, 7 aa, Artificial Sequence
  Description of Artificial Sequence: Synthetic peptide
TGVSPVA

SEQ ID NO: 794 - protein, 7 aa, Artificial Sequence
  Description of Artificial Sequence: Synthetic peptide
SSTSSAS

SEQ ID NO: 795 - protein, 7 aa, Artificial Sequence
  Description of Artificial Sequence: Synthetic peptide
SGNAKSN

SEQ ID NO: 796 - protein, 7 aa, Artificial Sequence
  Description of Artificial Sequence: Synthetic peptide
GVASPRS

SEQ ID NO: 797 - protein, 7 aa, Artificial Sequence
  Description of Artificial Sequence: Synthetic peptide
GPLATVK

SEQ ID NO: 798 - protein, 7 aa, Artificial Sequence
  Description of Artificial Sequence: Synthetic peptide
SPTSQNN

SEQ ID NO: 799 - protein, 7 aa, Artificial Sequence
  Description of Artificial Sequence: Synthetic peptide
QGKAQQA

SEQ ID NO: 800 - protein, 7 aa, Artificial Sequence
  Description of Artificial Sequence: Synthetic peptide
GTASQNS

SEQ ID NO: 801 - protein, 7 aa, Artificial Sequence
  Description of Artificial Sequence: Synthetic peptide
NSASSSS

SEQ ID NO: 802 - protein, 7 aa, Artificial Sequence
  Description of Artificial Sequence: Synthetic peptide
LATKGSA

SEQ ID NO: 803 - protein, 7 aa, Artificial Sequence
  Description of Artificial Sequence: Synthetic peptide
GRDHKTS

SEQ ID NO: 804 - protein, 7 aa, Artificial Sequence
  Description of Artificial Sequence: Synthetic peptide
GSPGTSN

SEQ ID NO: 805 - protein, 7 aa, Artificial Sequence
  Description of Artificial Sequence: Synthetic peptide
RSDGNKG

SEQ ID NO: 806 - protein, 7 aa, Artificial Sequence
  Description of Artificial Sequence: Synthetic peptide
TSQRDHA

SEQ ID NO: 807 - protein, 7 aa, Artificial Sequence
  Description of Artificial Sequence: Synthetic peptide
GVPKDKG

SEQ ID NO: 808 - protein, 7 aa, Artificial Sequence
  Description of Artificial Sequence: Synthetic peptide
VGTKSQG

SEQ ID NO: 809 - protein, 7 aa, Artificial Sequence
  Description of Artificial Sequence: Synthetic peptide
EANSRST

SEQ ID NO: 810 - protein, 7 aa, Artificial Sequence
  Description of Artificial Sequence: Synthetic peptide
TVSTPSS

SEQ ID NO: 811 - protein, 7 aa, Artificial Sequence
  Description of Artificial Sequence: Synthetic peptide
GTNSPPR

SEQ ID NO: 812 - protein, 7 aa, Artificial Sequence
  Description of Artificial Sequence: Synthetic peptide
GPQGENR

SEQ ID NO: 813 - protein, 7 aa, Artificial Sequence
  Description of Artificial Sequence: Synthetic peptide
DQAKGGR

SEQ ID NO: 814 - protein, 7 aa, Artificial Sequence
  Description of Artificial Sequence: Synthetic peptide
SQRSPGT

SEQ ID NO: 815 - protein, 7 aa, Artificial Sequence
  Description of Artificial Sequence: Synthetic peptide
TTNTKAT

SEQ ID NO: 816 - protein, 7 aa, Artificial Sequence
  Description of Artificial Sequence: Synthetic peptide
DGVGGRG

SEQ ID NO: 817 - protein, 7 aa, Artificial Sequence
  Description of Artificial Sequence: Synthetic peptide
GPTNSVK

SEQ ID NO: 818 - protein, 7 aa, Artificial Sequence
  Description of Artificial Sequence: Synthetic peptide
TPVNSPH

SEQ ID NO: 819 - protein, 7 aa, Artificial Sequence
  Description of Artificial Sequence: Synthetic peptide
RGSGSSS

SEQ ID NO: 820 - protein, 7 aa, Artificial Sequence
  Description of Artificial Sequence: Synthetic peptide
LHSDKTT

SEQ ID NO: 821 - protein, 7 aa, Artificial Sequence
  Description of Artificial Sequence: Synthetic peptide
TSHDKIR

SEQ ID NO: 822 - protein, 7 aa, Artificial Sequence
  Description of Artificial Sequence: Synthetic peptide
SVEGKNR

SEQ ID NO: 823 - protein, 7 aa, Artificial Sequence
  Description of Artificial Sequence: Synthetic peptide
GTSVKAT

SEQ ID NO: 824 - protein, 7 aa, Artificial Sequence
  Description of Artificial Sequence: Synthetic peptide
SNTNASV

SEQ ID NO: 825 - protein, 7 aa, Artificial Sequence
  Description of Artificial Sequence: Synthetic peptide
ANSSKVV

SEQ ID NO: 826 - protein, 7 aa, Artificial Sequence
  Description of Artificial Sequence: Synthetic peptide
HNSSTSS

SEQ ID NO: 827 - protein, 7 aa, Artificial Sequence
  Description of Artificial Sequence: Synthetic peptide
NDGKNSL

SEQ ID NO: 828 - protein, 7 aa, Artificial Sequence
  Description of Artificial Sequence: Synthetic peptide
TGQNGSA

SEQ ID NO: 829 - protein, 7 aa, Artificial Sequence
  Description of Artificial Sequence: Synthetic peptide
GHAESSK

SEQ ID NO: 830 - protein, 7 aa, Artificial Sequence
  Description of Artificial Sequence: Synthetic peptide
SAGGKPA

SEQ ID NO: 831 - protein, 7 aa, Artificial Sequence
  Description of Artificial Sequence: Synthetic peptide
TQSKSAM

SEQ ID NO: 832 - protein, 7 aa, Artificial Sequence
  Description of Artificial Sequence: Synthetic peptide
HTHSPTQ

SEQ ID NO: 833 - protein, 7 aa, Artificial Sequence
  Description of Artificial Sequence: Synthetic peptide
TNNKQAL

SEQ ID NO: 834 - protein, 7 aa, Artificial Sequence
  Description of Artificial Sequence: Synthetic peptide
SSTSKTV

SEQ ID NO: 835 - protein, 7 aa, Artificial Sequence
  Description of Artificial Sequence: Synthetic peptide
TQESKYG

SEQ ID NO: 836 - protein, 7 aa, Artificial Sequence
  Description of Artificial Sequence: Synthetic peptide
GLTGKSS

SEQ ID NO: 837 - protein, 7 aa, Artificial Sequence
  Description of Artificial Sequence: Synthetic peptide
NGVPPNQ

SEQ ID NO: 838 - protein, 7 aa, Artificial Sequence
  Description of Artificial Sequence: Synthetic peptide
RDGNNAT

SEQ ID NO: 839 - protein, 7 aa, Artificial Sequence
  Description of Artificial Sequence: Synthetic peptide
STATASS

SEQ ID NO: 840 - protein, 7 aa, Artificial Sequence
  Description of Artificial Sequence: Synthetic peptide
SMTKTNV

SEQ ID NO: 841 - protein, 7 aa, Artificial Sequence
  Description of Artificial Sequence: Synthetic peptide
SGKSVNN

SEQ ID NO: 842 - protein, 7 aa, Artificial Sequence
  Description of Artificial Sequence: Synthetic peptide
HINGKSQ

SEQ ID NO: 843 - protein, 7 aa, Artificial Sequence
  Description of Artificial Sequence: Synthetic peptide
GASSKEK

SEQ ID NO: 844 - protein, 7 aa, Artificial Sequence
  Description of Artificial Sequence: Synthetic peptide
SSPQSTG

SEQ ID NO: 845 - protein, 7 aa, Artificial Sequence
  Description of Artificial Sequence: Synthetic peptide
ASAKSST

SEQ ID NO: 846 - protein, 7 aa, Artificial Sequence
  Description of Artificial Sequence: Synthetic peptide
NQATALS

SEQ ID NO: 847 - protein, 7 aa, Artificial Sequence
  Description of Artificial Sequence: Synthetic peptide
QVTKTNN

SEQ ID NO: 848 - protein, 7 aa, Artificial Sequence
  Description of Artificial Sequence: Synthetic peptide
QQNSKLV

SEQ ID NO: 849 - protein, 7 aa, Artificial Sequence
  Description of Artificial Sequence: Synthetic peptide
AAGAKSG

SEQ ID NO: 850 - protein, 7 aa, Artificial Sequence
  Description of Artificial Sequence: Synthetic peptide
NPSNKNN

SEQ ID NO: 851 - protein, 7 aa, Artificial Sequence
  Description of Artificial Sequence: Synthetic peptide
SASRDKA

SEQ ID NO: 852 - protein, 7 aa, Artificial Sequence
  Description of Artificial Sequence: Synthetic peptide
TASNTPS

SEQ ID NO: 853 - protein, 7 aa, Artificial Sequence
  Description of Artificial Sequence: Synthetic peptide
TPSQKGT

SEQ ID NO: 854 - protein, 7 aa, Artificial Sequence
  Description of Artificial Sequence: Synthetic peptide
VTNTKSH

SEQ ID NO: 855 - protein, 7 aa, Artificial Sequence
  Description of Artificial Sequence: Synthetic peptide
NTSSKPT

SEQ ID NO: 856 - protein, 7 aa, Artificial Sequence
  Description of Artificial Sequence: Synthetic peptide
SMSQKSG

SEQ ID NO: 857 - protein, 7 aa, Artificial Sequence
  Description of Artificial Sequence: Synthetic peptide
NSGKTLI

SEQ ID NO: 858 - protein, 7 aa, Artificial Sequence
  Description of Artificial Sequence: Synthetic peptide
GASTKTV

SEQ ID NO: 859 - protein, 7 aa, Artificial Sequence
  Description of Artificial Sequence: Synthetic peptide
SIASKPT

SEQ ID NO: 860 - protein, 7 aa, Artificial Sequence
  Description of Artificial Sequence: Synthetic peptide
QTASSSK

SEQ ID NO: 861 - protein, 7 aa, Artificial Sequence
  Description of Artificial Sequence: Synthetic peptide
SSDAKPI

SEQ ID NO: 862 - protein, 7 aa, Artificial Sequence
  Description of Artificial Sequence: Synthetic peptide
NGSGQNK

SEQ ID NO: 863 - protein, 7 aa, Artificial Sequence
  Description of Artificial Sequence: Synthetic peptide
STAKATG

SEQ ID NO: 864 - protein, 7 aa, Artificial Sequence
  Description of Artificial Sequence: Synthetic peptide
MPDQKAS

SEQ ID NO: 865 - protein, 7 aa, Artificial Sequence
  Description of Artificial Sequence: Synthetic peptide
DGTLSSK

SEQ ID NO: 866 - protein, 7 aa, Artificial Sequence
  Description of Artificial Sequence: Synthetic peptide
SDSSKSQ

SEQ ID NO: 867 - protein, 7 aa, Artificial Sequence
  Description of Artificial Sequence: Synthetic peptide
HQKSGGS

SEQ ID NO: 868 - protein, 7 aa, Artificial Sequence
  Description of Artificial Sequence: Synthetic peptide
DGSPRSV

SEQ ID NO: 869 - protein, 7 aa, Artificial Sequence
  Description of Artificial Sequence: Synthetic peptide
SPVTHGK

SEQ ID NO: 870 - protein, 7 aa, Artificial Sequence
  Description of Artificial Sequence: Synthetic peptide
QIADKNH

SEQ ID NO: 871 - protein, 7 aa, Artificial Sequence
  Description of Artificial Sequence: Synthetic peptide
TAGKANS

SEQ ID NO: 872 - protein, 7 aa, Artificial Sequence
  Description of Artificial Sequence: Synthetic peptide
NLRDAPK

SEQ ID NO: 873 - protein, 7 aa, Artificial Sequence
  Description of Artificial Sequence: Synthetic peptide
AHESKAS

SEQ ID NO: 874 - protein, 7 aa, Artificial Sequence
  Description of Artificial Sequence: Synthetic peptide
TGGHSTN

SEQ ID NO: 875 - protein, 7 aa, Artificial Sequence
  Description of Artificial Sequence: Synthetic peptide
SVGKDRN

SEQ ID NO: 876 - protein, 7 aa, Artificial Sequence
  Description of Artificial Sequence: Synthetic peptide
NANKSLT

SEQ ID NO: 877 - protein, 7 aa, Artificial Sequence
  Description of Artificial Sequence: Synthetic peptide
SQNGAHR

SEQ ID NO: 878 - protein, 7 aa, Artificial Sequence
  Description of Artificial Sequence: Synthetic peptide
HSGKSTT

SEQ ID NO: 879 - protein, 7 aa, Artificial Sequence
  Description of Artificial Sequence: Synthetic peptide
NLSKTDQ

SEQ ID NO: 880 - protein, 7 aa, Artificial Sequence
  Description of Artificial Sequence: Synthetic peptide
DVSASPK

SEQ ID NO: 881 - protein, 7 aa, Artificial Sequence
  Description of Artificial Sequence: Synthetic peptide
TSLKGTN

SEQ ID NO: 882 - protein, 7 aa, Artificial Sequence
  Description of Artificial Sequence: Synthetic peptide
QADSKPV

SEQ ID NO: 883 - protein, 7 aa, Artificial Sequence
  Description of Artificial Sequence: Synthetic peptide
AKSNTNS

SEQ ID NO: 884 - protein, 7 aa, Artificial Sequence
  Description of Artificial Sequence: Synthetic peptide
GGSKANS

SEQ ID NO: 885 - protein, 7 aa, Artificial Sequence
  Description of Artificial Sequence: Synthetic peptide
GGAKGQA

SEQ ID NO: 886 - protein, 7 aa, Artificial Sequence
  Description of Artificial Sequence: Synthetic peptide
SNEKPLV

SEQ ID NO: 887 - protein, 7 aa, Artificial Sequence
  Description of Artificial Sequence: Synthetic peptide
QNHSKQD

SEQ ID NO: 888 - protein, 7 aa, Artificial Sequence
  Description of Artificial Sequence: Synthetic peptide
SGGSGIH

SEQ ID NO: 889 - protein, 7 aa, Artificial Sequence
  Description of Artificial Sequence: Synthetic peptide
AGTKQPN

SEQ ID NO: 890 - protein, 7 aa, Artificial Sequence
  Description of Artificial Sequence: Synthetic peptide
SNATGTS

SEQ ID NO: 891 - protein, 7 aa, Artificial Sequence
  Description of Artificial Sequence: Synthetic peptide
TRDQSHS

SEQ ID NO: 892 - protein, 7 aa, Artificial Sequence
  Description of Artificial Sequence: Synthetic peptide
SNSPANT

SEQ ID NO: 893 - protein, 7 aa, Artificial Sequence
  Description of Artificial Sequence: Synthetic peptide
KNETKTI

SEQ ID NO: 894 - protein, 7 aa, Artificial Sequence
  Description of Artificial Sequence: Synthetic peptide
GPTSKQS

SEQ ID NO: 895 - protein, 7 aa, Artificial Sequence
  Description of Artificial Sequence: Synthetic peptide
STSTSSR

SEQ ID NO: 896 - protein, 7 aa, Artificial Sequence
  Description of Artificial Sequence: Synthetic peptide
QDSPQPR

SEQ ID NO: 897 - protein, 7 aa, Artificial Sequence
  Description of Artificial Sequence: Synthetic peptide
GNSGKMF

SEQ ID NO: 898 - protein, 7 aa, Artificial Sequence
  Description of Artificial Sequence: Synthetic peptide
GIRSPSE

SEQ ID NO: 899 - protein, 7 aa, Artificial Sequence
  Description of Artificial Sequence: Synthetic peptide
NSSSKSS

SEQ ID NO: 900 - protein, 7 aa, Artificial Sequence
  Description of Artificial Sequence: Synthetic peptide
SPSGKGL

SEQ ID NO: 901 - protein, 7 aa, Artificial Sequence
  Description of Artificial Sequence: Synthetic peptide
STDKARV

SEQ ID NO: 902 - protein, 7 aa, Artificial Sequence
  Description of Artificial Sequence: Synthetic peptide
RSEASVK

SEQ ID NO: 903 - protein, 7 aa, Artificial Sequence
  Description of Artificial Sequence: Synthetic peptide
DNSSVNK

SEQ ID NO: 904 - protein, 7 aa, Artificial Sequence
  Description of Artificial Sequence: Synthetic peptide
SSTVKPV

SEQ ID NO: 905 - protein, 7 aa, Artificial Sequence
  Description of Artificial Sequence: Synthetic peptide
MGVKPDL

SEQ ID NO: 906 - protein, 7 aa, Artificial Sequence
  Description of Artificial Sequence: Synthetic peptide
TNQKTAA

SEQ ID NO: 907 - protein, 7 aa, Artificial Sequence
  Description of Artificial Sequence: Synthetic peptide
GTGNKHA

SEQ ID NO: 908 - protein, 7 aa, Artificial Sequence
  Description of Artificial Sequence: Synthetic peptide
GLNNSSG

SEQ ID NO: 909 - protein, 7 aa, Artificial Sequence
  Description of Artificial Sequence: Synthetic peptide
GREAPTR

SEQ ID NO: 910 - protein, 7 aa, Artificial Sequence
  Description of Artificial Sequence: Synthetic peptide
STLKPIQ

SEQ ID NO: 911 - protein, 7 aa, Artificial Sequence
  Description of Artificial Sequence: Synthetic peptide
SSAQAVS

SEQ ID NO: 912 - protein, 7 aa, Artificial Sequence
  Description of Artificial Sequence: Synthetic peptide
DGLKGQS

SEQ ID NO: 913 - protein, 7 aa, Artificial Sequence
  Description of Artificial Sequence: Synthetic peptide
VAGTSQS

SEQ ID NO: 914 - protein, 7 aa, Artificial Sequence
  Description of Artificial Sequence: Synthetic peptide
HATQAST

SEQ ID NO: 915 - protein, 7 aa, Artificial Sequence
  Description of Artificial Sequence: Synthetic peptide
TQGSRNS

SEQ ID NO: 916 - protein, 7 aa, Artificial Sequence
  Description of Artificial Sequence: Synthetic peptide
TTSGQSK

SEQ ID NO: 917 - protein, 7 aa, Artificial Sequence
  Description of Artificial Sequence: Synthetic peptide
AAAGSTK

SEQ ID NO: 918 - protein, 7 aa, Artificial Sequence
  Description of Artificial Sequence: Synthetic peptide
LSTQTSS

SEQ ID NO: 919 - protein, 7 aa, Artificial Sequence
  Description of Artificial Sequence: Synthetic peptide
NAQGTPV

SEQ ID NO: 920 - protein, 7 aa, Artificial Sequence
  Description of Artificial Sequence: Synthetic peptide
SSGSKQS

SEQ ID NO: 921 - protein, 7 aa, Artificial Sequence
  Description of Artificial Sequence: Synthetic peptide
TGGAPTT

SEQ ID NO: 922 - protein, 7 aa, Artificial Sequence
  Description of Artificial Sequence: Synthetic peptide
RGTSQQA

SEQ ID NO: 923 - protein, 7 aa, Artificial Sequence
  Description of Artificial Sequence: Synthetic peptide
IGTGKAQ

SEQ ID NO: 924 - protein, 7 aa, Artificial Sequence
  Description of Artificial Sequence: Synthetic peptide
AGSKETR

SEQ ID NO: 925 - protein, 7 aa, Artificial Sequence
  Description of Artificial Sequence: Synthetic peptide
GQASPQK

SEQ ID NO: 926 - protein, 7 aa, Artificial Sequence
  Description of Artificial Sequence: Synthetic peptide
SSDSHPT

SEQ ID NO: 927 - protein, 7 aa, Artificial Sequence
  Description of Artificial Sequence: Synthetic peptide
TNTGKPL

SEQ ID NO: 928 - protein, 7 aa, Artificial Sequence
  Description of Artificial Sequence: Synthetic peptide
VVQKPAE

SEQ ID NO: 929 - protein, 7 aa, Artificial Sequence
  Description of Artificial Sequence: Synthetic peptide
SPGSGSQ

SEQ ID NO: 930 - protein, 7 aa, Artificial Sequence
  Description of Artificial Sequence: Synthetic peptide
LGTQKTV

SEQ ID NO: 931 - protein, 7 aa, Artificial Sequence
  Description of Artificial Sequence: Synthetic peptide
SGQSGVK

SEQ ID NO: 932 - protein, 7 aa, Artificial Sequence
  Description of Artificial Sequence: Synthetic peptide
ASTSTQA

SEQ ID NO: 933 - protein, 7 aa, Artificial Sequence
  Description of Artificial Sequence: Synthetic peptide
GMAGSSQ

SEQ ID NO: 934 - protein, 7 aa, Artificial Sequence
  Description of Artificial Sequence: Synthetic peptide
TKSTTPI

SEQ ID NO: 935 - protein, 7 aa, Artificial Sequence
  Description of Artificial Sequence: Synthetic peptide
TSGNNPM

SEQ ID NO: 936 - protein, 7 aa, Artificial Sequence
  Description of Artificial Sequence: Synthetic peptide
DNIQKAN

SEQ ID NO: 937 - protein, 7 aa, Artificial Sequence
  Description of Artificial Sequence: Synthetic peptide
TSDRVQG

SEQ ID NO: 938 - protein, 7 aa, Artificial Sequence
  Description of Artificial Sequence: Synthetic peptide
DGLSKPT

SEQ ID NO: 939 - protein, 7 aa, Artificial Sequence
  Description of Artificial Sequence: Synthetic peptide
GHNSPTL

SEQ ID NO: 940 - protein, 7 aa, Artificial Sequence
  Description of Artificial Sequence: Synthetic peptide
TSSQRSS

SEQ ID NO: 941 - protein, 7 aa, Artificial Sequence
  Description of Artificial Sequence: Synthetic peptide
AQATPHV

SEQ ID NO: 942 - protein, 7 aa, Artificial Sequence
  Description of Artificial Sequence: Synthetic peptide
AKSTVNT

SEQ ID NO: 943 - protein, 7 aa, Artificial Sequence
  Description of Artificial Sequence: Synthetic peptide
MNGSGAH

SEQ ID NO: 944 - protein, 7 aa, Artificial Sequence
  Description of Artificial Sequence: Synthetic peptide
QNAAKNP

SEQ ID NO: 945 - protein, 7 aa, Artificial Sequence
  Description of Artificial Sequence: Synthetic peptide
MASNPRE

SEQ ID NO: 946 - protein, 7 aa, Artificial Sequence
  Description of Artificial Sequence: Synthetic peptide
QSNTVSS

SEQ ID NO: 947 - protein, 7 aa, Artificial Sequence
  Description of Artificial Sequence: Synthetic peptide
DSSPTHR

SEQ ID NO: 948 - protein, 7 aa, Artificial Sequence
  Description of Artificial Sequence: Synthetic peptide
NGTSERR

SEQ ID NO: 949 - protein, 7 aa, Artificial Sequence
  Description of Artificial Sequence: Synthetic peptide
AASDGRN

SEQ ID NO: 950 - protein, 7 aa, Artificial Sequence
  Description of Artificial Sequence: Synthetic peptide
EISSPGR

SEQ ID NO: 951 - protein, 7 aa, Artificial Sequence
  Description of Artificial Sequence: Synthetic peptide
SGQERAT

SEQ ID NO: 952 - protein, 7 aa, Artificial Sequence
  Description of Artificial Sequence: Synthetic peptide
TQNGGGN

SEQ ID NO: 953 - protein, 7 aa, Artificial Sequence
  Description of Artificial Sequence: Synthetic peptide
SRSGSSS

SEQ ID NO: 954 - protein, 7 aa, Artificial Sequence
  Description of Artificial Sequence: Synthetic peptide
QTKPTTT

SEQ ID NO: 955 - protein, 7 aa, Artificial Sequence
  Description of Artificial Sequence: Synthetic peptide
DTVPPSK

SEQ ID NO: 956 - protein, 7 aa, Artificial Sequence
  Description of Artificial Sequence: Synthetic peptide
DGRQAGV

SEQ ID NO: 957 - protein, 7 aa, Artificial Sequence
  Description of Artificial Sequence: Synthetic peptide
VGPNNQS

SEQ ID NO: 958 - protein, 7 aa, Artificial Sequence
  Description of Artificial Sequence: Synthetic peptide
RNSGNQG

SEQ ID NO: 959 - protein, 7 aa, Artificial Sequence
  Description of Artificial Sequence: Synthetic peptide
GVNNKAG

SEQ ID NO: 960 - protein, 7 aa, Artificial Sequence
  Description of Artificial Sequence: Synthetic peptide
QPNGQIK

SEQ ID NO: 961 - protein, 7 aa, Artificial Sequence
  Description of Artificial Sequence: Synthetic peptide
NLSTSGG

SEQ ID NO: 962 - protein, 7 aa, Artificial Sequence
  Description of Artificial Sequence: Synthetic peptide
QHTKTPS

SEQ ID NO: 963 - protein, 7 aa, Artificial Sequence
  Description of Artificial Sequence: Synthetic peptide
DAGNKAR

SEQ ID NO: 964 - protein, 7 aa, Artificial Sequence
  Description of Artificial Sequence: Synthetic peptide
TTSAKVQ

SEQ ID NO: 965 - protein, 7 aa, Artificial Sequence
  Description of Artificial Sequence: Synthetic peptide
SHSTKST

SEQ ID NO: 966 - protein, 7 aa, Artificial Sequence
  Description of Artificial Sequence: Synthetic peptide
ANAGKLS

SEQ ID NO: 967 - protein, 7 aa, Artificial Sequence
  Description of Artificial Sequence: Synthetic peptide
YGSKDLS

SEQ ID NO: 968 - protein, 7 aa, Artificial Sequence
  Description of Artificial Sequence: Synthetic peptide
SNKSSGG

SEQ ID NO: 969 - protein, 7 aa, Artificial Sequence
  Description of Artificial Sequence: Synthetic peptide
NNANKSV

SEQ ID NO: 970 - protein, 7 aa, Artificial Sequence
  Description of Artificial Sequence: Synthetic peptide
TSSKSAV

SEQ ID NO: 971 - protein, 7 aa, Artificial Sequence
  Description of Artificial Sequence: Synthetic peptide
SNAGSMQ

SEQ ID NO: 972 - protein, 7 aa, Artificial Sequence
  Description of Artificial Sequence: Synthetic peptide
GVAKSSS

SEQ ID NO: 973 - protein, 7 aa, Artificial Sequence
  Description of Artificial Sequence: Synthetic peptide
TKVGTPV

SEQ ID NO: 974 - protein, 7 aa, Artificial Sequence
  Description of Artificial Sequence: Synthetic peptide
GTSSKPL

SEQ ID NO: 975 - protein, 7 aa, Artificial Sequence
  Description of Artificial Sequence: Synthetic peptide
STSSSNL

SEQ ID NO: 976 - protein, 7 aa, Artificial Sequence
  Description of Artificial Sequence: Synthetic peptide
SPSKSGT

SEQ ID NO: 977 - protein, 7 aa, Artificial Sequence
  Description of Artificial Sequence: Synthetic peptide
NNNTSNV

SEQ ID NO: 978 - protein, 7 aa, Artificial Sequence
  Description of Artificial Sequence: Synthetic peptide
DNGSSRQ

SEQ ID NO: 979 - protein, 7 aa, Artificial Sequence
  Description of Artificial Sequence: Synthetic peptide
SNDPPSK

SEQ ID NO: 980 - protein, 7 aa, Artificial Sequence
  Description of Artificial Sequence: Synthetic peptide
QGSQSAM

SEQ ID NO: 981 - protein, 7 aa, Artificial Sequence
  Description of Artificial Sequence: Synthetic peptide
NTDKPAV

SEQ ID NO: 982 - protein, 7 aa, Artificial Sequence
  Description of Artificial Sequence: Synthetic peptide
RSDGSPR

SEQ ID NO: 983 - protein, 7 aa, Artificial Sequence
  Description of Artificial Sequence: Synthetic peptide
MGNSSSV

SEQ ID NO: 984 - protein, 7 aa, Artificial Sequence
  Description of Artificial Sequence: Synthetic peptide
KIGASSA

SEQ ID NO: 985 - protein, 7 aa, Artificial Sequence
  Description of Artificial Sequence: Synthetic peptide
TTSNSTK

SEQ ID NO: 986 - protein, 7 aa, Artificial Sequence
  Description of Artificial Sequence: Synthetic peptide
SRNTSNT

SEQ ID NO: 987 - protein, 7 aa, Artificial Sequence
  Description of Artificial Sequence: Synthetic peptide
HSTEKQR

SEQ ID NO: 988 - protein, 7 aa, Artificial Sequence
  Description of Artificial Sequence: Synthetic peptide
DRPGNGG

SEQ ID NO: 989 - protein, 7 aa, Artificial Sequence
  Description of Artificial Sequence: Synthetic peptide
SGLKPTV

SEQ ID NO: 990 - protein, 7 aa, Artificial Sequence
  Description of Artificial Sequence: Synthetic peptide
KGQGSTV

SEQ ID NO: 991 - protein, 7 aa, Artificial Sequence
  Description of Artificial Sequence: Synthetic peptide
QTTPSSQ

SEQ ID NO: 992 - protein, 7 aa, Artificial Sequence
  Description of Artificial Sequence: Synthetic peptide
AHGQVPQ

SEQ ID NO: 993 - protein, 7 aa, Artificial Sequence
  Description of Artificial Sequence: Synthetic peptide
ETGHKAA

SEQ ID NO: 994 - protein, 7 aa, Artificial Sequence
  Description of Artificial Sequence: Synthetic peptide
TKAQSPL

SEQ ID NO: 995 - protein, 7 aa, Artificial Sequence
  Description of Artificial Sequence: Synthetic peptide
NSSTKTP

SEQ ID NO: 996 - protein, 7 aa, Artificial Sequence
  Description of Artificial Sequence: Synthetic peptide
ATTGDSK

SEQ ID NO: 997 - protein, 7 aa, Artificial Sequence
  Description of Artificial Sequence: Synthetic peptide
AGTTNAH

SEQ ID NO: 998 - protein, 7 aa, Artificial Sequence
  Description of Artificial Sequence: Synthetic peptide
VNGKPNA

SEQ ID NO: 999 - protein, 7 aa, Artificial Sequence
  Description of Artificial Sequence: Synthetic peptide
HSATPNK

SEQ ID NO: 1000 - protein, 7 aa, Artificial Sequence
  Description of Artificial Sequence: Synthetic peptide
SNGQKPP

SEQ ID NO: 1001 - protein, 7 aa, Artificial Sequence
  Description of Artificial Sequence: Synthetic peptide
LGNKDQA

SEQ ID NO: 1002 - protein, 7 aa, Artificial Sequence
  Description of Artificial Sequence: Synthetic peptide
VQGTHTQ

SEQ ID NO: 1003 - protein, 7 aa, Artificial Sequence
  Description of Artificial Sequence: Synthetic peptide
DVHVKNQ

SEQ ID NO: 1004 - protein, 7 aa, Artificial Sequence
  Description of Artificial Sequence: Synthetic peptide
ATTKSST

SEQ ID NO: 1005 - protein, 7 aa, Artificial Sequence
  Description of Artificial Sequence: Synthetic peptide
STATSSH

SEQ ID NO: 1006 - protein, 7 aa, Artificial Sequence
  Description of Artificial Sequence: Synthetic peptide
VSQPSVA

SEQ ID NO: 1007 - protein, 7 aa, Artificial Sequence
  Description of Artificial Sequence: Synthetic peptide
SSNGHGS

SEQ ID NO: 1008 - protein, 7 aa, Artificial Sequence
  Description of Artificial Sequence: Synthetic peptide
ASNTGST

SEQ ID NO: 1009 - protein, 7 aa, Artificial Sequence
  Description of Artificial Sequence: Synthetic peptide
TGASNQK

SEQ ID NO: 1010 - protein, 7 aa, Artificial Sequence
  Description of Artificial Sequence: Synthetic peptide
SSDTNHA

SEQ ID NO: 1011 - protein, 7 aa, Artificial Sequence
  Description of Artificial Sequence: Synthetic peptide
SMGKSSV

SEQ ID NO: 1012 - protein, 7 aa, Artificial Sequence
  Description of Artificial Sequence: Synthetic peptide
LNNGKAT

SEQ ID NO: 1013 - protein, 7 aa, Artificial Sequence
  Description of Artificial Sequence: Synthetic peptide
QAGRDSQ

SEQ ID NO: 1014 - protein, 7 aa, Artificial Sequence
  Description of Artificial Sequence: Synthetic peptide
TPAQKSQ

SEQ ID NO: 1015 - protein, 7 aa, Artificial Sequence
  Description of Artificial Sequence: Synthetic peptide
QNVKPSV

SEQ ID NO: 1016 - protein, 7 aa, Artificial Sequence
  Description of Artificial Sequence: Synthetic peptide
LGNSGTN

SEQ ID NO: 1017 - protein, 7 aa, Artificial Sequence
  Description of Artificial Sequence: Synthetic peptide
EGMKPSL

SEQ ID NO: 1018 - protein, 7 aa, Artificial Sequence
  Description of Artificial Sequence: Synthetic peptide
GGGHSPK

SEQ ID NO: 1019 - protein, 7 aa, Artificial Sequence
  Description of Artificial Sequence: Synthetic peptide
THQTTSA

SEQ ID NO: 1020 - protein, 7 aa, Artificial Sequence
  Description of Artificial Sequence: Synthetic peptide
VTTSSPK

SEQ ID NO: 1021 - protein, 7 aa, Artificial Sequence
  Description of Artificial Sequence: Synthetic peptide
GADSPGR

SEQ ID NO: 1022 - protein, 7 aa, Artificial Sequence
  Description of Artificial Sequence: Synthetic peptide
QHDAKMA

SEQ ID NO: 1023 - protein, 7 aa, Artificial Sequence
  Description of Artificial Sequence: Synthetic peptide
RTGAESR

SEQ ID NO: 1024 - protein, 7 aa, Artificial Sequence
  Description of Artificial Sequence: Synthetic peptide
RNGASSG

SEQ ID NO: 1025 - protein, 7 aa, Artificial Sequence
  Description of Artificial Sequence: Synthetic peptide
GAETKPS

SEQ ID NO: 1026 - protein, 7 aa, Artificial Sequence
  Description of Artificial Sequence: Synthetic peptide
SQGNKTL

SEQ ID NO: 1027 - protein, 7 aa, Artificial Sequence
  Description of Artificial Sequence: Synthetic peptide
HSATKSS

SEQ ID NO: 1028 - protein, 7 aa, Artificial Sequence
  Description of Artificial Sequence: Synthetic peptide
SSASVAK

SEQ ID NO: 1029 - protein, 7 aa, Artificial Sequence
  Description of Artificial Sequence: Synthetic peptide
TSQSGHH

SEQ ID NO: 1030 - protein, 7 aa, Artificial Sequence
  Description of Artificial Sequence: Synthetic peptide
GTTSHAS

SEQ ID NO: 1031 - protein, 7 aa, Artificial Sequence
  Description of Artificial Sequence: Synthetic peptide
QTTSPSK

SEQ ID NO: 1032 - protein, 7 aa, Artificial Sequence
  Description of Artificial Sequence: Synthetic peptide
SANRPGV

SEQ ID NO: 1033 - protein, 7 aa, Artificial Sequence
  Description of Artificial Sequence: Synthetic peptide
SASTKSL

SEQ ID NO: 1034 - protein, 7 aa, Artificial Sequence
  Description of Artificial Sequence: Synthetic peptide
ANGVKLQ

SEQ ID NO: 1035 - protein, 7 aa, Artificial Sequence
  Description of Artificial Sequence: Synthetic peptide
LQSSKPT

SEQ ID NO: 1036 - protein, 7 aa, Artificial Sequence
  Description of Artificial Sequence: Synthetic peptide
GTATPVK

SEQ ID NO: 1037 - protein, 7 aa, Artificial Sequence
  Description of Artificial Sequence: Synthetic peptide
GNSGQSR

SEQ ID NO: 1038 - protein, 7 aa, Artificial Sequence
  Description of Artificial Sequence: Synthetic peptide
LNGEKIS

SEQ ID NO: 1039 - protein, 7 aa, Artificial Sequence
  Description of Artificial Sequence: Synthetic peptide
NRDGSTT

SEQ ID NO: 1040 - protein, 7 aa, Artificial Sequence
  Description of Artificial Sequence: Synthetic peptide
MGKSSAQ

SEQ ID NO: 1041 - protein, 7 aa, Artificial Sequence
  Description of Artificial Sequence: Synthetic peptide
VSQSPVK

SEQ ID NO: 1042 - protein, 7 aa, Artificial Sequence
  Description of Artificial Sequence: Synthetic peptide
SVGEAQK

SEQ ID NO: 1043 - protein, 7 aa, Artificial Sequence
  Description of Artificial Sequence: Synthetic peptide
DKTQPHK

SEQ ID NO: 1044 - protein, 7 aa, Artificial Sequence
  Description of Artificial Sequence: Synthetic peptide
GAGSKPI

SEQ ID NO: 1045 - protein, 7 aa, Artificial Sequence
  Description of Artificial Sequence: Synthetic peptide
NQQGNGG

SEQ ID NO: 1046 - protein, 7 aa, Artificial Sequence
  Description of Artificial Sequence: Synthetic peptide
TINNKHS

SEQ ID NO: 1047 - protein, 7 aa, Artificial Sequence
  Description of Artificial Sequence: Synthetic peptide
SGGSPSV

SEQ ID NO: 1048 - protein, 7 aa, Artificial Sequence
  Description of Artificial Sequence: Synthetic peptide
GTSAPAR

SEQ ID NO: 1049 - protein, 7 aa, Artificial Sequence
  Description of Artificial Sequence: Synthetic peptide
SASHSPV

SEQ ID NO: 1050 - protein, 7 aa, Artificial Sequence
  Description of Artificial Sequence: Synthetic peptide
QNSPSMS

SEQ ID NO: 1051 - protein, 7 aa, Artificial Sequence
  Description of Artificial Sequence: Synthetic peptide
LPQNPTS

SEQ ID NO: 1052 - protein, 7 aa, Artificial Sequence
  Description of Artificial Sequence: Synthetic peptide
QRTETNV

SEQ ID NO: 1053 - protein, 7 aa, Artificial Sequence
  Description of Artificial Sequence: Synthetic peptide
GLGKAAA

SEQ ID NO: 1054 - protein, 7 aa, Artificial Sequence
  Description of Artificial Sequence: Synthetic peptide
SSASKPL

SEQ ID NO: 1055 - protein, 7 aa, Artificial Sequence
  Description of Artificial Sequence: Synthetic peptide
QSSGKAS

SEQ ID NO: 1056 - protein, 7 aa, Artificial Sequence
  Description of Artificial Sequence: Synthetic peptide
WGSKNDN

SEQ ID NO: 1057 - protein, 7 aa, Artificial Sequence
  Description of Artificial Sequence: Synthetic peptide
DGHTKQS

SEQ ID NO: 1058 - protein, 7 aa, Artificial Sequence
  Description of Artificial Sequence: Synthetic peptide
VPNSRTT

SEQ ID NO: 1059 - protein, 7 aa, Artificial Sequence
  Description of Artificial Sequence: Synthetic peptide
NTSQKAS

SEQ ID NO: 1060 - protein, 7 aa, Artificial Sequence
  Description of Artificial Sequence: Synthetic peptide
SGQSSHS

SEQ ID NO: 1061 - protein, 7 aa, Artificial Sequence
  Description of Artificial Sequence: Synthetic peptide
AGLKSTQ

SEQ ID NO: 1062 - protein, 7 aa, Artificial Sequence
  Description of Artificial Sequence: Synthetic peptide
GGVKPFT

SEQ ID NO: 1063 - protein, 7 aa, Artificial Sequence
  Description of Artificial Sequence: Synthetic peptide
GVEARST

SEQ ID NO: 1064 - protein, 7 aa, Artificial Sequence
  Description of Artificial Sequence: Synthetic peptide
ERNKVTT

SEQ ID NO: 1065 - protein, 7 aa, Artificial Sequence
  Description of Artificial Sequence: Synthetic peptide
TAAQSGG

SEQ ID NO: 1066 - protein, 7 aa, Artificial Sequence
  Description of Artificial Sequence: Synthetic peptide
SLESKPA

SEQ ID NO: 1067 - protein, 7 aa, Artificial Sequence
  Description of Artificial Sequence: Synthetic peptide
SGDRQQA

SEQ ID NO: 1068 - protein, 7 aa, Artificial Sequence
  Description of Artificial Sequence: Synthetic peptide
HKTTSAN

SEQ ID NO: 1069 - protein, 7 aa, Artificial Sequence
  Description of Artificial Sequence: Synthetic peptide
LEGQSNR

SEQ ID NO: 1070 - protein, 7 aa, Artificial Sequence
  Description of Artificial Sequence: Synthetic peptide
LAGNQKE

SEQ ID NO: 1071 - protein, 7 aa, Artificial Sequence
  Description of Artificial Sequence: Synthetic peptide
DPKGSSS

SEQ ID NO: 1072 - protein, 7 aa, Artificial Sequence
  Description of Artificial Sequence: Synthetic peptide
ALHQKAG

SEQ ID NO: 1073 - protein, 7 aa, Artificial Sequence
  Description of Artificial Sequence: Synthetic peptide
SLNKPIQ

SEQ ID NO: 1074 - protein, 7 aa, Artificial Sequence
  Description of Artificial Sequence: Synthetic peptide
AASPPNK

SEQ ID NO: 1075 - protein, 7 aa, Artificial Sequence
  Description of Artificial Sequence: Synthetic peptide
LGVSNSG

SEQ ID NO: 1076 - protein, 7 aa, Artificial Sequence
  Description of Artificial Sequence: Synthetic peptide
MNSKAQA

SEQ ID NO: 1077 - protein, 7 aa, Artificial Sequence
  Description of Artificial Sequence: Synthetic peptide
NSSSKVS

SEQ ID NO: 1078 - protein, 7 aa, Artificial Sequence
  Description of Artificial Sequence: Synthetic peptide
TQTKVNL

SEQ ID NO: 1079 - protein, 7 aa, Artificial Sequence
  Description of Artificial Sequence: Synthetic peptide
RMGDQSG

SEQ ID NO: 1080 - protein, 7 aa, Artificial Sequence
  Description of Artificial Sequence: Synthetic peptide
LPNSNQA

SEQ ID NO: 1081 - protein, 7 aa, Artificial Sequence
  Description of Artificial Sequence: Synthetic peptide
TQGKTVG

SEQ ID NO: 1082 - protein, 7 aa, Artificial Sequence
  Description of Artificial Sequence: Synthetic peptide
TQSKELR

SEQ ID NO: 1083 - protein, 7 aa, Artificial Sequence
  Description of Artificial Sequence: Synthetic peptide
SSGKSAT

SEQ ID NO: 1084 - protein, 7 aa, Artificial Sequence
  Description of Artificial Sequence: Synthetic peptide
VGSSPQV

SEQ ID NO: 1085 - protein, 7 aa, Artificial Sequence
  Description of Artificial Sequence: Synthetic peptide
SKSNSVN

SEQ ID NO: 1086 - protein, 7 aa, Artificial Sequence
  Description of Artificial Sequence: Synthetic peptide
NDRKDQQ

SEQ ID NO: 1087 - protein, 7 aa, Artificial Sequence
  Description of Artificial Sequence: Synthetic peptide
TPSAKVS

SEQ ID NO: 1088 - protein, 7 aa, Artificial Sequence
  Description of Artificial Sequence: Synthetic peptide
SRAKQGE

SEQ ID NO: 1089 - protein, 7 aa, Artificial Sequence
  Description of Artificial Sequence: Synthetic peptide
HSAPNNG

SEQ ID NO: 1090 - protein, 7 aa, Artificial Sequence
  Description of Artificial Sequence: Synthetic peptide
SGVTSPA

SEQ ID NO: 1091 - protein, 7 aa, Artificial Sequence
  Description of Artificial Sequence: Synthetic peptide
MGSNGQK

SEQ ID NO: 1092 - protein, 7 aa, Artificial Sequence
  Description of Artificial Sequence: Synthetic peptide
ATQSPSL

SEQ ID NO: 1093 - protein, 7 aa, Artificial Sequence
  Description of Artificial Sequence: Synthetic peptide
GSETRAA

SEQ ID NO: 1094 - protein, 7 aa, Artificial Sequence
  Description of Artificial Sequence: Synthetic peptide
NTSTTSR

SEQ ID NO: 1095 - protein, 7 aa, Artificial Sequence
  Description of Artificial Sequence: Synthetic peptide
SVHSKSV

SEQ ID NO: 1096 - protein, 7 aa, Artificial Sequence
  Description of Artificial Sequence: Synthetic peptide
TLGNPSR

SEQ ID NO: 1097 - protein, 7 aa, Artificial Sequence
  Description of Artificial Sequence: Synthetic peptide
SRSGTPV

SEQ ID NO: 1098 - protein, 7 aa, Artificial Sequence
  Description of Artificial Sequence: Synthetic peptide
TSSSPSV

SEQ ID NO: 1099 - protein, 7 aa, Artificial Sequence
  Description of Artificial Sequence: Synthetic peptide
SNATKPT

SEQ ID NO: 1100 - protein, 7 aa, Artificial Sequence
  Description of Artificial Sequence: Synthetic peptide
AGKSSQT

SEQ ID NO: 1101 - protein, 7 aa, Artificial Sequence
  Description of Artificial Sequence: Synthetic peptide
NSTSGGG

SEQ ID NO: 1102 - protein, 7 aa, Artificial Sequence
  Description of Artificial Sequence: Synthetic peptide
SSRSTQA

SEQ ID NO: 1103 - protein, 7 aa, Artificial Sequence
  Description of Artificial Sequence: Synthetic peptide
KSNERTT

SEQ ID NO: 1104 - protein, 7 aa, Artificial Sequence
  Description of Artificial Sequence: Synthetic peptide
SRGPTTV

SEQ ID NO: 1105 - protein, 7 aa, Artificial Sequence
  Description of Artificial Sequence: Synthetic peptide
SGVSKQG

SEQ ID NO: 1106 - protein, 7 aa, Artificial Sequence
  Description of Artificial Sequence: Synthetic peptide
QSQNAGS

SEQ ID NO: 1107 - protein, 7 aa, Artificial Sequence
  Description of Artificial Sequence: Synthetic peptide
VATSKSS

SEQ ID NO: 1108 - protein, 7 aa, Artificial Sequence
  Description of Artificial Sequence: Synthetic peptide
RGSTSST

SEQ ID NO: 1109 - protein, 7 aa, Artificial Sequence
  Description of Artificial Sequence: Synthetic peptide
APAGDRV

SEQ ID NO: 1110 - protein, 7 aa, Artificial Sequence
  Description of Artificial Sequence: Synthetic peptide
GGLDSHK

SEQ ID NO: 1111 - protein, 7 aa, Artificial Sequence
  Description of Artificial Sequence: Synthetic peptide
VHDGKGK

SEQ ID NO: 1112 - protein, 7 aa, Artificial Sequence
  Description of Artificial Sequence: Synthetic peptide
GNTNPAK

SEQ ID NO: 1113 - protein, 7 aa, Artificial Sequence
  Description of Artificial Sequence: Synthetic peptide
SRSTGNQ

SEQ ID NO: 1114 - protein, 7 aa, Artificial Sequence
  Description of Artificial Sequence: Synthetic peptide
GSANSPK

SEQ ID NO: 1115 - protein, 7 aa, Artificial Sequence
  Description of Artificial Sequence: Synthetic peptide
NNNNKAS

SEQ ID NO: 1116 - protein, 7 aa, Artificial Sequence
  Description of Artificial Sequence: Synthetic peptide
RSASPTV

SEQ ID NO: 1117 - protein, 7 aa, Artificial Sequence
  Description of Artificial Sequence: Synthetic peptide
ASTGPRD

SEQ ID NO: 1118 - protein, 7 aa, Artificial Sequence
  Description of Artificial Sequence: Synthetic peptide
FGNSSSA

SEQ ID NO: 1119 - protein, 7 aa, Artificial Sequence
  Description of Artificial Sequence: Synthetic peptide
VQQAAPS

SEQ ID NO: 1120 - protein, 7 aa, Artificial Sequence
  Description of Artificial Sequence: Synthetic peptide
DSSSRGH

SEQ ID NO: 1121 - protein, 7 aa, Artificial Sequence
  Description of Artificial Sequence: Synthetic peptide
GLDSKMT

SEQ ID NO: 1122 - protein, 7 aa, Artificial Sequence
  Description of Artificial Sequence: Synthetic peptide
NPAGGSA

SEQ ID NO: 1123 - protein, 7 aa, Artificial Sequence
  Description of Artificial Sequence: Synthetic peptide
GSNSTKA

SEQ ID NO: 1124 - protein, 7 aa, Artificial Sequence
  Description of Artificial Sequence: Synthetic peptide
STTKPLS

SEQ ID NO: 1125 - protein, 7 aa, Artificial Sequence
  Description of Artificial Sequence: Synthetic peptide
ASSSGMV

SEQ ID NO: 1126 - protein, 7 aa, Artificial Sequence
  Description of Artificial Sequence: Synthetic peptide
SSQKTSQ

SEQ ID NO: 1127 - protein, 7 aa, Artificial Sequence
  Description of Artificial Sequence: Synthetic peptide
GSTSPAQ

SEQ ID NO: 1128 - protein, 7 aa, Artificial Sequence
  Description of Artificial Sequence: Synthetic peptide
VAGQSAV

SEQ ID NO: 1129 - protein, 7 aa, Artificial Sequence
  Description of Artificial Sequence: Synthetic peptide
STTKGPE

SEQ ID NO: 1130 - protein, 7 aa, Artificial Sequence
  Description of Artificial Sequence: Synthetic peptide
RSDNGNR

SEQ ID NO: 1131 - protein, 7 aa, Artificial Sequence
  Description of Artificial Sequence: Synthetic peptide
SVGTPTS

SEQ ID NO: 1132 - protein, 7 aa, Artificial Sequence
  Description of Artificial Sequence: Synthetic peptide
TAHGKPV

SEQ ID NO: 1133 - protein, 7 aa, Artificial Sequence
  Description of Artificial Sequence: Synthetic peptide
TSTSKVA

SEQ ID NO: 1134 - protein, 7 aa, Artificial Sequence
  Description of Artificial Sequence: Synthetic peptide
NISKSNS

SEQ ID NO: 1135 - protein, 7 aa, Artificial Sequence
  Description of Artificial Sequence: Synthetic peptide
SVGKAAA

SEQ ID NO: 1136 - protein, 7 aa, Artificial Sequence
  Description of Artificial Sequence: Synthetic peptide
DPSDVKR

SEQ ID NO: 1137 - protein, 7 aa, Artificial Sequence
  Description of Artificial Sequence: Synthetic peptide
VVTKPST

SEQ ID NO: 1138 - protein, 7 aa, Artificial Sequence
  Description of Artificial Sequence: Synthetic peptide
SNTASPV

SEQ ID NO: 1139 - protein, 7 aa, Artificial Sequence
  Description of Artificial Sequence: Synthetic peptide
MPAKSSV

SEQ ID NO: 1140 - protein, 7 aa, Artificial Sequence
  Description of Artificial Sequence: Synthetic peptide
DNGKGQL

SEQ ID NO: 1141 - protein, 7 aa, Artificial Sequence
  Description of Artificial Sequence: Synthetic peptide
GHTDKTT

SEQ ID NO: 1142 - protein, 7 aa, Artificial Sequence
  Description of Artificial Sequence: Synthetic peptide
DLREKPA

SEQ ID NO: 1143 - protein, 7 aa, Artificial Sequence
  Description of Artificial Sequence: Synthetic peptide
SGGSGHT

SEQ ID NO: 1144 - protein, 7 aa, Artificial Sequence
  Description of Artificial Sequence: Synthetic peptide
NVTSKAM

SEQ ID NO: 1145 - protein, 7 aa, Artificial Sequence
  Description of Artificial Sequence: Synthetic peptide
NVSPTQA

SEQ ID NO: 1146 - protein, 7 aa, Artificial Sequence
  Description of Artificial Sequence: Synthetic peptide
ERSSATS

SEQ ID NO: 1147 - protein, 7 aa, Artificial Sequence
  Description of Artificial Sequence: Synthetic peptide
GTSENKG

SEQ ID NO: 1148 - protein, 7 aa, Artificial Sequence
  Description of Artificial Sequence: Synthetic peptide
SRGGSSG

SEQ ID NO: 1149 - protein, 7 aa, Artificial Sequence
  Description of Artificial Sequence: Synthetic peptide
QNSKSAV

SEQ ID NO: 1150 - protein, 7 aa, Artificial Sequence
  Description of Artificial Sequence: Synthetic peptide
TTSPNHQ

SEQ ID NO: 1151 - protein, 7 aa, Artificial Sequence
  Description of Artificial Sequence: Synthetic peptide
NPGGRNG

SEQ ID NO: 1152 - protein, 7 aa, Artificial Sequence
  Description of Artificial Sequence: Synthetic peptide
TNSSNPA

SEQ ID NO: 1153 - protein, 7 aa, Artificial Sequence
  Description of Artificial Sequence: Synthetic peptide
LDSVKSR

SEQ ID NO: 1154 - protein, 7 aa, Artificial Sequence
  Description of Artificial Sequence: Synthetic peptide
GRTEPHT

SEQ ID NO: 1155 - protein, 7 aa, Artificial Sequence
  Description of Artificial Sequence: Synthetic peptide
DSAVRGN

SEQ ID NO: 1156 - protein, 7 aa, Artificial Sequence
  Description of Artificial Sequence: Synthetic peptide
IATKVGS

SEQ ID NO: 1157 - protein, 7 aa, Artificial Sequence
  Description of Artificial Sequence: Synthetic peptide
LGASKNG

SEQ ID NO: 1158 - protein, 7 aa, Artificial Sequence
  Description of Artificial Sequence: Synthetic peptide
DRQVGTT

SEQ ID NO: 1159 - protein, 7 aa, Artificial Sequence
  Description of Artificial Sequence: Synthetic peptide
DTGTARG

SEQ ID NO: 1160 - protein, 7 aa, Artificial Sequence
  Description of Artificial Sequence: Synthetic peptide
RQSDKSV

SEQ ID NO: 1161 - protein, 7 aa, Artificial Sequence
  Description of Artificial Sequence: Synthetic peptide
TGVASNV

SEQ ID NO: 1162 - protein, 7 aa, Artificial Sequence
  Description of Artificial Sequence: Synthetic peptide
LADTPRT

SEQ ID NO: 1163 - protein, 7 aa, Artificial Sequence
  Description of Artificial Sequence: Synthetic peptide
MSSKVST

SEQ ID NO: 1164 - protein, 7 aa, Artificial Sequence
  Description of Artificial Sequence: Synthetic peptide
SNNSKPQ

SEQ ID NO: 1165 - protein, 7 aa, Artificial Sequence
  Description of Artificial Sequence: Synthetic peptide
GTENARG

SEQ ID NO: 1166 - protein, 7 aa, Artificial Sequence
  Description of Artificial Sequence: Synthetic peptide
LGNSSPA

SEQ ID NO: 1167 - protein, 7 aa, Artificial Sequence
  Description of Artificial Sequence: Synthetic peptide
RSESKIT

SEQ ID NO: 1168 - protein, 7 aa, Artificial Sequence
  Description of Artificial Sequence: Synthetic peptide
ASESRNV

SEQ ID NO: 1169 - protein, 7 aa, Artificial Sequence
  Description of Artificial Sequence: Synthetic peptide
GSTEGLR

SEQ ID NO: 1170 - protein, 7 aa, Artificial Sequence
  Description of Artificial Sequence: Synthetic peptide
SSLPSKG

SEQ ID NO: 1171 - protein, 7 aa, Artificial Sequence
  Description of Artificial Sequence: Synthetic peptide
TDRKDDR

SEQ ID NO: 1172 - protein, 7 aa, Artificial Sequence
  Description of Artificial Sequence: Synthetic peptide
GTATNNH

SEQ ID NO: 1173 - protein, 7 aa, Artificial Sequence
  Description of Artificial Sequence: Synthetic peptide
TSSTKTV

SEQ ID NO: 1174 - protein, 7 aa, Artificial Sequence
  Description of Artificial Sequence: Synthetic peptide
SGTGNSG

SEQ ID NO: 1175 - protein, 7 aa, Artificial Sequence
  Description of Artificial Sequence: Synthetic peptide
GGDGKAR

SEQ ID NO: 1176 - protein, 7 aa, Artificial Sequence
  Description of Artificial Sequence: Synthetic peptide
TRSEGSV

SEQ ID NO: 1177 - protein, 7 aa, Artificial Sequence
  Description of Artificial Sequence: Synthetic peptide
SGLGKPV

SEQ ID NO: 1178 - protein, 7 aa, Artificial Sequence
  Description of Artificial Sequence: Synthetic peptide
APIQSGS

SEQ ID NO: 1179 - protein, 7 aa, Artificial Sequence
  Description of Artificial Sequence: Synthetic peptide
FGSPTPS

SEQ ID NO: 1180 - protein, 7 aa, Artificial Sequence
  Description of Artificial Sequence: Synthetic peptide
SRSTTST

SEQ ID NO: 1181 - protein, 7 aa, Artificial Sequence
  Description of Artificial Sequence: Synthetic peptide
NSGGTHS

SEQ ID NO: 1182 - protein, 7 aa, Artificial Sequence
  Description of Artificial Sequence: Synthetic peptide
STQSGNR

SEQ ID NO: 1183 - protein, 7 aa, Artificial Sequence
  Description of Artificial Sequence: Synthetic peptide
MEGTHGG

SEQ ID NO: 1184 - protein, 7 aa, Artificial Sequence
  Description of Artificial Sequence: Synthetic peptide
QSGGSNV

SEQ ID NO: 1185 - protein, 7 aa, Artificial Sequence
  Description of Artificial Sequence: Synthetic peptide
HGTAKTS

SEQ ID NO: 1186 - protein, 7 aa, Artificial Sequence
  Description of Artificial Sequence: Synthetic peptide
LGNGKTV

SEQ ID NO: 1187 - protein, 7 aa, Artificial Sequence
  Description of Artificial Sequence: Synthetic peptide
LNNQKTV

SEQ ID NO: 1188 - protein, 7 aa, Artificial Sequence
  Description of Artificial Sequence: Synthetic peptide
DQTARST

SEQ ID NO: 1189 - protein, 7 aa, Artificial Sequence
  Description of Artificial Sequence: Synthetic peptide
AGKGAAS

SEQ ID NO: 1190 - protein, 7 aa, Artificial Sequence
  Description of Artificial Sequence: Synthetic peptide
ASGRSVS

SEQ ID NO: 1191 - protein, 7 aa, Artificial Sequence
  Description of Artificial Sequence: Synthetic peptide
GLSGDIK

SEQ ID NO: 1192 - protein, 7 aa, Artificial Sequence
  Description of Artificial Sequence: Synthetic peptide
GPNRDSG

SEQ ID NO: 1193 - protein, 7 aa, Artificial Sequence
  Description of Artificial Sequence: Synthetic peptide
SQGQANT

SEQ ID NO: 1194 - protein, 7 aa, Artificial Sequence
  Description of Artificial Sequence: Synthetic peptide
HHDAQVK

SEQ ID NO: 1195 - protein, 7 aa, Artificial Sequence
  Description of Artificial Sequence: Synthetic peptide
GSGTPGA

SEQ ID NO: 1196 - protein, 7 aa, Artificial Sequence
  Description of Artificial Sequence: Synthetic peptide
DTGSRSR

SEQ ID NO: 1197 - protein, 7 aa, Artificial Sequence
  Description of Artificial Sequence: Synthetic peptide
SSVPSQA

SEQ ID NO: 1198 - protein, 7 aa, Artificial Sequence
  Description of Artificial Sequence: Synthetic peptide
SGTPTHN

SEQ ID NO: 1199 - protein, 7 aa, Artificial Sequence
  Description of Artificial Sequence: Synthetic peptide
SGGSSSK

SEQ ID NO: 1200 - protein, 7 aa, Artificial Sequence
  Description of Artificial Sequence: Synthetic peptide
GTGKPAQ

SEQ ID NO: 1201 - protein, 7 aa, Artificial Sequence
  Description of Artificial Sequence: Synthetic peptide
NANKTAG

SEQ ID NO: 1202 - protein, 7 aa, Artificial Sequence
  Description of Artificial Sequence: Synthetic peptide
NTERPTA

SEQ ID NO: 1203 - protein, 7 aa, Artificial Sequence
  Description of Artificial Sequence: Synthetic peptide
ASSPTQA

SEQ ID NO: 1204 - protein, 7 aa, Artificial Sequence
  Description of Artificial Sequence: Synthetic peptide
GHAGGNS

SEQ ID NO: 1205 - protein, 7 aa, Artificial Sequence
  Description of Artificial Sequence: Synthetic peptide
SPEGKNR

SEQ ID NO: 1206 - protein, 7 aa, Artificial Sequence
  Description of Artificial Sequence: Synthetic peptide
SMVASQG

SEQ ID NO: 1207 - protein, 7 aa, Artificial Sequence
  Description of Artificial Sequence: Synthetic peptide
GREVSPK

SEQ ID NO: 1208 - protein, 7 aa, Artificial Sequence
  Description of Artificial Sequence: Synthetic peptide
ATTASPK

SEQ ID NO: 1209 - protein, 7 aa, Artificial Sequence
  Description of Artificial Sequence: Synthetic peptide
MGVTGSA

SEQ ID NO: 1210 - protein, 7 aa, Artificial Sequence
  Description of Artificial Sequence: Synthetic peptide
APSSQSA

SEQ ID NO: 1211 - protein, 7 aa, Artificial Sequence
  Description of Artificial Sequence: Synthetic peptide
GSTAQPR

SEQ ID NO: 1212 - protein, 7 aa, Artificial Sequence
  Description of Artificial Sequence: Synthetic peptide
KNGNSTY

SEQ ID NO: 1213 - protein, 7 aa, Artificial Sequence
  Description of Artificial Sequence: Synthetic peptide
SNQGGIT

SEQ ID NO: 1214 - protein, 7 aa, Artificial Sequence
  Description of Artificial Sequence: Synthetic peptide
SVNKSDN

SEQ ID NO: 1215 - protein, 7 aa, Artificial Sequence
  Description of Artificial Sequence: Synthetic peptide
TSGGLKS

SEQ ID NO: 1216 - protein, 7 aa, Artificial Sequence
  Description of Artificial Sequence: Synthetic peptide
GVVSPAK

SEQ ID NO: 1217 - protein, 7 aa, Artificial Sequence
  Description of Artificial Sequence: Synthetic peptide
GQVQGTT

SEQ ID NO: 1218 - protein, 7 aa, Artificial Sequence
  Description of Artificial Sequence: Synthetic peptide
SMAKSTQ

SEQ ID NO: 1219 - protein, 7 aa, Artificial Sequence
  Description of Artificial Sequence: Synthetic peptide
TAAKIGS

SEQ ID NO: 1220 - protein, 7 aa, Artificial Sequence
  Description of Artificial Sequence: Synthetic peptide
GSTKSTS

SEQ ID NO: 1221 - protein, 7 aa, Artificial Sequence
  Description of Artificial Sequence: Synthetic peptide
SSHKSVA

SEQ ID NO: 1222 - protein, 7 aa, Artificial Sequence
  Description of Artificial Sequence: Synthetic peptide
SQGASLG

SEQ ID NO: 1223 - protein, 7 aa, Artificial Sequence
  Description of Artificial Sequence: Synthetic peptide
TNSSSAS

SEQ ID NO: 1224 - protein, 7 aa, Artificial Sequence
  Description of Artificial Sequence: Synthetic peptide
GSSRDSP

SEQ ID NO: 1225 - protein, 7 aa, Artificial Sequence
  Description of Artificial Sequence: Synthetic peptide
KSAKSIE

SEQ ID NO: 1226 - protein, 7 aa, Artificial Sequence
  Description of Artificial Sequence: Synthetic peptide
SSQTPQA

SEQ ID NO: 1227 - protein, 7 aa, Artificial Sequence
  Description of Artificial Sequence: Synthetic peptide
GGDKPSV

SEQ ID NO: 1228 - protein, 7 aa, Artificial Sequence
  Description of Artificial Sequence: Synthetic peptide
KSGSASS

SEQ ID NO: 1229 - protein, 7 aa, Artificial Sequence
  Description of Artificial Sequence: Synthetic peptide
YGSSKNQ

SEQ ID NO: 1230 - protein, 7 aa, Artificial Sequence
  Description of Artificial Sequence: Synthetic peptide
SHSKEQL

SEQ ID NO: 1231 - protein, 7 aa, Artificial Sequence
  Description of Artificial Sequence: Synthetic peptide
TRSTSTT

SEQ ID NO: 1232 - protein, 7 aa, Artificial Sequence
  Description of Artificial Sequence: Synthetic peptide
SKPGEHG

SEQ ID NO: 1233 - protein, 7 aa, Artificial Sequence
  Description of Artificial Sequence: Synthetic peptide
SKGSPSA

SEQ ID NO: 1234 - protein, 7 aa, Artificial Sequence
  Description of Artificial Sequence: Synthetic peptide
GSRPNSG

SEQ ID NO: 1235 - protein, 7 aa, Artificial Sequence
  Description of Artificial Sequence: Synthetic peptide
GAQTAHV

SEQ ID NO: 1236 - protein, 7 aa, Artificial Sequence
  Description of Artificial Sequence: Synthetic peptide
ANGAPTR

SEQ ID NO: 1237 - protein, 7 aa, Artificial Sequence
  Description of Artificial Sequence: Synthetic peptide
SGAAKES

SEQ ID NO: 1238 - protein, 7 aa, Artificial Sequence
  Description of Artificial Sequence: Synthetic peptide
MQTSSSI

SEQ ID NO: 1239 - protein, 7 aa, Artificial Sequence
  Description of Artificial Sequence: Synthetic peptide
GSSTPKL

SEQ ID NO: 1240 - protein, 7 aa, Artificial Sequence
  Description of Artificial Sequence: Synthetic peptide
GSTKPNY

SEQ ID NO: 1241 - protein, 7 aa, Artificial Sequence
  Description of Artificial Sequence: Synthetic peptide
AAGAHTV

SEQ ID NO: 1242 - protein, 7 aa, Artificial Sequence
  Description of Artificial Sequence: Synthetic peptide
GLEASKE

SEQ ID NO: 1243 - protein, 7 aa, Artificial Sequence
  Description of Artificial Sequence: Synthetic peptide
TTNAPVG

SEQ ID NO: 1244 - protein, 7 aa, Artificial Sequence
  Description of Artificial Sequence: Synthetic peptide
STSTKSM

SEQ ID NO: 1245 - protein, 7 aa, Artificial Sequence
  Description of Artificial Sequence: Synthetic peptide
DVGKQSK

SEQ ID NO: 1246 - protein, 7 aa, Artificial Sequence
  Description of Artificial Sequence: Synthetic peptide
QSNTTSS

SEQ ID NO: 1247 - protein, 7 aa, Artificial Sequence
  Description of Artificial Sequence: Synthetic peptide
SSHSPSL

SEQ ID NO: 1248 - protein, 7 aa, Artificial Sequence
  Description of Artificial Sequence: Synthetic peptide
GVGSKTA

SEQ ID NO: 1249 - protein, 7 aa, Artificial Sequence
  Description of Artificial Sequence: Synthetic peptide
SLNGKPG

SEQ ID NO: 1250 - protein, 7 aa, Artificial Sequence
  Description of Artificial Sequence: Synthetic peptide
TSEKPFN

SEQ ID NO: 1251 - protein, 7 aa, Artificial Sequence
  Description of Artificial Sequence: Synthetic peptide
SITKGNP

SEQ ID NO: 1252 - protein, 7 aa, Artificial Sequence
  Description of Artificial Sequence: Synthetic peptide
GTANPSR

SEQ ID NO: 1253 - protein, 7 aa, Artificial Sequence
  Description of Artificial Sequence: Synthetic peptide
SPNKPAS

SEQ ID NO: 1254 - protein, 7 aa, Artificial Sequence
  Description of Artificial Sequence: Synthetic peptide
TNSKPVS

SEQ ID NO: 1255 - protein, 7 aa, Artificial Sequence
  Description of Artificial Sequence: Synthetic peptide
SRDKNSG

SEQ ID NO: 1256 - protein, 7 aa, Artificial Sequence
  Description of Artificial Sequence: Synthetic peptide
NSTNHPS

SEQ ID NO: 1257 - protein, 7 aa, Artificial Sequence
  Description of Artificial Sequence: Synthetic peptide
TEKSKAI

SEQ ID NO: 1258 - protein, 7 aa, Artificial Sequence
  Description of Artificial Sequence: Synthetic peptide
SGPDLKS

SEQ ID NO: 1259 - protein, 7 aa, Artificial Sequence
  Description of Artificial Sequence: Synthetic peptide
DQTARNV

SEQ ID NO: 1260 - protein, 7 aa, Artificial Sequence
  Description of Artificial Sequence: Synthetic peptide
SDSQKTR

SEQ ID NO: 1261 - protein, 7 aa, Artificial Sequence
  Description of Artificial Sequence: Synthetic peptide
MSDNKVL

SEQ ID NO: 1262 - protein, 7 aa, Artificial Sequence
  Description of Artificial Sequence: Synthetic peptide
MTSTKAS

SEQ ID NO: 1263 - protein, 7 aa, Artificial Sequence
  Description of Artificial Sequence: Synthetic peptide
AVSSKHS

SEQ ID NO: 1264 - protein, 7 aa, Artificial Sequence
  Description of Artificial Sequence: Synthetic peptide
SHQSSAN

SEQ ID NO: 1265 - protein, 7 aa, Artificial Sequence
  Description of Artificial Sequence: Synthetic peptide
HGVKDSK

SEQ ID NO: 1266 - protein, 7 aa, Artificial Sequence
  Description of Artificial Sequence: Synthetic peptide
LGGTQNK

SEQ ID NO: 1267 - protein, 7 aa, Artificial Sequence
  Description of Artificial Sequence: Synthetic peptide
SGATPIK

SEQ ID NO: 1268 - protein, 7 aa, Artificial Sequence
  Description of Artificial Sequence: Synthetic peptide
TGGNTAH

SEQ ID NO: 1269 - protein, 7 aa, Artificial Sequence
  Description of Artificial Sequence: Synthetic peptide
LGDQRVT

SEQ ID NO: 1270 - protein, 7 aa, Artificial Sequence
  Description of Artificial Sequence: Synthetic peptide
SGSVQPA

SEQ ID NO: 1271 - protein, 7 aa, Artificial Sequence
  Description of Artificial Sequence: Synthetic peptide
NADTRSS

SEQ ID NO: 1272 - protein, 7 aa, Artificial Sequence
  Description of Artificial Sequence: Synthetic peptide
SSASKSN

SEQ ID NO: 1273 - protein, 7 aa, Artificial Sequence
  Description of Artificial Sequence: Synthetic peptide
NGSASSS

SEQ ID NO: 1274 - protein, 7 aa, Artificial Sequence
  Description of Artificial Sequence: Synthetic peptide
NANGRQQ

SEQ ID NO: 1275 - protein, 7 aa, Artificial Sequence
  Description of Artificial Sequence: Synthetic peptide
GMGHSAA

SEQ ID NO: 1276 - protein, 7 aa, Artificial Sequence
  Description of Artificial Sequence: Synthetic peptide
AGSGHST

SEQ ID NO: 1277 - protein, 7 aa, Artificial Sequence
  Description of Artificial Sequence: Synthetic peptide
DFGKANA

SEQ ID NO: 1278 - protein, 7 aa, Artificial Sequence
  Description of Artificial Sequence: Synthetic peptide
LAGNGNA

SEQ ID NO: 1279 - protein, 7 aa, Artificial Sequence
  Description of Artificial Sequence: Synthetic peptide
VPAGKGS

SEQ ID NO: 1280 - protein, 7 aa, Artificial Sequence
  Description of Artificial Sequence: Synthetic peptide
TSAPTSG

SEQ ID NO: 1281 - protein, 7 aa, Artificial Sequence
  Description of Artificial Sequence: Synthetic peptide
ISSKQSS

SEQ ID NO: 1282 - protein, 7 aa, Artificial Sequence
  Description of Artificial Sequence: Synthetic peptide
ANNGTGG

SEQ ID NO: 1283 - protein, 7 aa, Artificial Sequence
  Description of Artificial Sequence: Synthetic peptide
SSSGRNE

SEQ ID NO: 1284 - protein, 7 aa, Artificial Sequence
  Description of Artificial Sequence: Synthetic peptide
AGTTHGG

SEQ ID NO: 1285 - protein, 7 aa, Artificial Sequence
  Description of Artificial Sequence: Synthetic peptide
MPTSSQV

SEQ ID NO: 1286 - protein, 7 aa, Artificial Sequence
  Description of Artificial Sequence: Synthetic peptide
RSGDPIK

SEQ ID NO: 1287 - protein, 7 aa, Artificial Sequence
  Description of Artificial Sequence: Synthetic peptide
QAGSSNG

SEQ ID NO: 1288 - protein, 7 aa, Artificial Sequence
  Description of Artificial Sequence: Synthetic peptide
FGSGSAN

SEQ ID NO: 1289 - protein, 7 aa, Artificial Sequence
  Description of Artificial Sequence: Synthetic peptide
TSTGTQA

SEQ ID NO: 1290 - protein, 7 aa, Artificial Sequence
  Description of Artificial Sequence: Synthetic peptide
NKDHANV

SEQ ID NO: 1291 - protein, 7 aa, Artificial Sequence
  Description of Artificial Sequence: Synthetic peptide
DNSSMSK

SEQ ID NO: 1292 - protein, 7 aa, Artificial Sequence
  Description of Artificial Sequence: Synthetic peptide
SPSGGGN

SEQ ID NO: 1293 - protein, 7 aa, Artificial Sequence
  Description of Artificial Sequence: Synthetic peptide
NLGGKAV

SEQ ID NO: 1294 - protein, 7 aa, Artificial Sequence
  Description of Artificial Sequence: Synthetic peptide
SSTNKAM

SEQ ID NO: 1295 - protein, 7 aa, Artificial Sequence
  Description of Artificial Sequence: Synthetic peptide
STDIKAQ

SEQ ID NO: 1296 - protein, 7 aa, Artificial Sequence
  Description of Artificial Sequence: Synthetic peptide
SGSSNHV

SEQ ID NO: 1297 - protein, 7 aa, Artificial Sequence
  Description of Artificial Sequence: Synthetic peptide
TTVGSNS

SEQ ID NO: 1298 - protein, 7 aa, Artificial Sequence
  Description of Artificial Sequence: Synthetic peptide
SANHSPT

SEQ ID NO: 1299 - protein, 7 aa, Artificial Sequence
  Description of Artificial Sequence: Synthetic peptide
VTANASS

SEQ ID NO: 1300 - protein, 7 aa, Artificial Sequence
  Description of Artificial Sequence: Synthetic peptide
TPSKSSL

SEQ ID NO: 1301 - protein, 7 aa, Artificial Sequence
  Description of Artificial Sequence: Synthetic peptide
TGGRPSE

SEQ ID NO: 1302 - protein, 7 aa, Artificial Sequence
  Description of Artificial Sequence: Synthetic peptide
LVSSEQK

SEQ ID NO: 1303 - protein, 7 aa, Artificial Sequence
  Description of Artificial Sequence: Synthetic peptide
MGGAQGS

SEQ ID NO: 1304 - protein, 7 aa, Artificial Sequence
  Description of Artificial Sequence: Synthetic peptide
NGSRQNQ

SEQ ID NO: 1305 - protein, 7 aa, Artificial Sequence
  Description of Artificial Sequence: Synthetic peptide
HGTGKGA

SEQ ID NO: 1306 - protein, 7 aa, Artificial Sequence
  Description of Artificial Sequence: Synthetic peptide
GNSAGLS

SEQ ID NO: 1307 - protein, 7 aa, Artificial Sequence
  Description of Artificial Sequence: Synthetic peptide
SGIQKPA

SEQ ID NO: 1308 - protein, 7 aa, Artificial Sequence
  Description of Artificial Sequence: Synthetic peptide
GSKGSQN

SEQ ID NO: 1309 - protein, 7 aa, Artificial Sequence
  Description of Artificial Sequence: Synthetic peptide
ATGDPRR

SEQ ID NO: 1310 - protein, 7 aa, Artificial Sequence
  Description of Artificial Sequence: Synthetic peptide
DAARPQA

SEQ ID NO: 1311 - protein, 7 aa, Artificial Sequence
  Description of Artificial Sequence: Synthetic peptide
ENTSPSL

SEQ ID NO: 1312 - protein, 7 aa, Artificial Sequence
  Description of Artificial Sequence: Synthetic peptide
DGDKSRA

SEQ ID NO: 1313 - protein, 7 aa, Artificial Sequence
  Description of Artificial Sequence: Synthetic peptide
SASGATG

SEQ ID NO: 1314 - protein, 7 aa, Artificial Sequence
  Description of Artificial Sequence: Synthetic peptide
LPGKTNS

SEQ ID NO: 1315 - protein, 7 aa, Artificial Sequence
  Description of Artificial Sequence: Synthetic peptide
EVGHSKG

SEQ ID NO: 1316 - protein, 7 aa, Artificial Sequence
  Description of Artificial Sequence: Synthetic peptide
AGATPMR

SEQ ID NO: 1317 - protein, 7 aa, Artificial Sequence
  Description of Artificial Sequence: Synthetic peptide
MRSQDTT

SEQ ID NO: 1318 - protein, 7 aa, Artificial Sequence
  Description of Artificial Sequence: Synthetic peptide
QSGQPGR

SEQ ID NO: 1319 - protein, 7 aa, Artificial Sequence
  Description of Artificial Sequence: Synthetic peptide
DGVRSSN

SEQ ID NO: 1320 - protein, 7 aa, Artificial Sequence
  Description of Artificial Sequence: Synthetic peptide
TTTHNPV

SEQ ID NO: 1321 - protein, 7 aa, Artificial Sequence
  Description of Artificial Sequence: Synthetic peptide
LPSSPAT

SEQ ID NO: 1322 - protein, 7 aa, Artificial Sequence
  Description of Artificial Sequence: Synthetic peptide
DGSSPQI

SEQ ID NO: 1323 - protein, 7 aa, Artificial Sequence
  Description of Artificial Sequence: Synthetic peptide
SAGSKTA

SEQ ID NO: 1324 - protein, 7 aa, Artificial Sequence
  Description of Artificial Sequence: Synthetic peptide
GSKTHSS

SEQ ID NO: 1325 - protein, 7 aa, Artificial Sequence
  Description of Artificial Sequence: Synthetic peptide
SGNSAKT

SEQ ID NO: 1326 - protein, 7 aa, Artificial Sequence
  Description of Artificial Sequence: Synthetic peptide
HGGSKTT

SEQ ID NO: 1327 - protein, 7 aa, Artificial Sequence
  Description of Artificial Sequence: Synthetic peptide
VPSDRSS

SEQ ID NO: 1328 - protein, 7 aa, Artificial Sequence
  Description of Artificial Sequence: Synthetic peptide
QQGKSAL

SEQ ID NO: 1329 - protein, 7 aa, Artificial Sequence
  Description of Artificial Sequence: Synthetic peptide
MHDGKSV

SEQ ID NO: 1330 - protein, 7 aa, Artificial Sequence
  Description of Artificial Sequence: Synthetic peptide
DSAGNRL

SEQ ID NO: 1331 - protein, 7 aa, Artificial Sequence
  Description of Artificial Sequence: Synthetic peptide
VSGSSHA

SEQ ID NO: 1332 - protein, 7 aa, Artificial Sequence
  Description of Artificial Sequence: Synthetic peptide
SSDRSPV

SEQ ID NO: 1333 - protein, 7 aa, Artificial Sequence
  Description of Artificial Sequence: Synthetic peptide
GNAKAPS

SEQ ID NO: 1334 - protein, 7 aa, Artificial Sequence
  Description of Artificial Sequence: Synthetic peptide
GTAGSRN

SEQ ID NO: 1335 - protein, 7 aa, Artificial Sequence
  Description of Artificial Sequence: Synthetic peptide
VSDKPAI

SEQ ID NO: 1336 - protein, 7 aa, Artificial Sequence
  Description of Artificial Sequence: Synthetic peptide
LRGASSE

SEQ ID NO: 1337 - protein, 7 aa, Artificial Sequence
  Description of Artificial Sequence: Synthetic peptide
ESSGSMR

SEQ ID NO: 1338 - protein, 7 aa, Artificial Sequence
  Description of Artificial Sequence: Synthetic peptide
GSTKVTQ

SEQ ID NO: 1339 - protein, 7 aa, Artificial Sequence
  Description of Artificial Sequence: Synthetic peptide
SGAKASG

SEQ ID NO: 1340 - protein, 7 aa, Artificial Sequence
  Description of Artificial Sequence: Synthetic peptide
GRDTHNK

SEQ ID NO: 1341 - protein, 7 aa, Artificial Sequence
  Description of Artificial Sequence: Synthetic peptide
SGTPNGH

SEQ ID NO: 1342 - protein, 7 aa, Artificial Sequence
  Description of Artificial Sequence: Synthetic peptide
GSHSQKG

SEQ ID NO: 1343 - protein, 7 aa, Artificial Sequence
  Description of Artificial Sequence: Synthetic peptide
SNGVRSS

SEQ ID NO: 1344 - protein, 7 aa, Artificial Sequence
  Description of Artificial Sequence: Synthetic peptide
GRGSGDK

SEQ ID NO: 1345 - protein, 7 aa, Artificial Sequence
  Description of Artificial Sequence: Synthetic peptide
SSGNSRS

SEQ ID NO: 1346 - protein, 7 aa, Artificial Sequence
  Description of Artificial Sequence: Synthetic peptide
VPDKSSK

SEQ ID NO: 1347 - protein, 7 aa, Artificial Sequence
  Description of Artificial Sequence: Synthetic peptide
IPSTKSQ

SEQ ID NO: 1348 - protein, 7 aa, Artificial Sequence
  Description of Artificial Sequence: Synthetic peptide
RNGKENS

SEQ ID NO: 1349 - protein, 7 aa, Artificial Sequence
  Description of Artificial Sequence: Synthetic peptide
QIQAPAS

SEQ ID NO: 1350 - protein, 7 aa, Artificial Sequence
  Description of Artificial Sequence: Synthetic peptide
GSVKVES

SEQ ID NO: 1351 - protein, 7 aa, Artificial Sequence
  Description of Artificial Sequence: Synthetic peptide
TPTGARN

SEQ ID NO: 1352 - protein, 7 aa, Artificial Sequence
  Description of Artificial Sequence: Synthetic peptide
DNQGGRG

SEQ ID NO: 1353 - protein, 7 aa, Artificial Sequence
  Description of Artificial Sequence: Synthetic peptide
GTSPSDR

SEQ ID NO: 1354 - protein, 7 aa, Artificial Sequence
  Description of Artificial Sequence: Synthetic peptide
ASDQTGK

SEQ ID NO: 1355 - protein, 7 aa, Artificial Sequence
  Description of Artificial Sequence: Synthetic peptide
VTQSHST

SEQ ID NO: 1356 - protein, 7 aa, Artificial Sequence
  Description of Artificial Sequence: Synthetic peptide
SPDTRPV

SEQ ID NO: 1357 - protein, 7 aa, Artificial Sequence
  Description of Artificial Sequence: Synthetic peptide
GSGNSTL

SEQ ID NO: 1358 - protein, 7 aa, Artificial Sequence
  Description of Artificial Sequence: Synthetic peptide
NGGSKPP

SEQ ID NO: 1359 - protein, 7 aa, Artificial Sequence
  Description of Artificial Sequence: Synthetic peptide
MGSNEQR

SEQ ID NO: 1360 - protein, 7 aa, Artificial Sequence
  Description of Artificial Sequence: Synthetic peptide
SSTTTNV

SEQ ID NO: 1361 - protein, 7 aa, Artificial Sequence
  Description of Artificial Sequence: Synthetic peptide
GSNAPIK

SEQ ID NO: 1362 - protein, 7 aa, Artificial Sequence
  Description of Artificial Sequence: Synthetic peptide
TPSKTST

SEQ ID NO: 1363 - protein, 7 aa, Artificial Sequence
  Description of Artificial Sequence: Synthetic peptide
STSRTNT

SEQ ID NO: 1364 - protein, 7 aa, Artificial Sequence
  Description of Artificial Sequence: Synthetic peptide
QVSAPRE

SEQ ID NO: 1365 - protein, 7 aa, Artificial Sequence
  Description of Artificial Sequence: Synthetic peptide
DMASKPA

SEQ ID NO: 1366 - protein, 7 aa, Artificial Sequence
  Description of Artificial Sequence: Synthetic peptide
LNQKSVA

SEQ ID NO: 1367 - protein, 7 aa, Artificial Sequence
  Description of Artificial Sequence: Synthetic peptide
NAGAHAG

SEQ ID NO: 1368 - protein, 7 aa, Artificial Sequence
  Description of Artificial Sequence: Synthetic peptide
TSGDSNR

SEQ ID NO: 1369 - protein, 7 aa, Artificial Sequence
  Description of Artificial Sequence: Synthetic peptide
STTGSRS

SEQ ID NO: 1370 - protein, 7 aa, Artificial Sequence
  Description of Artificial Sequence: Synthetic peptide
SIGNPST

SEQ ID NO: 1371 - protein, 7 aa, Artificial Sequence
  Description of Artificial Sequence: Synthetic peptide
IGTTPAR

SEQ ID NO: 1372 - protein, 7 aa, Artificial Sequence
  Description of Artificial Sequence: Synthetic peptide
GTNKTVS

SEQ ID NO: 1373 - protein, 7 aa, Artificial Sequence
  Description of Artificial Sequence: Synthetic peptide
VTGSPSR

SEQ ID NO: 1374 - protein, 7 aa, Artificial Sequence
  Description of Artificial Sequence: Synthetic peptide
VRDSKST

SEQ ID NO: 1375 - protein, 7 aa, Artificial Sequence
  Description of Artificial Sequence: Synthetic peptide
SQKASVQ

SEQ ID NO: 1376 - protein, 7 aa, Artificial Sequence
  Description of Artificial Sequence: Synthetic peptide
TRAQPSS

SEQ ID NO: 1377 - protein, 7 aa, Artificial Sequence
  Description of Artificial Sequence: Synthetic peptide
TTKPNSA

SEQ ID NO: 1378 - protein, 7 aa, Artificial Sequence
  Description of Artificial Sequence: Synthetic peptide
DNPIPVK

SEQ ID NO: 1379 - protein, 7 aa, Artificial Sequence
  Description of Artificial Sequence: Synthetic peptide
GKTDRNS

SEQ ID NO: 1380 - protein, 7 aa, Artificial Sequence
  Description of Artificial Sequence: Synthetic peptide
NSTGKLG

SEQ ID NO: 1381 - protein, 7 aa, Artificial Sequence
  Description of Artificial Sequence: Synthetic peptide
TVSSTNH

SEQ ID NO: 1382 - protein, 7 aa, Artificial Sequence
  Description of Artificial Sequence: Synthetic peptide
SSSTGMQ

SEQ ID NO: 1383 - protein, 7 aa, Artificial Sequence
  Description of Artificial Sequence: Synthetic peptide
ASNVPNK

SEQ ID NO: 1384 - protein, 7 aa, Artificial Sequence
  Description of Artificial Sequence: Synthetic peptide
ASASPTL

SEQ ID NO: 1385 - protein, 7 aa, Artificial Sequence
  Description of Artificial Sequence: Synthetic peptide
HTSDKTV

SEQ ID NO: 1386 - protein, 7 aa, Artificial Sequence
  Description of Artificial Sequence: Synthetic peptide
SSTKPTS

SEQ ID NO: 1387 - protein, 7 aa, Artificial Sequence
  Description of Artificial Sequence: Synthetic peptide
NRKNDTQ

SEQ ID NO: 1388 - protein, 7 aa, Artificial Sequence
  Description of Artificial Sequence: Synthetic peptide
SVPTGKG

SEQ ID NO: 1389 - protein, 7 aa, Artificial Sequence
  Description of Artificial Sequence: Synthetic peptide
EPSKSMI

SEQ ID NO: 1390 - protein, 7 aa, Artificial Sequence
  Description of Artificial Sequence: Synthetic peptide
AQATKPS

SEQ ID NO: 1391 - protein, 7 aa, Artificial Sequence
  Description of Artificial Sequence: Synthetic peptide
NTGKSQT

SEQ ID NO: 1392 - protein, 7 aa, Artificial Sequence
  Description of Artificial Sequence: Synthetic peptide
RGTKPQE

SEQ ID NO: 1393 - protein, 7 aa, Artificial Sequence
  Description of Artificial Sequence: Synthetic peptide
SKENKAS

SEQ ID NO: 1394 - protein, 7 aa, Artificial Sequence
  Description of Artificial Sequence: Synthetic peptide
QQAKGNA

SEQ ID NO: 1395 - protein, 7 aa, Artificial Sequence
  Description of Artificial Sequence: Synthetic peptide
KGNSTVN

SEQ ID NO: 1396 - protein, 7 aa, Artificial Sequence
  Description of Artificial Sequence: Synthetic peptide
QGSSGLG

SEQ ID NO: 1397 - protein, 7 aa, Artificial Sequence
  Description of Artificial Sequence: Synthetic peptide
DRSPSNV

SEQ ID NO: 1398 - protein, 7 aa, Artificial Sequence
  Description of Artificial Sequence: Synthetic peptide
AGDSKAR

SEQ ID NO: 1399 - protein, 7 aa, Artificial Sequence
  Description of Artificial Sequence: Synthetic peptide
TPSKDKA

SEQ ID NO: 1400 - protein, 7 aa, Artificial Sequence
  Description of Artificial Sequence: Synthetic peptide
KQGPSAE

SEQ ID NO: 1401 - protein, 7 aa, Artificial Sequence
  Description of Artificial Sequence: Synthetic peptide
SRGAPGT

SEQ ID NO: 1402 - protein, 7 aa, Artificial Sequence
  Description of Artificial Sequence: Synthetic peptide
GSAQSPR

SEQ ID NO: 1403 - protein, 7 aa, Artificial Sequence
  Description of Artificial Sequence: Synthetic peptide
TNRNPNL

SEQ ID NO: 1404 - protein, 7 aa, Artificial Sequence
  Description of Artificial Sequence: Synthetic peptide
IDSKPTN

SEQ ID NO: 1405 - protein, 7 aa, Artificial Sequence
  Description of Artificial Sequence: Synthetic peptide
VTGGTKG

SEQ ID NO: 1406 - protein, 7 aa, Artificial Sequence
  Description of Artificial Sequence: Synthetic peptide
TTNTPLK

SEQ ID NO: 1407 - protein, 7 aa, Artificial Sequence
  Description of Artificial Sequence: Synthetic peptide
SHEGKST

SEQ ID NO: 1408 - protein, 7 aa, Artificial Sequence
  Description of Artificial Sequence: Synthetic peptide
MDKPSQG

SEQ ID NO: 1409 - protein, 7 aa, Artificial Sequence
  Description of Artificial Sequence: Synthetic peptide
TQQAKTE

SEQ ID NO: 1410 - protein, 7 aa, Artificial Sequence
  Description of Artificial Sequence: Synthetic peptide
GDNKVLK

SEQ ID NO: 1411 - protein, 7 aa, Artificial Sequence
  Description of Artificial Sequence: Synthetic peptide
TRSNPQA

SEQ ID NO: 1412 - protein, 7 aa, Artificial Sequence
  Description of Artificial Sequence: Synthetic peptide
SLSSGTK

SEQ ID NO: 1413 - protein, 7 aa, Artificial Sequence
  Description of Artificial Sequence: Synthetic peptide
MSGGPKN

SEQ ID NO: 1414 - protein, 7 aa, Artificial Sequence
  Description of Artificial Sequence: Synthetic peptide
VGTGQQG

SEQ ID NO: 1415 - protein, 7 aa, Artificial Sequence
  Description of Artificial Sequence: Synthetic peptide
AESGRNT

SEQ ID NO: 1416 - protein, 7 aa, Artificial Sequence
  Description of Artificial Sequence: Synthetic peptide
TINKQAT

SEQ ID NO: 1417 - protein, 7 aa, Artificial Sequence
  Description of Artificial Sequence: Synthetic peptide
AKSSGSG

SEQ ID NO: 1418 - protein, 7 aa, Artificial Sequence
  Description of Artificial Sequence: Synthetic peptide
NTSKASA

SEQ ID NO: 1419 - protein, 7 aa, Artificial Sequence
  Description of Artificial Sequence: Synthetic peptide
SGKPASA

SEQ ID NO: 1420 - protein, 7 aa, Artificial Sequence
  Description of Artificial Sequence: Synthetic peptide
SMTKSNV

SEQ ID NO: 1421 - protein, 7 aa, Artificial Sequence
  Description of Artificial Sequence: Synthetic peptide
STRTSSE

SEQ ID NO: 1422 - protein, 7 aa, Artificial Sequence
  Description of Artificial Sequence: Synthetic peptide
RQGSDAR

SEQ ID NO: 1423 - protein, 7 aa, Artificial Sequence
  Description of Artificial Sequence: Synthetic peptide
QKAPSAS

SEQ ID NO: 1424 - protein, 7 aa, Artificial Sequence
  Description of Artificial Sequence: Synthetic peptide
GGSPAAS

SEQ ID NO: 1425 - protein, 7 aa, Artificial Sequence
  Description of Artificial Sequence: Synthetic peptide
VGSSSSM

SEQ ID NO: 1426 - protein, 7 aa, Artificial Sequence
  Description of Artificial Sequence: Synthetic peptide
SLSVPKD

SEQ ID NO: 1427 - protein, 7 aa, Artificial Sequence
  Description of Artificial Sequence: Synthetic peptide
MSSKPAT

SEQ ID NO: 1428 - protein, 7 aa, Artificial Sequence
  Description of Artificial Sequence: Synthetic peptide
SVMQKAS

SEQ ID NO: 1429 - protein, 7 aa, Artificial Sequence
  Description of Artificial Sequence: Synthetic peptide
TGSTATL

SEQ ID NO: 1430 - protein, 7 aa, Artificial Sequence
  Description of Artificial Sequence: Synthetic peptide
SPQKNNG

SEQ ID NO: 1431 - protein, 7 aa, Artificial Sequence
  Description of Artificial Sequence: Synthetic peptide
GPERPAG

SEQ ID NO: 1432 - protein, 7 aa, Artificial Sequence
  Description of Artificial Sequence: Synthetic peptide
KPRESSG

SEQ ID NO: 1433 - protein, 7 aa, Artificial Sequence
  Description of Artificial Sequence: Synthetic peptide
HADRQAS

SEQ ID NO: 1434 - protein, 7 aa, Artificial Sequence
  Description of Artificial Sequence: Synthetic peptide
ASGSGQS

SEQ ID NO: 1435 - protein, 7 aa, Artificial Sequence
  Description of Artificial Sequence: Synthetic peptide
SSTNNPK

SEQ ID NO: 1436 - protein, 7 aa, Artificial Sequence
  Description of Artificial Sequence: Synthetic peptide
AGTPSPR

SEQ ID NO: 1437 - protein, 7 aa, Artificial Sequence
  Description of Artificial Sequence: Synthetic peptide
SGRPDVS

SEQ ID NO: 1438 - protein, 7 aa, Artificial Sequence
  Description of Artificial Sequence: Synthetic peptide
HTSPGKN

SEQ ID NO: 1439 - protein, 7 aa, Artificial Sequence
  Description of Artificial Sequence: Synthetic peptide
GSAKNSA

SEQ ID NO: 1440 - protein, 7 aa, Artificial Sequence
  Description of Artificial Sequence: Synthetic peptide
AQASQTK

SEQ ID NO: 1441 - protein, 7 aa, Artificial Sequence
  Description of Artificial Sequence: Synthetic peptide
GSQKPYS

SEQ ID NO: 1442 - protein, 7 aa, Artificial Sequence
  Description of Artificial Sequence: Synthetic peptide
VSSTTQT

SEQ ID NO: 1443 - protein, 7 aa, Artificial Sequence
  Description of Artificial Sequence: Synthetic peptide
SVTSQGK

SEQ ID NO: 1444 - protein, 7 aa, Artificial Sequence
  Description of Artificial Sequence: Synthetic peptide
SVASGNK

SEQ ID NO: 1445 - protein, 7 aa, Artificial Sequence
  Description of Artificial Sequence: Synthetic peptide
SGAQQPR

SEQ ID NO: 1446 - protein, 7 aa, Artificial Sequence
  Description of Artificial Sequence: Synthetic peptide
HSKPSTM

SEQ ID NO: 1447 - protein, 7 aa, Artificial Sequence
  Description of Artificial Sequence: Synthetic peptide
NGRGGTQ

SEQ ID NO: 1448 - protein, 7 aa, Artificial Sequence
  Description of Artificial Sequence: Synthetic peptide
LPGKAMT

SEQ ID NO: 1449 - protein, 7 aa, Artificial Sequence
  Description of Artificial Sequence: Synthetic peptide
QTGEIGK

SEQ ID NO: 1450 - protein, 7 aa, Artificial Sequence
  Description of Artificial Sequence: Synthetic peptide
SSNHTSS

SEQ ID NO: 1451 - protein, 7 aa, Artificial Sequence
  Description of Artificial Sequence: Synthetic peptide
RQESKSM

SEQ ID NO: 1452 - protein, 7 aa, Artificial Sequence
  Description of Artificial Sequence: Synthetic peptide
VGQGKNA

SEQ ID NO: 1453 - protein, 7 aa, Artificial Sequence
  Description of Artificial Sequence: Synthetic peptide
TPGSNGR

SEQ ID NO: 1454 - protein, 7 aa, Artificial Sequence
  Description of Artificial Sequence: Synthetic peptide
TTGTDKL

SEQ ID NO: 1455 - protein, 7 aa, Artificial Sequence
  Description of Artificial Sequence: Synthetic peptide
EPSATQR

SEQ ID NO: 1456 - protein, 7 aa, Artificial Sequence
  Description of Artificial Sequence: Synthetic peptide
NVGTASK

SEQ ID NO: 1457 - protein, 7 aa, Artificial Sequence
  Description of Artificial Sequence: Synthetic peptide
GGGTAHM

SEQ ID NO: 1458 - protein, 7 aa, Artificial Sequence
  Description of Artificial Sequence: Synthetic peptide
GQSTHHQ

SEQ ID NO: 1459 - protein, 7 aa, Artificial Sequence
  Description of Artificial Sequence: Synthetic peptide
KANQGSG

SEQ ID NO: 1460 - protein, 7 aa, Artificial Sequence
  Description of Artificial Sequence: Synthetic peptide
GRTNITQ

SEQ ID NO: 1461 - protein, 7 aa, Artificial Sequence
  Description of Artificial Sequence: Synthetic peptide
STSSKMG

SEQ ID NO: 1462 - protein, 7 aa, Artificial Sequence
  Description of Artificial Sequence: Synthetic peptide
VQTGSHS

SEQ ID NO: 1463 - protein, 7 aa, Artificial Sequence
  Description of Artificial Sequence: Synthetic peptide
SASPTSG

SEQ ID NO: 1464 - protein, 7 aa, Artificial Sequence
  Description of Artificial Sequence: Synthetic peptide
VRDKSTA

SEQ ID NO: 1465 - protein, 7 aa, Artificial Sequence
  Description of Artificial Sequence: Synthetic peptide
QSSGSRS

SEQ ID NO: 1466 - protein, 7 aa, Artificial Sequence
  Description of Artificial Sequence: Synthetic peptide
NAQSPIR

SEQ ID NO: 1467 - protein, 7 aa, Artificial Sequence
  Description of Artificial Sequence: Synthetic peptide
GASVGSH

SEQ ID NO: 1468 - protein, 7 aa, Artificial Sequence
  Description of Artificial Sequence: Synthetic peptide
KGDKVFL

SEQ ID NO: 1469 - protein, 7 aa, Artificial Sequence
  Description of Artificial Sequence: Synthetic peptide
TGHAPNV

SEQ ID NO: 1470 - protein, 7 aa, Artificial Sequence
  Description of Artificial Sequence: Synthetic peptide
NALGAGG

SEQ ID NO: 1471 - protein, 7 aa, Artificial Sequence
  Description of Artificial Sequence: Synthetic peptide
SVSKPIS

SEQ ID NO: 1472 - protein, 7 aa, Artificial Sequence
  Description of Artificial Sequence: Synthetic peptide
YNGSKLQ

SEQ ID NO: 1473 - protein, 7 aa, Artificial Sequence
  Description of Artificial Sequence: Synthetic peptide
EANTKPH

SEQ ID NO: 1474 - protein, 7 aa, Artificial Sequence
  Description of Artificial Sequence: Synthetic peptide
NTNGAGR

SEQ ID NO: 1475 - protein, 7 aa, Artificial Sequence
  Description of Artificial Sequence: Synthetic peptide
VSANPPQ

SEQ ID NO: 1476 - protein, 7 aa, Artificial Sequence
  Description of Artificial Sequence: Synthetic peptide
NTSGKGV

SEQ ID NO: 1477 - protein, 7 aa, Artificial Sequence
  Description of Artificial Sequence: Synthetic peptide
SSTSVMK

SEQ ID NO: 1478 - protein, 7 aa, Artificial Sequence
  Description of Artificial Sequence: Synthetic peptide
DRSKAST

SEQ ID NO: 1479 - protein, 7 aa, Artificial Sequence
  Description of Artificial Sequence: Synthetic peptide
RSKESQV

SEQ ID NO: 1480 - protein, 7 aa, Artificial Sequence
  Description of Artificial Sequence: Synthetic peptide
SSGQSIS

SEQ ID NO: 1481 - protein, 7 aa, Artificial Sequence
  Description of Artificial Sequence: Synthetic peptide
TPSTSGR

SEQ ID NO: 1482 - protein, 7 aa, Artificial Sequence
  Description of Artificial Sequence: Synthetic peptide
DPTSGKG

SEQ ID NO: 1483 - protein, 7 aa, Artificial Sequence
  Description of Artificial Sequence: Synthetic peptide
GTASPAN

SEQ ID NO: 1484 - protein, 7 aa, Artificial Sequence
  Description of Artificial Sequence: Synthetic peptide
QPTSKSH

SEQ ID NO: 1485 - protein, 7 aa, Artificial Sequence
  Description of Artificial Sequence: Synthetic peptide
TGSANHV

SEQ ID NO: 1486 - protein, 7 aa, Artificial Sequence
  Description of Artificial Sequence: Synthetic peptide
QARSSQE

SEQ ID NO: 1487 - protein, 7 aa, Artificial Sequence
  Description of Artificial Sequence: Synthetic peptide
DARQKSV

SEQ ID NO: 1488 - protein, 7 aa, Artificial Sequence
  Description of Artificial Sequence: Synthetic peptide
AGASSVN

SEQ ID NO: 1489 - protein, 7 aa, Artificial Sequence
  Description of Artificial Sequence: Synthetic peptide
HELKGTT

SEQ ID NO: 1490 - protein, 7 aa, Artificial Sequence
  Description of Artificial Sequence: Synthetic peptide
VSNPETK

SEQ ID NO: 1491 - protein, 7 aa, Artificial Sequence
  Description of Artificial Sequence: Synthetic peptide
QQQSPSL

SEQ ID NO: 1492 - protein, 7 aa, Artificial Sequence
  Description of Artificial Sequence: Synthetic peptide
ADTTPTK

SEQ ID NO: 1493 - protein, 7 aa, Artificial Sequence
  Description of Artificial Sequence: Synthetic peptide
DNSKGSR

SEQ ID NO: 1494 - protein, 7 aa, Artificial Sequence
  Description of Artificial Sequence: Synthetic peptide
ANAKPSQ

SEQ ID NO: 1495 - protein, 7 aa, Artificial Sequence
  Description of Artificial Sequence: Synthetic peptide
AGGASGT

SEQ ID NO: 1496 - protein, 7 aa, Artificial Sequence
  Description of Artificial Sequence: Synthetic peptide
GNGAPGL

SEQ ID NO: 1497 - protein, 7 aa, Artificial Sequence
  Description of Artificial Sequence: Synthetic peptide
NRTGKLE

SEQ ID NO: 1498 - protein, 7 aa, Artificial Sequence
  Description of Artificial Sequence: Synthetic peptide
GNDKQHS

SEQ ID NO: 1499 - protein, 7 aa, Artificial Sequence
  Description of Artificial Sequence: Synthetic peptide
QSGPPNR

SEQ ID NO: 1500 - protein, 7 aa, Artificial Sequence
  Description of Artificial Sequence: Synthetic peptide
GSASNNK

SEQ ID NO: 1501 - protein, 7 aa, Artificial Sequence
  Description of Artificial Sequence: Synthetic peptide
STVSKTA

SEQ ID NO: 1502 - protein, 7 aa, Artificial Sequence
  Description of Artificial Sequence: Synthetic peptide
MSTQKLG

SEQ ID NO: 1503 - protein, 7 aa, Artificial Sequence
  Description of Artificial Sequence: Synthetic peptide
ISRSSQQ

SEQ ID NO: 1504 - protein, 7 aa, Artificial Sequence
  Description of Artificial Sequence: Synthetic peptide
ESNTPPK

SEQ ID NO: 1505 - protein, 7 aa, Artificial Sequence
  Description of Artificial Sequence: Synthetic peptide
TRAQANS

SEQ ID NO: 1506 - protein, 7 aa, Artificial Sequence
  Description of Artificial Sequence: Synthetic peptide
TNAAKSS

SEQ ID NO: 1507 - protein, 7 aa, Artificial Sequence
  Description of Artificial Sequence: Synthetic peptide
HPLQSGT

SEQ ID NO: 1508 - protein, 7 aa, Artificial Sequence
  Description of Artificial Sequence: Synthetic peptide
DPSKKNA

SEQ ID NO: 1509 - protein, 7 aa, Artificial Sequence
  Description of Artificial Sequence: Synthetic peptide
NGRETPK

SEQ ID NO: 1510 - protein, 7 aa, Artificial Sequence
  Description of Artificial Sequence: Synthetic peptide
STHKSSV

SEQ ID NO: 1511 - protein, 7 aa, Artificial Sequence
  Description of Artificial Sequence: Synthetic peptide
DTGRTPT

SEQ ID NO: 1512 - protein, 7 aa, Artificial Sequence
  Description of Artificial Sequence: Synthetic peptide
DAGTRSL

SEQ ID NO: 1513 - protein, 7 aa, Artificial Sequence
  Description of Artificial Sequence: Synthetic peptide
VSGQHQK

SEQ ID NO: 1514 - protein, 7 aa, Artificial Sequence
  Description of Artificial Sequence: Synthetic peptide
RNGQSAA

SEQ ID NO: 1515 - protein, 7 aa, Artificial Sequence
  Description of Artificial Sequence: Synthetic peptide
GTSGDRV

SEQ ID NO: 1516 - protein, 7 aa, Artificial Sequence
  Description of Artificial Sequence: Synthetic peptide
NHSGSPS

SEQ ID NO: 1517 - protein, 7 aa, Artificial Sequence
  Description of Artificial Sequence: Synthetic peptide
GSGQKQL

SEQ ID NO: 1518 - protein, 7 aa, Artificial Sequence
  Description of Artificial Sequence: Synthetic peptide
GYADAHK

SEQ ID NO: 1519 - protein, 7 aa, Artificial Sequence
  Description of Artificial Sequence: Synthetic peptide
NGNSNHQ

SEQ ID NO: 1520 - protein, 7 aa, Artificial Sequence
  Description of Artificial Sequence: Synthetic peptide
AGEKGRN

SEQ ID NO: 1521 - protein, 7 aa, Artificial Sequence
  Description of Artificial Sequence: Synthetic peptide
QRSTTST

SEQ ID NO: 1522 - protein, 7 aa, Artificial Sequence
  Description of Artificial Sequence: Synthetic peptide
LPQGTRS

SEQ ID NO: 1523 - protein, 7 aa, Artificial Sequence
  Description of Artificial Sequence: Synthetic peptide
NTNPPSK

SEQ ID NO: 1524 - protein, 7 aa, Artificial Sequence
  Description of Artificial Sequence: Synthetic peptide
QTSKSSV

SEQ ID NO: 1525 - protein, 7 aa, Artificial Sequence
  Description of Artificial Sequence: Synthetic peptide
SQHKPYT

SEQ ID NO: 1526 - protein, 7 aa, Artificial Sequence
  Description of Artificial Sequence: Synthetic peptide
ESTPRTA

SEQ ID NO: 1527 - protein, 7 aa, Artificial Sequence
  Description of Artificial Sequence: Synthetic peptide
MNDKSRN

SEQ ID NO: 1528 - protein, 7 aa, Artificial Sequence
  Description of Artificial Sequence: Synthetic peptide
SPGVTNT

SEQ ID NO: 1529 - protein, 7 aa, Artificial Sequence
  Description of Artificial Sequence: Synthetic peptide
DQLKSSA

SEQ ID NO: 1530 - protein, 7 aa, Artificial Sequence
  Description of Artificial Sequence: Synthetic peptide
AESDRKH

SEQ ID NO: 1531 - protein, 7 aa, Artificial Sequence
  Description of Artificial Sequence: Synthetic peptide
TSVTKPV

SEQ ID NO: 1532 - protein, 7 aa, Artificial Sequence
  Description of Artificial Sequence: Synthetic peptide
SGSPSAH

SEQ ID NO: 1533 - protein, 7 aa, Artificial Sequence
  Description of Artificial Sequence: Synthetic peptide
APGGNHT

SEQ ID NO: 1534 - protein, 7 aa, Artificial Sequence
  Description of Artificial Sequence: Synthetic peptide
AGNSEAK

SEQ ID NO: 1535 - protein, 7 aa, Artificial Sequence
  Description of Artificial Sequence: Synthetic peptide
GTTTSVR

SEQ ID NO: 1536 - protein, 7 aa, Artificial Sequence
  Description of Artificial Sequence: Synthetic peptide
SQTPPSA

SEQ ID NO: 1537 - protein, 7 aa, Artificial Sequence
  Description of Artificial Sequence: Synthetic peptide
GASQSLS

SEQ ID NO: 1538 - protein, 7 aa, Artificial Sequence
  Description of Artificial Sequence: Synthetic peptide
AGSTHAV

SEQ ID NO: 1539 - protein, 7 aa, Artificial Sequence
  Description of Artificial Sequence: Synthetic peptide
STNPTRG

SEQ ID NO: 1540 - protein, 7 aa, Artificial Sequence
  Description of Artificial Sequence: Synthetic peptide
GRDTPSR

SEQ ID NO: 1541 - protein, 7 aa, Artificial Sequence
  Description of Artificial Sequence: Synthetic peptide
ESSRDMK

SEQ ID NO: 1542 - protein, 7 aa, Artificial Sequence
  Description of Artificial Sequence: Synthetic peptide
AANSKNL

SEQ ID NO: 1543 - protein, 7 aa, Artificial Sequence
  Description of Artificial Sequence: Synthetic peptide
QTGAHTA

SEQ ID NO: 1544 - protein, 7 aa, Artificial Sequence
  Description of Artificial Sequence: Synthetic peptide
SNASSNS

SEQ ID NO: 1545 - protein, 7 aa, Artificial Sequence
  Description of Artificial Sequence: Synthetic peptide
VSSSKAT

SEQ ID NO: 1546 - protein, 7 aa, Artificial Sequence
  Description of Artificial Sequence: Synthetic peptide
EKTNAMV

SEQ ID NO: 1547 - protein, 7 aa, Artificial Sequence
  Description of Artificial Sequence: Synthetic peptide
EGMSTTR

SEQ ID NO: 1548 - protein, 7 aa, Artificial Sequence
  Description of Artificial Sequence: Synthetic peptide
DTRGTHS

SEQ ID NO: 1549 - protein, 7 aa, Artificial Sequence
  Description of Artificial Sequence: Synthetic peptide
NEQAAAR

SEQ ID NO: 1550 - protein, 7 aa, Artificial Sequence
  Description of Artificial Sequence: Synthetic peptide
TKSGVNQ

SEQ ID NO: 1551 - protein, 7 aa, Artificial Sequence
  Description of Artificial Sequence: Synthetic peptide
TENARPG

SEQ ID NO: 1552 - protein, 7 aa, Artificial Sequence
  Description of Artificial Sequence: Synthetic peptide
TTGAKPH

SEQ ID NO: 1553 - protein, 7 aa, Artificial Sequence
  Description of Artificial Sequence: Synthetic peptide
SNSKGEG

SEQ ID NO: 1554 - protein, 7 aa, Artificial Sequence
  Description of Artificial Sequence: Synthetic peptide
STARGNS

SEQ ID NO: 1555 - protein, 7 aa, Artificial Sequence
  Description of Artificial Sequence: Synthetic peptide
SPVTASQ

SEQ ID NO: 1556 - protein, 7 aa, Artificial Sequence
  Description of Artificial Sequence: Synthetic peptide
SGNSPMV

SEQ ID NO: 1557 - protein, 7 aa, Artificial Sequence
  Description of Artificial Sequence: Synthetic peptide
SRNDAKV

SEQ ID NO: 1558 - protein, 7 aa, Artificial Sequence
  Description of Artificial Sequence: Synthetic peptide
SGGNHGS

SEQ ID NO: 1559 - protein, 7 aa, Artificial Sequence
  Description of Artificial Sequence: Synthetic peptide
QGTGSLG

SEQ ID NO: 1560 - protein, 7 aa, Artificial Sequence
  Description of Artificial Sequence: Synthetic peptide
HSTAQQK

SEQ ID NO: 1561 - protein, 7 aa, Artificial Sequence
  Description of Artificial Sequence: Synthetic peptide
EFKSNNV

SEQ ID NO: 1562 - protein, 7 aa, Artificial Sequence
  Description of Artificial Sequence: Synthetic peptide
DGERPSV

SEQ ID NO: 1563 - protein, 7 aa, Artificial Sequence
  Description of Artificial Sequence: Synthetic peptide
DGAKVNK

SEQ ID NO: 1564 - protein, 7 aa, Artificial Sequence
  Description of Artificial Sequence: Synthetic peptide
AGTNKPQ

SEQ ID NO: 1565 - protein, 7 aa, Artificial Sequence
  Description of Artificial Sequence: Synthetic peptide
GTVKPQS

SEQ ID NO: 1566 - protein, 7 aa, Artificial Sequence
  Description of Artificial Sequence: Synthetic peptide
GMAHNSG

SEQ ID NO: 1567 - protein, 7 aa, Artificial Sequence
  Description of Artificial Sequence: Synthetic peptide
GGNHEMK

SEQ ID NO: 1568 - protein, 7 aa, Artificial Sequence
  Description of Artificial Sequence: Synthetic peptide
VTNKPSM

SEQ ID NO: 1569 - protein, 7 aa, Artificial Sequence
  Description of Artificial Sequence: Synthetic peptide
NSGNTVK

SEQ ID NO: 1570 - protein, 7 aa, Artificial Sequence
  Description of Artificial Sequence: Synthetic peptide
DNNPRTS

SEQ ID NO: 1571 - protein, 7 aa, Artificial Sequence
  Description of Artificial Sequence: Synthetic peptide
EPTTRNS

SEQ ID NO: 1572 - protein, 7 aa, Artificial Sequence
  Description of Artificial Sequence: Synthetic peptide
GSASGTA

SEQ ID NO: 1573 - protein, 7 aa, Artificial Sequence
  Description of Artificial Sequence: Synthetic peptide
NTSQTGR

SEQ ID NO: 1574 - protein, 7 aa, Artificial Sequence
  Description of Artificial Sequence: Synthetic peptide
SSTTSTK

SEQ ID NO: 1575 - protein, 7 aa, Artificial Sequence
  Description of Artificial Sequence: Synthetic peptide
TGQDKPG

SEQ ID NO: 1576 - protein, 7 aa, Artificial Sequence
  Description of Artificial Sequence: Synthetic peptide
TAARSGS

SEQ ID NO: 1577 - protein, 7 aa, Artificial Sequence
  Description of Artificial Sequence: Synthetic peptide
GVPSTGG

SEQ ID NO: 1578 - protein, 7 aa, Artificial Sequence
  Description of Artificial Sequence: Synthetic peptide
APSSTKG

SEQ ID NO: 1579 - protein, 7 aa, Artificial Sequence
  Description of Artificial Sequence: Synthetic peptide
TKNSPTQ

SEQ ID NO: 1580 - protein, 7 aa, Artificial Sequence
  Description of Artificial Sequence: Synthetic peptide
LATTKPS

SEQ ID NO: 1581 - protein, 7 aa, Artificial Sequence
  Description of Artificial Sequence: Synthetic peptide
VRESSNT

SEQ ID NO: 1582 - protein, 7 aa, Artificial Sequence
  Description of Artificial Sequence: Synthetic peptide
DVSNKSS

SEQ ID NO: 1583 - protein, 7 aa, Artificial Sequence
  Description of Artificial Sequence: Synthetic peptide
GKSSPVK

SEQ ID NO: 1584 - protein, 7 aa, Artificial Sequence
  Description of Artificial Sequence: Synthetic peptide
LPGKTHS

SEQ ID NO: 1585 - protein, 7 aa, Artificial Sequence
  Description of Artificial Sequence: Synthetic peptide
AGVKPAT

SEQ ID NO: 1586 - protein, 7 aa, Artificial Sequence
  Description of Artificial Sequence: Synthetic peptide
LGNGQGQ

SEQ ID NO: 1587 - protein, 7 aa, Artificial Sequence
  Description of Artificial Sequence: Synthetic peptide
LPTNKSL

SEQ ID NO: 1588 - protein, 7 aa, Artificial Sequence
  Description of Artificial Sequence: Synthetic peptide
GSDGKFS

SEQ ID NO: 1589 - protein, 7 aa, Artificial Sequence
  Description of Artificial Sequence: Synthetic peptide
QSGAQHS

SEQ ID NO: 1590 - protein, 7 aa, Artificial Sequence
  Description of Artificial Sequence: Synthetic peptide
LTSTSST

SEQ ID NO: 1591 - protein, 7 aa, Artificial Sequence
  Description of Artificial Sequence: Synthetic peptide
QATNSGG

SEQ ID NO: 1592 - protein, 7 aa, Artificial Sequence
  Description of Artificial Sequence: Synthetic peptide
GASVKPL

SEQ ID NO: 1593 - protein, 7 aa, Artificial Sequence
  Description of Artificial Sequence: Synthetic peptide
DVKAKTQ

SEQ ID NO: 1594 - protein, 7 aa, Artificial Sequence
  Description of Artificial Sequence: Synthetic peptide
TDGAAPK

SEQ ID NO: 1595 - protein, 7 aa, Artificial Sequence
  Description of Artificial Sequence: Synthetic peptide
DHTKKSS

SEQ ID NO: 1596 - protein, 7 aa, Artificial Sequence
  Description of Artificial Sequence: Synthetic peptide
RSGQQMV

SEQ ID NO: 1597 - protein, 7 aa, Artificial Sequence
  Description of Artificial Sequence: Synthetic peptide
DESTRNS

SEQ ID NO: 1598 - protein, 7 aa, Artificial Sequence
  Description of Artificial Sequence: Synthetic peptide
DSSERIR

SEQ ID NO: 1599 - protein, 7 aa, Artificial Sequence
  Description of Artificial Sequence: Synthetic peptide
MRNSATS

SEQ ID NO: 1600 - protein, 7 aa, Artificial Sequence
  Description of Artificial Sequence: Synthetic peptide
GDAAVSR

SEQ ID NO: 1601 - protein, 7 aa, Artificial Sequence
  Description of Artificial Sequence: Synthetic peptide
DSTKPGR

SEQ ID NO: 1602 - protein, 7 aa, Artificial Sequence
  Description of Artificial Sequence: Synthetic peptide
FGDNTVR

SEQ ID NO: 1603 - protein, 7 aa, Artificial Sequence
  Description of Artificial Sequence: Synthetic peptide
MDKSGSH

SEQ ID NO: 1604 - protein, 7 aa, Artificial Sequence
  Description of Artificial Sequence: Synthetic peptide
DRRDSSS

SEQ ID NO: 1605 - protein, 7 aa, Artificial Sequence
  Description of Artificial Sequence: Synthetic peptide
GRSDKSY

SEQ ID NO: 1606 - protein, 7 aa, Artificial Sequence
  Description of Artificial Sequence: Synthetic peptide
ATGSKTA

SEQ ID NO: 1607 - protein, 7 aa, Artificial Sequence
  Description of Artificial Sequence: Synthetic peptide
GSSAKPT

SEQ ID NO: 1608 - protein, 7 aa, Artificial Sequence
  Description of Artificial Sequence: Synthetic peptide
TRGGSAT

SEQ ID NO: 1609 - protein, 7 aa, Artificial Sequence
  Description of Artificial Sequence: Synthetic peptide
STTSKST

SEQ ID NO: 1610 - protein, 7 aa, Artificial Sequence
  Description of Artificial Sequence: Synthetic peptide
STDTRPS

SEQ ID NO: 1611 - protein, 7 aa, Artificial Sequence
  Description of Artificial Sequence: Synthetic peptide
TGTVSTR

SEQ ID NO: 1612 - protein, 7 aa, Artificial Sequence
  Description of Artificial Sequence: Synthetic peptide
GTLKGGE

SEQ ID NO: 1613 - protein, 7 aa, Artificial Sequence
  Description of Artificial Sequence: Synthetic peptide
GQGKTSQ

SEQ ID NO: 1614 - protein, 7 aa, Artificial Sequence
  Description of Artificial Sequence: Synthetic peptide
GGGNVGK

SEQ ID NO: 1615 - protein, 7 aa, Artificial Sequence
  Description of Artificial Sequence: Synthetic peptide
HGGSSVN

SEQ ID NO: 1616 - protein, 7 aa, Artificial Sequence
  Description of Artificial Sequence: Synthetic peptide
TKADGSR

SEQ ID NO: 1617 - protein, 7 aa, Artificial Sequence
  Description of Artificial Sequence: Synthetic peptide
HPSNAPH

SEQ ID NO: 1618 - protein, 7 aa, Artificial Sequence
  Description of Artificial Sequence: Synthetic peptide
VTAPSTK

SEQ ID NO: 1619 - protein, 7 aa, Artificial Sequence
  Description of Artificial Sequence: Synthetic peptide
TSGKGAL

SEQ ID NO: 1620 - protein, 7 aa, Artificial Sequence
  Description of Artificial Sequence: Synthetic peptide
SVSDRNH

SEQ ID NO: 1621 - protein, 7 aa, Artificial Sequence
  Description of Artificial Sequence: Synthetic peptide
VAANATK

SEQ ID NO: 1622 - protein, 7 aa, Artificial Sequence
  Description of Artificial Sequence: Synthetic peptide
SVHQKSS

SEQ ID NO: 1623 - protein, 7 aa, Artificial Sequence
  Description of Artificial Sequence: Synthetic peptide
EGAHSKV

SEQ ID NO: 1624 - protein, 7 aa, Artificial Sequence
  Description of Artificial Sequence: Synthetic peptide
ETTALSK

SEQ ID NO: 1625 - protein, 7 aa, Artificial Sequence
  Description of Artificial Sequence: Synthetic peptide
RSEAQPK

SEQ ID NO: 1626 - protein, 7 aa, Artificial Sequence
  Description of Artificial Sequence: Synthetic peptide
TNSAAAK

SEQ ID NO: 1627 - protein, 7 aa, Artificial Sequence
  Description of Artificial Sequence: Synthetic peptide
TAAKSAQ

SEQ ID NO: 1628 - protein, 7 aa, Artificial Sequence
  Description of Artificial Sequence: Synthetic peptide
TGAGASL

SEQ ID NO: 1629 - protein, 7 aa, Artificial Sequence
  Description of Artificial Sequence: Synthetic peptide
AGTDKTA

SEQ ID NO: 1630 - protein, 7 aa, Artificial Sequence
  Description of Artificial Sequence: Synthetic peptide
LGSQTST

SEQ ID NO: 1631 - protein, 7 aa, Artificial Sequence
  Description of Artificial Sequence: Synthetic peptide
QGSKPQN

SEQ ID NO: 1632 - protein, 7 aa, Artificial Sequence
  Description of Artificial Sequence: Synthetic peptide
ERESSAT

SEQ ID NO: 1633 - protein, 7 aa, Artificial Sequence
  Description of Artificial Sequence: Synthetic peptide
GTNTRAS

SEQ ID NO: 1634 - protein, 7 aa, Artificial Sequence
  Description of Artificial Sequence: Synthetic peptide
TNAQKIN

SEQ ID NO: 1635 - protein, 7 aa, Artificial Sequence
  Description of Artificial Sequence: Synthetic peptide
NQHQSSS

SEQ ID NO: 1636 - protein, 7 aa, Artificial Sequence
  Description of Artificial Sequence: Synthetic peptide
STTNAKV

SEQ ID NO: 1637 - protein, 7 aa, Artificial Sequence
  Description of Artificial Sequence: Synthetic peptide
GLGKAAN

SEQ ID NO: 1638 - protein, 7 aa, Artificial Sequence
  Description of Artificial Sequence: Synthetic peptide
NNKPQMV

SEQ ID NO: 1639 - protein, 7 aa, Artificial Sequence
  Description of Artificial Sequence: Synthetic peptide
THPKPTE

SEQ ID NO: 1640 - protein, 7 aa, Artificial Sequence
  Description of Artificial Sequence: Synthetic peptide
THGTPLS

SEQ ID NO: 1641 - protein, 7 aa, Artificial Sequence
  Description of Artificial Sequence: Synthetic peptide
SSGNGTP

SEQ ID NO: 1642 - protein, 7 aa, Artificial Sequence
  Description of Artificial Sequence: Synthetic peptide
TTSNKQD

SEQ ID NO: 1643 - protein, 7 aa, Artificial Sequence
  Description of Artificial Sequence: Synthetic peptide
MGLDKSL

SEQ ID NO: 1644 - protein, 7 aa, Artificial Sequence
  Description of Artificial Sequence: Synthetic peptide
NIGASNS

SEQ ID NO: 1645 - protein, 7 aa, Artificial Sequence
  Description of Artificial Sequence: Synthetic peptide
GSQKSAS

SEQ ID NO: 1646 - protein, 7 aa, Artificial Sequence
  Description of Artificial Sequence: Synthetic peptide
DGLSGTH

SEQ ID NO: 1647 - protein, 7 aa, Artificial Sequence
  Description of Artificial Sequence: Synthetic peptide
QRVKDTS

SEQ ID NO: 1648 - protein, 7 aa, Artificial Sequence
  Description of Artificial Sequence: Synthetic peptide
TLSDRNS

SEQ ID NO: 1649 - protein, 7 aa, Artificial Sequence
  Description of Artificial Sequence: Synthetic peptide
TTNAPQG

SEQ ID NO: 1650 - protein, 7 aa, Artificial Sequence
  Description of Artificial Sequence: Synthetic peptide
VRSDKTQ

SEQ ID NO: 1651 - protein, 7 aa, Artificial Sequence
  Description of Artificial Sequence: Synthetic peptide
TNIASSK

SEQ ID NO: 1652 - protein, 7 aa, Artificial Sequence
  Description of Artificial Sequence: Synthetic peptide
SSTSRPS

SEQ ID NO: 1653 - protein, 7 aa, Artificial Sequence
  Description of Artificial Sequence: Synthetic peptide
SGVDSRT

SEQ ID NO: 1654 - protein, 7 aa, Artificial Sequence
  Description of Artificial Sequence: Synthetic peptide
LHQSSPT

SEQ ID NO: 1655 - protein, 7 aa, Artificial Sequence
  Description of Artificial Sequence: Synthetic peptide
LGGGKSG

SEQ ID NO: 1656 - protein, 7 aa, Artificial Sequence
  Description of Artificial Sequence: Synthetic peptide
LTSASPS

SEQ ID NO: 1657 - protein, 7 aa, Artificial Sequence
  Description of Artificial Sequence: Synthetic peptide
DPSSPGV

SEQ ID NO: 1658 - protein, 7 aa, Artificial Sequence
  Description of Artificial Sequence: Synthetic peptide
EVTTPHT

SEQ ID NO: 1659 - protein, 7 aa, Artificial Sequence
  Description of Artificial Sequence: Synthetic peptide
SGGTGNR

SEQ ID NO: 1660 - protein, 7 aa, Artificial Sequence
  Description of Artificial Sequence: Synthetic peptide
GRIADVK

SEQ ID NO: 1661 - protein, 7 aa, Artificial Sequence
  Description of Artificial Sequence: Synthetic peptide
HNNDTPR

SEQ ID NO: 1662 - protein, 7 aa, Artificial Sequence
  Description of Artificial Sequence: Synthetic peptide
AQKSTIS

SEQ ID NO: 1663 - protein, 7 aa, Artificial Sequence
  Description of Artificial Sequence: Synthetic peptide
RDGNSSS

SEQ ID NO: 1664 - protein, 7 aa, Artificial Sequence
  Description of Artificial Sequence: Synthetic peptide
HGGTSVK

SEQ ID NO: 1665 - protein, 7 aa, Artificial Sequence
  Description of Artificial Sequence: Synthetic peptide
NPVANNK

SEQ ID NO: 1666 - protein, 7 aa, Artificial Sequence
  Description of Artificial Sequence: Synthetic peptide
GTTLKPG

SEQ ID NO: 1667 - protein, 7 aa, Artificial Sequence
  Description of Artificial Sequence: Synthetic peptide
TSQPPNA

SEQ ID NO: 1668 - protein, 7 aa, Artificial Sequence
  Description of Artificial Sequence: Synthetic peptide
SIGNVAK

SEQ ID NO: 1669 - protein, 7 aa, Artificial Sequence
  Description of Artificial Sequence: Synthetic peptide
VGGVTSS

SEQ ID NO: 1670 - protein, 7 aa, Artificial Sequence
  Description of Artificial Sequence: Synthetic peptide
RGTTSTS

SEQ ID NO: 1671 - protein, 7 aa, Artificial Sequence
  Description of Artificial Sequence: Synthetic peptide
NLGKSPT

SEQ ID NO: 1672 - protein, 7 aa, Artificial Sequence
  Description of Artificial Sequence: Synthetic peptide
QPGGKNV

SEQ ID NO: 1673 - protein, 7 aa, Artificial Sequence
  Description of Artificial Sequence: Synthetic peptide
KTTGAQS

SEQ ID NO: 1674 - protein, 7 aa, Artificial Sequence
  Description of Artificial Sequence: Synthetic peptide
AGVPSGN

SEQ ID NO: 1675 - protein, 7 aa, Artificial Sequence
  Description of Artificial Sequence: Synthetic peptide
GSTQRAN

SEQ ID NO: 1676 - protein, 7 aa, Artificial Sequence
  Description of Artificial Sequence: Synthetic peptide
NSAQPPN

SEQ ID NO: 1677 - protein, 7 aa, Artificial Sequence
  Description of Artificial Sequence: Synthetic peptide
STGMSGK

SEQ ID NO: 1678 - protein, 7 aa, Artificial Sequence
  Description of Artificial Sequence: Synthetic peptide
EGSTSKR

SEQ ID NO: 1679 - protein, 7 aa, Artificial Sequence
  Description of Artificial Sequence: Synthetic peptide
GTAHNSG

SEQ ID NO: 1680 - protein, 7 aa, Artificial Sequence
  Description of Artificial Sequence: Synthetic peptide
SVQRSSG

SEQ ID NO: 1681 - protein, 7 aa, Artificial Sequence
  Description of Artificial Sequence: Synthetic peptide
SGAPANK

SEQ ID NO: 1682 - protein, 7 aa, Artificial Sequence
  Description of Artificial Sequence: Synthetic peptide
QNSSRVE

SEQ ID NO: 1683 - protein, 7 aa, Artificial Sequence
  Description of Artificial Sequence: Synthetic peptide
GRDTKMM

SEQ ID NO: 1684 - protein, 7 aa, Artificial Sequence
  Description of Artificial Sequence: Synthetic peptide
SGISAHT

SEQ ID NO: 1685 - protein, 7 aa, Artificial Sequence
  Description of Artificial Sequence: Synthetic peptide
NLSHKSG

SEQ ID NO: 1686 - protein, 7 aa, Artificial Sequence
  Description of Artificial Sequence: Synthetic peptide
SETRSST

SEQ ID NO: 1687 - protein, 7 aa, Artificial Sequence
  Description of Artificial Sequence: Synthetic peptide
GRADSQK

SEQ ID NO: 1688 - protein, 7 aa, Artificial Sequence
  Description of Artificial Sequence: Synthetic peptide
TRSSPAN

SEQ ID NO: 1689 - protein, 7 aa, Artificial Sequence
  Description of Artificial Sequence: Synthetic peptide
DPQLSMK

SEQ ID NO: 1690 - protein, 7 aa, Artificial Sequence
  Description of Artificial Sequence: Synthetic peptide
RGSSQQG

SEQ ID NO: 1691 - protein, 7 aa, Artificial Sequence
  Description of Artificial Sequence: Synthetic peptide
SNANKSY

SEQ ID NO: 1692 - protein, 7 aa, Artificial Sequence
  Description of Artificial Sequence: Synthetic peptide
QGTRPSE

SEQ ID NO: 1693 - protein, 7 aa, Artificial Sequence
  Description of Artificial Sequence: Synthetic peptide
SGGSSVK

SEQ ID NO: 1694 - protein, 7 aa, Artificial Sequence
  Description of Artificial Sequence: Synthetic peptide
LTSKGSQ

SEQ ID NO: 1695 - protein, 7 aa, Artificial Sequence
  Description of Artificial Sequence: Synthetic peptide
SGERSNE

SEQ ID NO: 1696 - protein, 7 aa, Artificial Sequence
  Description of Artificial Sequence: Synthetic peptide
MPGSTSG

SEQ ID NO: 1697 - protein, 7 aa, Artificial Sequence
  Description of Artificial Sequence: Synthetic peptide
EARNKQV

SEQ ID NO: 1698 - protein, 7 aa, Artificial Sequence
  Description of Artificial Sequence: Synthetic peptide
LSSKTSN

SEQ ID NO: 1699 - protein, 7 aa, Artificial Sequence
  Description of Artificial Sequence: Synthetic peptide
SGTTKPS

SEQ ID NO: 1700 - protein, 7 aa, Artificial Sequence
  Description of Artificial Sequence: Synthetic peptide
IANKSPV

SEQ ID NO: 1701 - protein, 7 aa, Artificial Sequence
  Description of Artificial Sequence: Synthetic peptide
MANSPNR

SEQ ID NO: 1702 - protein, 7 aa, Artificial Sequence
  Description of Artificial Sequence: Synthetic peptide
DSTRGSG

SEQ ID NO: 1703 - protein, 7 aa, Artificial Sequence
  Description of Artificial Sequence: Synthetic peptide
GQSQTSH

SEQ ID NO: 1704 - protein, 7 aa, Artificial Sequence
  Description of Artificial Sequence: Synthetic peptide
NNSTVGH

SEQ ID NO: 1705 - protein, 7 aa, Artificial Sequence
  Description of Artificial Sequence: Synthetic peptide
TGNRPTE

SEQ ID NO: 1706 - protein, 7 aa, Artificial Sequence
  Description of Artificial Sequence: Synthetic peptide
ATNKVAT

SEQ ID NO: 1707 - protein, 7 aa, Artificial Sequence
  Description of Artificial Sequence: Synthetic peptide
ATGKAQA

SEQ ID NO: 1708 - protein, 7 aa, Artificial Sequence
  Description of Artificial Sequence: Synthetic peptide
EVSGKQL

SEQ ID NO: 1709 - protein, 7 aa, Artificial Sequence
  Description of Artificial Sequence: Synthetic peptide
DQAANRQ

SEQ ID NO: 1710 - protein, 7 aa, Artificial Sequence
  Description of Artificial Sequence: Synthetic peptide
ANTGAAK

SEQ ID NO: 1711 - protein, 7 aa, Artificial Sequence
  Description of Artificial Sequence: Synthetic peptide
SSDSNNR

SEQ ID NO: 1712 - protein, 7 aa, Artificial Sequence
  Description of Artificial Sequence: Synthetic peptide
GTKSVGS

SEQ ID NO: 1713 - protein, 7 aa, Artificial Sequence
  Description of Artificial Sequence: Synthetic peptide
SPLNSSK

SEQ ID NO: 1714 - protein, 7 aa, Artificial Sequence
  Description of Artificial Sequence: Synthetic peptide
TKGGSNT

SEQ ID NO: 1715 - protein, 7 aa, Artificial Sequence
  Description of Artificial Sequence: Synthetic peptide
VNGTRNT

SEQ ID NO: 1716 - protein, 7 aa, Artificial Sequence
  Description of Artificial Sequence: Synthetic peptide
VPNKSSS

SEQ ID NO: 1717 - protein, 7 aa, Artificial Sequence
  Description of Artificial Sequence: Synthetic peptide
KSDAKGN

SEQ ID NO: 1718 - protein, 7 aa, Artificial Sequence
  Description of Artificial Sequence: Synthetic peptide
GEGRPSV

SEQ ID NO: 1719 - protein, 7 aa, Artificial Sequence
  Description of Artificial Sequence: Synthetic peptide
ATERPST

SEQ ID NO: 1720 - protein, 7 aa, Artificial Sequence
  Description of Artificial Sequence: Synthetic peptide
AGTTTNK

SEQ ID NO: 1721 - protein, 7 aa, Artificial Sequence
  Description of Artificial Sequence: Synthetic peptide
DTVRAGS

SEQ ID NO: 1722 - protein, 7 aa, Artificial Sequence
  Description of Artificial Sequence: Synthetic peptide
SQQKTGM

SEQ ID NO: 1723 - protein, 7 aa, Artificial Sequence
  Description of Artificial Sequence: Synthetic peptide
QSDNKTH

SEQ ID NO: 1724 - protein, 7 aa, Artificial Sequence
  Description of Artificial Sequence: Synthetic peptide
KSGERPT

SEQ ID NO: 1725 - protein, 7 aa, Artificial Sequence
  Description of Artificial Sequence: Synthetic peptide
SQSGTLA

SEQ ID NO: 1726 - protein, 7 aa, Artificial Sequence
  Description of Artificial Sequence: Synthetic peptide
SGSDRNS

SEQ ID NO: 1727 - protein, 7 aa, Artificial Sequence
  Description of Artificial Sequence: Synthetic peptide
REDRAKE

SEQ ID NO: 1728 - protein, 7 aa, Artificial Sequence
  Description of Artificial Sequence: Synthetic peptide
MPNSNAS

SEQ ID NO: 1729 - protein, 7 aa, Artificial Sequence
  Description of Artificial Sequence: Synthetic peptide
QGTQTKS

SEQ ID NO: 1730 - protein, 7 aa, Artificial Sequence
  Description of Artificial Sequence: Synthetic peptide
QGVGNTA

SEQ ID NO: 1731 - protein, 7 aa, Artificial Sequence
  Description of Artificial Sequence: Synthetic peptide
AGRQGSN

SEQ ID NO: 1732 - protein, 7 aa, Artificial Sequence
  Description of Artificial Sequence: Synthetic peptide
SPGERAK

SEQ ID NO: 1733 - protein, 7 aa, Artificial Sequence
  Description of Artificial Sequence: Synthetic peptide
SGPSKPA

SEQ ID NO: 1734 - protein, 7 aa, Artificial Sequence
  Description of Artificial Sequence: Synthetic peptide
CTNTKPG

SEQ ID NO: 1735 - protein, 7 aa, Artificial Sequence
  Description of Artificial Sequence: Synthetic peptide
SPPNTGS

SEQ ID NO: 1736 - protein, 7 aa, Artificial Sequence
  Description of Artificial Sequence: Synthetic peptide
DGQRVSL

SEQ ID NO: 1737 - protein, 7 aa, Artificial Sequence
  Description of Artificial Sequence: Synthetic peptide
NDTKSPS

SEQ ID NO: 1738 - protein, 7 aa, Artificial Sequence
  Description of Artificial Sequence: Synthetic peptide
STESPTR

SEQ ID NO: 1739 - protein, 7 aa, Artificial Sequence
  Description of Artificial Sequence: Synthetic peptide
KTSPSTS

SEQ ID NO: 1740 - protein, 7 aa, Artificial Sequence
  Description of Artificial Sequence: Synthetic peptide
LNGSEKS

SEQ ID NO: 1741 - protein, 7 aa, Artificial Sequence
  Description of Artificial Sequence: Synthetic peptide
STQGSVK

SEQ ID NO: 1742 - protein, 7 aa, Artificial Sequence
  Description of Artificial Sequence: Synthetic peptide
ASGSGMH

SEQ ID NO: 1743 - protein, 7 aa, Artificial Sequence
  Description of Artificial Sequence: Synthetic peptide
GGASSKA

SEQ ID NO: 1744 - protein, 7 aa, Artificial Sequence
  Description of Artificial Sequence: Synthetic peptide
IPSDKGT

SEQ ID NO: 1745 - protein, 7 aa, Artificial Sequence
  Description of Artificial Sequence: Synthetic peptide
GEKSKPQ

SEQ ID NO: 1746 - protein, 7 aa, Artificial Sequence
  Description of Artificial Sequence: Synthetic peptide
TQDRSST

SEQ ID NO: 1747 - protein, 7 aa, Artificial Sequence
  Description of Artificial Sequence: Synthetic peptide
AIGKQGT

SEQ ID NO: 1748 - protein, 7 aa, Artificial Sequence
  Description of Artificial Sequence: Synthetic peptide
STGSGMS

SEQ ID NO: 1749 - protein, 7 aa, Artificial Sequence
  Description of Artificial Sequence: Synthetic peptide
ADVRPNT

SEQ ID NO: 1750 - protein, 7 aa, Artificial Sequence
  Description of Artificial Sequence: Synthetic peptide
AGKGTSS

SEQ ID NO: 1751 - protein, 7 aa, Artificial Sequence
  Description of Artificial Sequence: Synthetic peptide
AMGKTSA

SEQ ID NO: 1752 - protein, 7 aa, Artificial Sequence
  Description of Artificial Sequence: Synthetic peptide
KGNSALT

SEQ ID NO: 1753 - protein, 7 aa, Artificial Sequence
  Description of Artificial Sequence: Synthetic peptide
EGQSQKM

SEQ ID NO: 1754 - protein, 7 aa, Artificial Sequence
  Description of Artificial Sequence: Synthetic peptide
HTVKASQ

SEQ ID NO: 1755 - protein, 7 aa, Artificial Sequence
  Description of Artificial Sequence: Synthetic peptide
NGPRSTS

SEQ ID NO: 1756 - protein, 7 aa, Artificial Sequence
  Description of Artificial Sequence: Synthetic peptide
VNSKPAQ

SEQ ID NO: 1757 - protein, 7 aa, Artificial Sequence
  Description of Artificial Sequence: Synthetic peptide
HGESRTS

SEQ ID NO: 1758 - protein, 7 aa, Artificial Sequence
  Description of Artificial Sequence: Synthetic peptide
GRNNTNS

SEQ ID NO: 1759 - protein, 7 aa, Artificial Sequence
  Description of Artificial Sequence: Synthetic peptide
TTNTKVQ

SEQ ID NO: 1760 - protein, 7 aa, Artificial Sequence
  Description of Artificial Sequence: Synthetic peptide
SGTATRD

SEQ ID NO: 1761 - protein, 7 aa, Artificial Sequence
  Description of Artificial Sequence: Synthetic peptide
EPTQSRS

SEQ ID NO: 1762 - protein, 7 aa, Artificial Sequence
  Description of Artificial Sequence: Synthetic peptide
GLASKNS

SEQ ID NO: 1763 - protein, 7 aa, Artificial Sequence
  Description of Artificial Sequence: Synthetic peptide
WGTDKMR

SEQ ID NO: 1764 - protein, 7 aa, Artificial Sequence
  Description of Artificial Sequence: Synthetic peptide
RGGQNSV

SEQ ID NO: 1765 - protein, 7 aa, Artificial Sequence
  Description of Artificial Sequence: Synthetic peptide
GTTNSSR

SEQ ID NO: 1766 - protein, 7 aa, Artificial Sequence
  Description of Artificial Sequence: Synthetic peptide
TANTHPT

SEQ ID NO: 1767 - protein, 7 aa, Artificial Sequence
  Description of Artificial Sequence: Synthetic peptide
QTANSSQ

SEQ ID NO: 1768 - protein, 7 aa, Artificial Sequence
  Description of Artificial Sequence: Synthetic peptide
TTSSHSL

SEQ ID NO: 1769 - protein, 7 aa, Artificial Sequence
  Description of Artificial Sequence: Synthetic peptide
TADNRTA

SEQ ID NO: 1770 - protein, 7 aa, Artificial Sequence
  Description of Artificial Sequence: Synthetic peptide
ETRTGTV

SEQ ID NO: 1771 - protein, 7 aa, Artificial Sequence
  Description of Artificial Sequence: Synthetic peptide
TQGQKAT

SEQ ID NO: 1772 - protein, 7 aa, Artificial Sequence
  Description of Artificial Sequence: Synthetic peptide
ERKTGNG

SEQ ID NO: 1773 - protein, 7 aa, Artificial Sequence
  Description of Artificial Sequence: Synthetic peptide
GDKSSRE

SEQ ID NO: 1774 - protein, 7 aa, Artificial Sequence
  Description of Artificial Sequence: Synthetic peptide
NNSDRRD

SEQ ID NO: 1775 - protein, 7 aa, Artificial Sequence
  Description of Artificial Sequence: Synthetic peptide
APGAHQS

SEQ ID NO: 1776 - protein, 7 aa, Artificial Sequence
  Description of Artificial Sequence: Synthetic peptide
HSQGKNV

SEQ ID NO: 1777 - protein, 7 aa, Artificial Sequence
  Description of Artificial Sequence: Synthetic peptide
SQTSNHI

SEQ ID NO: 1778 - protein, 7 aa, Artificial Sequence
  Description of Artificial Sequence: Synthetic peptide
LGEKSHS

SEQ ID NO: 1779 - protein, 7 aa, Artificial Sequence
  Description of Artificial Sequence: Synthetic peptide
VGDRPAI

SEQ ID NO: 1780 - protein, 7 aa, Artificial Sequence
  Description of Artificial Sequence: Synthetic peptide
SNSQVAS

SEQ ID NO: 1781 - protein, 7 aa, Artificial Sequence
  Description of Artificial Sequence: Synthetic peptide
ASVPSSG

SEQ ID NO: 1782 - protein, 7 aa, Artificial Sequence
  Description of Artificial Sequence: Synthetic peptide
SRDGKVV

SEQ ID NO: 1783 - protein, 7 aa, Artificial Sequence
  Description of Artificial Sequence: Synthetic peptide
GTGKHAA

SEQ ID NO: 1784 - protein, 7 aa, Artificial Sequence
  Description of Artificial Sequence: Synthetic peptide
RGAGNSN

SEQ ID NO: 1785 - protein, 7 aa, Artificial Sequence
  Description of Artificial Sequence: Synthetic peptide
TNVTKSS

SEQ ID NO: 1786 - protein, 7 aa, Artificial Sequence
  Description of Artificial Sequence: Synthetic peptide
SSADRNS

SEQ ID NO: 1787 - protein, 7 aa, Artificial Sequence
  Description of Artificial Sequence: Synthetic peptide
NSGTGSR

SEQ ID NO: 1788 - protein, 7 aa, Artificial Sequence
  Description of Artificial Sequence: Synthetic peptide
SGSRPSV

SEQ ID NO: 1789 - protein, 7 aa, Artificial Sequence
  Description of Artificial Sequence: Synthetic peptide
MGDRSQG

SEQ ID NO: 1790 - protein, 7 aa, Artificial Sequence
  Description of Artificial Sequence: Synthetic peptide
GHNKAVG

SEQ ID NO: 1791 - protein, 7 aa, Artificial Sequence
  Description of Artificial Sequence: Synthetic peptide
SSQKPGG

SEQ ID NO: 1792 - protein, 7 aa, Artificial Sequence
  Description of Artificial Sequence: Synthetic peptide
SGSPANR

SEQ ID NO: 1793 - protein, 7 aa, Artificial Sequence
  Description of Artificial Sequence: Synthetic peptide
MGSGTAT

SEQ ID NO: 1794 - protein, 7 aa, Artificial Sequence
  Description of Artificial Sequence: Synthetic peptide
IGGGPSS

SEQ ID NO: 1795 - protein, 7 aa, Artificial Sequence
  Description of Artificial Sequence: Synthetic peptide
NVRTPTS

SEQ ID NO: 1796 - protein, 7 aa, Artificial Sequence
  Description of Artificial Sequence: Synthetic peptide
SGESQHK

SEQ ID NO: 1797 - protein, 7 aa, Artificial Sequence
  Description of Artificial Sequence: Synthetic peptide
QVSPSTQ

SEQ ID NO: 1798 - protein, 7 aa, Artificial Sequence
  Description of Artificial Sequence: Synthetic peptide
ASHKPIT

SEQ ID NO: 1799 - protein, 7 aa, Artificial Sequence
  Description of Artificial Sequence: Synthetic peptide
ASVPSKA

SEQ ID NO: 1800 - protein, 7 aa, Artificial Sequence
  Description of Artificial Sequence: Synthetic peptide
NTQSNSR

SEQ ID NO: 1801 - protein, 7 aa, Artificial Sequence
  Description of Artificial Sequence: Synthetic peptide
VTGTTQG

SEQ ID NO: 1802 - protein, 7 aa, Artificial Sequence
  Description of Artificial Sequence: Synthetic peptide
TGTTGHS

SEQ ID NO: 1803 - protein, 7 aa, Artificial Sequence
  Description of Artificial Sequence: Synthetic peptide
SRSPSQS

SEQ ID NO: 1804 - protein, 7 aa, Artificial Sequence
  Description of Artificial Sequence: Synthetic peptide
GDMQGGK

SEQ ID NO: 1805 - protein, 7 aa, Artificial Sequence
  Description of Artificial Sequence: Synthetic peptide
TKDTRPI

SEQ ID NO: 1806 - protein, 7 aa, Artificial Sequence
  Description of Artificial Sequence: Synthetic peptide
QNTRSIA

SEQ ID NO: 1807 - protein, 7 aa, Artificial Sequence
  Description of Artificial Sequence: Synthetic peptide
QSAASTK

SEQ ID NO: 1808 - protein, 7 aa, Artificial Sequence
  Description of Artificial Sequence: Synthetic peptide
RNDSKSH

SEQ ID NO: 1809 - protein, 7 aa, Artificial Sequence
  Description of Artificial Sequence: Synthetic peptide
STPQGSG

SEQ ID NO: 1810 - protein, 7 aa, Artificial Sequence
  Description of Artificial Sequence: Synthetic peptide
ATASKVT

SEQ ID NO: 1811 - protein, 7 aa, Artificial Sequence
  Description of Artificial Sequence: Synthetic peptide
EAVAPNK

SEQ ID NO: 1812 - protein, 7 aa, Artificial Sequence
  Description of Artificial Sequence: Synthetic peptide
VDSSRTS

SEQ ID NO: 1813 - protein, 7 aa, Artificial Sequence
  Description of Artificial Sequence: Synthetic peptide
GNSAGSK

SEQ ID NO: 1814 - protein, 7 aa, Artificial Sequence
  Description of Artificial Sequence: Synthetic peptide
NRGEKPG

SEQ ID NO: 1815 - protein, 7 aa, Artificial Sequence
  Description of Artificial Sequence: Synthetic peptide
SVLNKGG

SEQ ID NO: 1816 - protein, 7 aa, Artificial Sequence
  Description of Artificial Sequence: Synthetic peptide
QNNTATQ

SEQ ID NO: 1817 - protein, 7 aa, Artificial Sequence
  Description of Artificial Sequence: Synthetic peptide
QENAANK

SEQ ID NO: 1818 - protein, 7 aa, Artificial Sequence
  Description of Artificial Sequence: Synthetic peptide
ASVSRSS

SEQ ID NO: 1819 - protein, 7 aa, Artificial Sequence
  Description of Artificial Sequence: Synthetic peptide
GAGVKNL

SEQ ID NO: 1820 - protein, 7 aa, Artificial Sequence
  Description of Artificial Sequence: Synthetic peptide
RGDSNKL

SEQ ID NO: 1821 - protein, 7 aa, Artificial Sequence
  Description of Artificial Sequence: Synthetic peptide
SSNSAVR

SEQ ID NO: 1822 - protein, 7 aa, Artificial Sequence
  Description of Artificial Sequence: Synthetic peptide
SQSGQGT

SEQ ID NO: 1823 - protein, 7 aa, Artificial Sequence
  Description of Artificial Sequence: Synthetic peptide
SVDRTQG

SEQ ID NO: 1824 - protein, 7 aa, Artificial Sequence
  Description of Artificial Sequence: Synthetic peptide
IGSSTNA

SEQ ID NO: 1825 - protein, 7 aa, Artificial Sequence
  Description of Artificial Sequence: Synthetic peptide
ENNKSQM

SEQ ID NO: 1826 - protein, 7 aa, Artificial Sequence
  Description of Artificial Sequence: Synthetic peptide
GGSKSAS

SEQ ID NO: 1827 - protein, 7 aa, Artificial Sequence
  Description of Artificial Sequence: Synthetic peptide
LGTQPPV

SEQ ID NO: 1828 - protein, 7 aa, Artificial Sequence
  Description of Artificial Sequence: Synthetic peptide
SLHKPTS

SEQ ID NO: 1829 - protein, 7 aa, Artificial Sequence
  Description of Artificial Sequence: Synthetic peptide
GKQTSVG

SEQ ID NO: 1830 - protein, 7 aa, Artificial Sequence
  Description of Artificial Sequence: Synthetic peptide
RGQTTPG

SEQ ID NO: 1831 - protein, 7 aa, Artificial Sequence
  Description of Artificial Sequence: Synthetic peptide
STGENRG

SEQ ID NO: 1832 - protein, 7 aa, Artificial Sequence
  Description of Artificial Sequence: Synthetic peptide
SAGKSTT

SEQ ID NO: 1833 - protein, 7 aa, Artificial Sequence
  Description of Artificial Sequence: Synthetic peptide
SGGTAMV

SEQ ID NO: 1834 - protein, 7 aa, Artificial Sequence
  Description of Artificial Sequence: Synthetic peptide
HHNAPAQ

SEQ ID NO: 1835 - protein, 7 aa, Artificial Sequence
  Description of Artificial Sequence: Synthetic peptide
TSGSDRL

SEQ ID NO: 1836 - protein, 7 aa, Artificial Sequence
  Description of Artificial Sequence: Synthetic peptide
RPDKQSI

SEQ ID NO: 1837 - protein, 7 aa, Artificial Sequence
  Description of Artificial Sequence: Synthetic peptide
NTTQKGG

SEQ ID NO: 1838 - protein, 7 aa, Artificial Sequence
  Description of Artificial Sequence: Synthetic peptide
TQISTTG

SEQ ID NO: 1839 - protein, 7 aa, Artificial Sequence
  Description of Artificial Sequence: Synthetic peptide
IPSKPAN

SEQ ID NO: 1840 - protein, 7 aa, Artificial Sequence
  Description of Artificial Sequence: Synthetic peptide
DGNKVLG

SEQ ID NO: 1841 - protein, 7 aa, Artificial Sequence
  Description of Artificial Sequence: Synthetic peptide
APGQKPL

SEQ ID NO: 1842 - protein, 7 aa, Artificial Sequence
  Description of Artificial Sequence: Synthetic peptide
YQAADTK

SEQ ID NO: 1843 - protein, 7 aa, Artificial Sequence
  Description of Artificial Sequence: Synthetic peptide
GEGSKSR

SEQ ID NO: 1844 - protein, 7 aa, Artificial Sequence
  Description of Artificial Sequence: Synthetic peptide
DAKVNGR

SEQ ID NO: 1845 - protein, 7 aa, Artificial Sequence
  Description of Artificial Sequence: Synthetic peptide
DGANRSS

SEQ ID NO: 1846 - protein, 7 aa, Artificial Sequence
  Description of Artificial Sequence: Synthetic peptide
SSQQGPA

SEQ ID NO: 1847 - protein, 7 aa, Artificial Sequence
  Description of Artificial Sequence: Synthetic peptide
QRSKDSA

SEQ ID NO: 1848 - protein, 7 aa, Artificial Sequence
  Description of Artificial Sequence: Synthetic peptide
NRVTKSE

SEQ ID NO: 1849 - protein, 7 aa, Artificial Sequence
  Description of Artificial Sequence: Synthetic peptide
DQRGSVS

SEQ ID NO: 1850 - protein, 7 aa, Artificial Sequence
  Description of Artificial Sequence: Synthetic peptide
GQVPKTG

SEQ ID NO: 1851 - protein, 7 aa, Artificial Sequence
  Description of Artificial Sequence: Synthetic peptide
SGSSKGH

SEQ ID NO: 1852 - protein, 7 aa, Artificial Sequence
  Description of Artificial Sequence: Synthetic peptide
LQQKSHG

SEQ ID NO: 1853 - protein, 7 aa, Artificial Sequence
  Description of Artificial Sequence: Synthetic peptide
DSGANRV

SEQ ID NO: 1854 - protein, 7 aa, Artificial Sequence
  Description of Artificial Sequence: Synthetic peptide
AQGNKAH

SEQ ID NO: 1855 - protein, 7 aa, Artificial Sequence
  Description of Artificial Sequence: Synthetic peptide
ASDNKPS

SEQ ID NO: 1856 - protein, 7 aa, Artificial Sequence
  Description of Artificial Sequence: Synthetic peptide
SQAHSSA

SEQ ID NO: 1857 - protein, 7 aa, Artificial Sequence
  Description of Artificial Sequence: Synthetic peptide
NSSKTSS

SEQ ID NO: 1858 - protein, 7 aa, Artificial Sequence
  Description of Artificial Sequence: Synthetic peptide
TSEGTHR

SEQ ID NO: 1859 - protein, 7 aa, Artificial Sequence
  Description of Artificial Sequence: Synthetic peptide
DGPKPGS

SEQ ID NO: 1860 - protein, 7 aa, Artificial Sequence
  Description of Artificial Sequence: Synthetic peptide
GRSQTSV

SEQ ID NO: 1861 - protein, 7 aa, Artificial Sequence
  Description of Artificial Sequence: Synthetic peptide
TQEGKQS

SEQ ID NO: 1862 - protein, 7 aa, Artificial Sequence
  Description of Artificial Sequence: Synthetic peptide
ELSSPRN

SEQ ID NO: 1863 - protein, 7 aa, Artificial Sequence
  Description of Artificial Sequence: Synthetic peptide
ASSSKTS

SEQ ID NO: 1864 - protein, 7 aa, Artificial Sequence
  Description of Artificial Sequence: Synthetic peptide
AGTTKNS

SEQ ID NO: 1865 - protein, 7 aa, Artificial Sequence
  Description of Artificial Sequence: Synthetic peptide
GVAKVGG

SEQ ID NO: 1866 - protein, 7 aa, Artificial Sequence
  Description of Artificial Sequence: Synthetic peptide
STNTKAL

SEQ ID NO: 1867 - protein, 7 aa, Artificial Sequence
  Description of Artificial Sequence: Synthetic peptide
EHTGKQM

SEQ ID NO: 1868 - protein, 7 aa, Artificial Sequence
  Description of Artificial Sequence: Synthetic peptide
QTGSNNK

SEQ ID NO: 1869 - protein, 7 aa, Artificial Sequence
  Description of Artificial Sequence: Synthetic peptide
LQNKSSL

SEQ ID NO: 1870 - protein, 7 aa, Artificial Sequence
  Description of Artificial Sequence: Synthetic peptide
SPSTNGR

SEQ ID NO: 1871 - protein, 7 aa, Artificial Sequence
  Description of Artificial Sequence: Synthetic peptide
NSVPGST

SEQ ID NO: 1872 - protein, 7 aa, Artificial Sequence
  Description of Artificial Sequence: Synthetic peptide
TTVKPNL

SEQ ID NO: 1873 - protein, 7 aa, Artificial Sequence
  Description of Artificial Sequence: Synthetic peptide
GDTPSRK

SEQ ID NO: 1874 - protein, 7 aa, Artificial Sequence
  Description of Artificial Sequence: Synthetic peptide
TTTKASA

SEQ ID NO: 1875 - protein, 7 aa, Artificial Sequence
  Description of Artificial Sequence: Synthetic peptide
AGMGKAS

SEQ ID NO: 1876 - protein, 7 aa, Artificial Sequence
  Description of Artificial Sequence: Synthetic peptide
LSGQSST

SEQ ID NO: 1877 - protein, 7 aa, Artificial Sequence
  Description of Artificial Sequence: Synthetic peptide
RGSSSST

SEQ ID NO: 1878 - protein, 7 aa, Artificial Sequence
  Description of Artificial Sequence: Synthetic peptide
SGSKALE

SEQ ID NO: 1879 - protein, 7 aa, Artificial Sequence
  Description of Artificial Sequence: Synthetic peptide
GPSTKSL

SEQ ID NO: 1880 - protein, 7 aa, Artificial Sequence
  Description of Artificial Sequence: Synthetic peptide
GTSTALK

SEQ ID NO: 1881 - protein, 7 aa, Artificial Sequence
  Description of Artificial Sequence: Synthetic peptide
LPSTNGS

SEQ ID NO: 1882 - protein, 7 aa, Artificial Sequence
  Description of Artificial Sequence: Synthetic peptide
NRQDKPS

SEQ ID NO: 1883 - protein, 7 aa, Artificial Sequence
  Description of Artificial Sequence: Synthetic peptide
RSGERPS

SEQ ID NO: 1884 - protein, 7 aa, Artificial Sequence
  Description of Artificial Sequence: Synthetic peptide
AQHPKQQ

SEQ ID NO: 1885 - protein, 7 aa, Artificial Sequence
  Description of Artificial Sequence: Synthetic peptide
GSDRNSG

SEQ ID NO: 1886 - protein, 7 aa, Artificial Sequence
  Description of Artificial Sequence: Synthetic peptide
SQTAAPT

SEQ ID NO: 1887 - protein, 7 aa, Artificial Sequence
  Description of Artificial Sequence: Synthetic peptide
SVSDRNK

SEQ ID NO: 1888 - protein, 7 aa, Artificial Sequence
  Description of Artificial Sequence: Synthetic peptide
GPTQKAN

SEQ ID NO: 1889 - protein, 7 aa, Artificial Sequence
  Description of Artificial Sequence: Synthetic peptide
GGASSNT

SEQ ID NO: 1890 - protein, 7 aa, Artificial Sequence
  Description of Artificial Sequence: Synthetic peptide
SSKAKSD

SEQ ID NO: 1891 - protein, 7 aa, Artificial Sequence
  Description of Artificial Sequence: Synthetic peptide
STNRATG

SEQ ID NO: 1892 - protein, 7 aa, Artificial Sequence
  Description of Artificial Sequence: Synthetic peptide
RTGTGAT

SEQ ID NO: 1893 - protein, 7 aa, Artificial Sequence
  Description of Artificial Sequence: Synthetic peptide
RSSTPTQ

SEQ ID NO: 1894 - protein, 7 aa, Artificial Sequence
  Description of Artificial Sequence: Synthetic peptide
STASKQA

SEQ ID NO: 1895 - protein, 7 aa, Artificial Sequence
  Description of Artificial Sequence: Synthetic peptide
TGAGPNL

SEQ ID NO: 1896 - protein, 7 aa, Artificial Sequence
  Description of Artificial Sequence: Synthetic peptide
ASTSPAT

SEQ ID NO: 1897 - protein, 7 aa, Artificial Sequence
  Description of Artificial Sequence: Synthetic peptide
VPSSSPK

SEQ ID NO: 1898 - protein, 7 aa, Artificial Sequence
  Description of Artificial Sequence: Synthetic peptide
VPTSKAV

SEQ ID NO: 1899 - protein, 7 aa, Artificial Sequence
  Description of Artificial Sequence: Synthetic peptide
KGASNVS

SEQ ID NO: 1900 - protein, 7 aa, Artificial Sequence
  Description of Artificial Sequence: Synthetic peptide
NGADKQR

SEQ ID NO: 1901 - protein, 7 aa, Artificial Sequence
  Description of Artificial Sequence: Synthetic peptide
TQSQRAS

SEQ ID NO: 1902 - protein, 7 aa, Artificial Sequence
  Description of Artificial Sequence: Synthetic peptide
THGAPNA

SEQ ID NO: 1903 - protein, 7 aa, Artificial Sequence
  Description of Artificial Sequence: Synthetic peptide
RTGDSGG

SEQ ID NO: 1904 - protein, 7 aa, Artificial Sequence
  Description of Artificial Sequence: Synthetic peptide
RGESKFT

SEQ ID NO: 1905 - protein, 7 aa, Artificial Sequence
  Description of Artificial Sequence: Synthetic peptide
SQNSKQV

SEQ ID NO: 1906 - protein, 7 aa, Artificial Sequence
  Description of Artificial Sequence: Synthetic peptide
MPGKTSS

SEQ ID NO: 1907 - protein, 7 aa, Artificial Sequence
  Description of Artificial Sequence: Synthetic peptide
MASKDNR

SEQ ID NO: 1908 - protein, 7 aa, Artificial Sequence
  Description of Artificial Sequence: Synthetic peptide
LTEKSSK

SEQ ID NO: 1909 - protein, 7 aa, Artificial Sequence
  Description of Artificial Sequence: Synthetic peptide
DSGKSSR

SEQ ID NO: 1910 - protein, 7 aa, Artificial Sequence
  Description of Artificial Sequence: Synthetic peptide
DGSNGHR

SEQ ID NO: 1911 - protein, 7 aa, Artificial Sequence
  Description of Artificial Sequence: Synthetic peptide
AGVRDMT

SEQ ID NO: 1912 - protein, 7 aa, Artificial Sequence
  Description of Artificial Sequence: Synthetic peptide
GLPNGQK

SEQ ID NO: 1913 - protein, 7 aa, Artificial Sequence
  Description of Artificial Sequence: Synthetic peptide
VGSRDQV

SEQ ID NO: 1914 - protein, 7 aa, Artificial Sequence
  Description of Artificial Sequence: Synthetic peptide
VSKPAMV

SEQ ID NO: 1915 - protein, 7 aa, Artificial Sequence
  Description of Artificial Sequence: Synthetic peptide
VSTAKAQ

SEQ ID NO: 1916 - protein, 7 aa, Artificial Sequence
  Description of Artificial Sequence: Synthetic peptide
SRATQTV

SEQ ID NO: 1917 - protein, 7 aa, Artificial Sequence
  Description of Artificial Sequence: Synthetic peptide
QPNSKPV

SEQ ID NO: 1918 - protein, 7 aa, Artificial Sequence
  Description of Artificial Sequence: Synthetic peptide
SGKGQLN

SEQ ID NO: 1919 - protein, 7 aa, Artificial Sequence
  Description of Artificial Sequence: Synthetic peptide
GAASGQV

SEQ ID NO: 1920 - protein, 7 aa, Artificial Sequence
  Description of Artificial Sequence: Synthetic peptide
SQMANSK

SEQ ID NO: 1921 - protein, 7 aa, Artificial Sequence
  Description of Artificial Sequence: Synthetic peptide
QTRTANQ

SEQ ID NO: 1922 - protein, 7 aa, Artificial Sequence
  Description of Artificial Sequence: Synthetic peptide
EGADRHR

SEQ ID NO: 1923 - protein, 7 aa, Artificial Sequence
  Description of Artificial Sequence: Synthetic peptide
VQNERSR

SEQ ID NO: 1924 - protein, 7 aa, Artificial Sequence
  Description of Artificial Sequence: Synthetic peptide
SSNSTRS

SEQ ID NO: 1925 - protein, 7 aa, Artificial Sequence
  Description of Artificial Sequence: Synthetic peptide
SNGNSRA

SEQ ID NO: 1926 - protein, 7 aa, Artificial Sequence
  Description of Artificial Sequence: Synthetic peptide
SVSKSTN

SEQ ID NO: 1927 - protein, 7 aa, Artificial Sequence
  Description of Artificial Sequence: Synthetic peptide
GIGKNGA

SEQ ID NO: 1928 - protein, 7 aa, Artificial Sequence
  Description of Artificial Sequence: Synthetic peptide
AESRPPL

SEQ ID NO: 1929 - protein, 7 aa, Artificial Sequence
  Description of Artificial Sequence: Synthetic peptide
TNNTRPE

SEQ ID NO: 1930 - protein, 7 aa, Artificial Sequence
  Description of Artificial Sequence: Synthetic peptide
VVAKSSS

SEQ ID NO: 1931 - protein, 7 aa, Artificial Sequence
  Description of Artificial Sequence: Synthetic peptide
QGAGSMA

SEQ ID NO: 1932 - protein, 7 aa, Artificial Sequence
  Description of Artificial Sequence: Synthetic peptide
TGVEKLH

SEQ ID NO: 1933 - protein, 7 aa, Artificial Sequence
  Description of Artificial Sequence: Synthetic peptide
LSDKPAR

SEQ ID NO: 1934 - protein, 7 aa, Artificial Sequence
  Description of Artificial Sequence: Synthetic peptide
ERSPSAT

SEQ ID NO: 1935 - protein, 7 aa, Artificial Sequence
  Description of Artificial Sequence: Synthetic peptide
ITASPTI

SEQ ID NO: 1936 - protein, 7 aa, Artificial Sequence
  Description of Artificial Sequence: Synthetic peptide
GLNKEVR

SEQ ID NO: 1937 - protein, 7 aa, Artificial Sequence
  Description of Artificial Sequence: Synthetic peptide
HGDRTNS

SEQ ID NO: 1938 - protein, 7 aa, Artificial Sequence
  Description of Artificial Sequence: Synthetic peptide
LGDRQMH

SEQ ID NO: 1939 - protein, 7 aa, Artificial Sequence
  Description of Artificial Sequence: Synthetic peptide
QSIHKSE

SEQ ID NO: 1940 - protein, 7 aa, Artificial Sequence
  Description of Artificial Sequence: Synthetic peptide
STSSQKT

SEQ ID NO: 1941 - protein, 7 aa, Artificial Sequence
  Description of Artificial Sequence: Synthetic peptide
DRAVQNL

SEQ ID NO: 1942 - protein, 7 aa, Artificial Sequence
  Description of Artificial Sequence: Synthetic peptide
TSGTSIL

SEQ ID NO: 1943 - protein, 7 aa, Artificial Sequence
  Description of Artificial Sequence: Synthetic peptide
QQGASQA

SEQ ID NO: 1944 - protein, 7 aa, Artificial Sequence
  Description of Artificial Sequence: Synthetic peptide
LGGASVK

SEQ ID NO: 1945 - protein, 7 aa, Artificial Sequence
  Description of Artificial Sequence: Synthetic peptide
TKSTPSV

SEQ ID NO: 1946 - protein, 7 aa, Artificial Sequence
  Description of Artificial Sequence: Synthetic peptide
ALTSKSQ

SEQ ID NO: 1947 - protein, 7 aa, Artificial Sequence
  Description of Artificial Sequence: Synthetic peptide
KSSGDQT

SEQ ID NO: 1948 - protein, 7 aa, Artificial Sequence
  Description of Artificial Sequence: Synthetic peptide
HSTPTNT

SEQ ID NO: 1949 - protein, 7 aa, Artificial Sequence
  Description of Artificial Sequence: Synthetic peptide
LQTSKPQ

SEQ ID NO: 1950 - protein, 7 aa, Artificial Sequence
  Description of Artificial Sequence: Synthetic peptide
RASPPSS

SEQ ID NO: 1951 - protein, 7 aa, Artificial Sequence
  Description of Artificial Sequence: Synthetic peptide
TPAKAQL

SEQ ID NO: 1952 - protein, 7 aa, Artificial Sequence
  Description of Artificial Sequence: Synthetic peptide
SSDRSNV

SEQ ID NO: 1953 - protein, 7 aa, Artificial Sequence
  Description of Artificial Sequence: Synthetic peptide
TGNSSVI

SEQ ID NO: 1954 - protein, 7 aa, Artificial Sequence
  Description of Artificial Sequence: Synthetic peptide
LSGNKAI

SEQ ID NO: 1955 - protein, 7 aa, Artificial Sequence
  Description of Artificial Sequence: Synthetic peptide
NGASRTT

SEQ ID NO: 1956 - protein, 7 aa, Artificial Sequence
  Description of Artificial Sequence: Synthetic peptide
ESTATPR

SEQ ID NO: 1957 - protein, 7 aa, Artificial Sequence
  Description of Artificial Sequence: Synthetic peptide
KSSGSPL

SEQ ID NO: 1958 - protein, 7 aa, Artificial Sequence
  Description of Artificial Sequence: Synthetic peptide
QGGASNR

SEQ ID NO: 1959 - protein, 7 aa, Artificial Sequence
  Description of Artificial Sequence: Synthetic peptide
HVKPTSV

SEQ ID NO: 1960 - protein, 7 aa, Artificial Sequence
  Description of Artificial Sequence: Synthetic peptide
GVNSGGH

SEQ ID NO: 1961 - protein, 7 aa, Artificial Sequence
  Description of Artificial Sequence: Synthetic peptide
TPSAKGN

SEQ ID NO: 1962 - protein, 7 aa, Artificial Sequence
  Description of Artificial Sequence: Synthetic peptide
KQGSSSV

SEQ ID NO: 1963 - protein, 7 aa, Artificial Sequence
  Description of Artificial Sequence: Synthetic peptide
TKQSSIA

SEQ ID NO: 1964 - protein, 7 aa, Artificial Sequence
  Description of Artificial Sequence: Synthetic peptide
SRAQGTA

SEQ ID NO: 1965 - protein, 7 aa, Artificial Sequence
  Description of Artificial Sequence: Synthetic peptide
TGRNGNQ

SEQ ID NO: 1966 - protein, 7 aa, Artificial Sequence
  Description of Artificial Sequence: Synthetic peptide
GSPQKNQ

SEQ ID NO: 1967 - protein, 7 aa, Artificial Sequence
  Description of Artificial Sequence: Synthetic peptide
TPSKERS

SEQ ID NO: 1968 - protein, 7 aa, Artificial Sequence
  Description of Artificial Sequence: Synthetic peptide
ITSQKSV

SEQ ID NO: 1969 - protein, 7 aa, Artificial Sequence
  Description of Artificial Sequence: Synthetic peptide
IQTKDQL

SEQ ID NO: 1970 - protein, 7 aa, Artificial Sequence
  Description of Artificial Sequence: Synthetic peptide
YGSDSNR

SEQ ID NO: 1971 - protein, 7 aa, Artificial Sequence
  Description of Artificial Sequence: Synthetic peptide
GGSPRGT

SEQ ID NO: 1972 - protein, 7 aa, Artificial Sequence
  Description of Artificial Sequence: Synthetic peptide
LTKASSV

SEQ ID NO: 1973 - protein, 7 aa, Artificial Sequence
  Description of Artificial Sequence: Synthetic peptide
SSSQKPM

SEQ ID NO: 1974 - protein, 7 aa, Artificial Sequence
  Description of Artificial Sequence: Synthetic peptide
DSQQRGS

SEQ ID NO: 1975 - protein, 7 aa, Artificial Sequence
  Description of Artificial Sequence: Synthetic peptide
STVKAHS

SEQ ID NO: 1976 - protein, 7 aa, Artificial Sequence
  Description of Artificial Sequence: Synthetic peptide
KSQSPST

SEQ ID NO: 1977 - protein, 7 aa, Artificial Sequence
  Description of Artificial Sequence: Synthetic peptide
ISTSPGK

SEQ ID NO: 1978 - protein, 7 aa, Artificial Sequence
  Description of Artificial Sequence: Synthetic peptide
GSGQRPD

SEQ ID NO: 1979 - protein, 7 aa, Artificial Sequence
  Description of Artificial Sequence: Synthetic peptide
TVSKSNS

SEQ ID NO: 1980 - protein, 7 aa, Artificial Sequence
  Description of Artificial Sequence: Synthetic peptide
HSGGSSV

SEQ ID NO: 1981 - protein, 7 aa, Artificial Sequence
  Description of Artificial Sequence: Synthetic peptide
GSTKPLL

SEQ ID NO: 1982 - protein, 7 aa, Artificial Sequence
  Description of Artificial Sequence: Synthetic peptide
HTTKSAT

SEQ ID NO: 1983 - protein, 7 aa, Artificial Sequence
  Description of Artificial Sequence: Synthetic peptide
SSSKGNS

SEQ ID NO: 1984 - protein, 7 aa, Artificial Sequence
  Description of Artificial Sequence: Synthetic peptide
SLAKGNN

SEQ ID NO: 1985 - protein, 7 aa, Artificial Sequence
  Description of Artificial Sequence: Synthetic peptide
AQGKPGP

SEQ ID NO: 1986 - protein, 7 aa, Artificial Sequence
  Description of Artificial Sequence: Synthetic peptide
TGGNKST

SEQ ID NO: 1987 - protein, 7 aa, Artificial Sequence
  Description of Artificial Sequence: Synthetic peptide
MGDNRAS

SEQ ID NO: 1988 - protein, 7 aa, Artificial Sequence
  Description of Artificial Sequence: Synthetic peptide
ERTVSPT

SEQ ID NO: 1989 - protein, 7 aa, Artificial Sequence
  Description of Artificial Sequence: Synthetic peptide
SPIQASK

SEQ ID NO: 1990 - protein, 7 aa, Artificial Sequence
  Description of Artificial Sequence: Synthetic peptide
TGTNAVM

SEQ ID NO: 1991 - protein, 7 aa, Artificial Sequence
  Description of Artificial Sequence: Synthetic peptide
HTNTKVG

SEQ ID NO: 1992 - protein, 7 aa, Artificial Sequence
  Description of Artificial Sequence: Synthetic peptide
KGQGPAV

SEQ ID NO: 1993 - protein, 7 aa, Artificial Sequence
  Description of Artificial Sequence: Synthetic peptide
NSDRSHV

SEQ ID NO: 1994 - protein, 7 aa, Artificial Sequence
  Description of Artificial Sequence: Synthetic peptide
TTSSKQE

SEQ ID NO: 1995 - protein, 7 aa, Artificial Sequence
  Description of Artificial Sequence: Synthetic peptide
LQTKSQT

SEQ ID NO: 1996 - protein, 7 aa, Artificial Sequence
  Description of Artificial Sequence: Synthetic peptide
DAGGNSA

SEQ ID NO: 1997 - protein, 7 aa, Artificial Sequence
  Description of Artificial Sequence: Synthetic peptide
KGSNNGQ

SEQ ID NO: 1998 - protein, 7 aa, Artificial Sequence
  Description of Artificial Sequence: Synthetic peptide
GLGKSAL

SEQ ID NO: 1999 - protein, 7 aa, Artificial Sequence
  Description of Artificial Sequence: Synthetic peptide
SQGAPTK

SEQ ID NO: 2000 - protein, 7 aa, Artificial Sequence
  Description of Artificial Sequence: Synthetic peptide
TTSDKIV

SEQ ID NO: 2001 - protein, 7 aa, Artificial Sequence
  Description of Artificial Sequence: Synthetic peptide
HSSQSQS

SEQ ID NO: 2002 - protein, 7 aa, Artificial Sequence
  Description of Artificial Sequence: Synthetic peptide
EAGRPNL

SEQ ID NO: 2003 - protein, 7 aa, Artificial Sequence
  Description of Artificial Sequence: Synthetic peptide
GADRKAQ

SEQ ID NO: 2004 - protein, 7 aa, Artificial Sequence
  Description of Artificial Sequence: Synthetic peptide
YGKSNQI

SEQ ID NO: 2005 - protein, 7 aa, Artificial Sequence
  Description of Artificial Sequence: Synthetic peptide
CTNGANK

SEQ ID NO: 2006 - protein, 7 aa, Artificial Sequence
  Description of Artificial Sequence: Synthetic peptide
QSSQAMT

SEQ ID NO: 2007 - protein, 7 aa, Artificial Sequence
  Description of Artificial Sequence: Synthetic peptide
HTTSPNN

SEQ ID NO: 2008 - protein, 7 aa, Artificial Sequence
  Description of Artificial Sequence: Synthetic peptide
SGTSSHS

SEQ ID NO: 2009 - protein, 7 aa, Artificial Sequence
  Description of Artificial Sequence: Synthetic peptide
SRNNGSG

SEQ ID NO: 2010 - protein, 7 aa, Artificial Sequence
  Description of Artificial Sequence: Synthetic peptide
TLNTAAG

SEQ ID NO: 2011 - protein, 7 aa, Artificial Sequence
  Description of Artificial Sequence: Synthetic peptide
ERQSTSS

SEQ ID NO: 2012 - protein, 7 aa, Artificial Sequence
  Description of Artificial Sequence: Synthetic peptide
GSGAPQT

SEQ ID NO: 2013 - protein, 7 aa, Artificial Sequence
  Description of Artificial Sequence: Synthetic peptide
EQNTVNR

SEQ ID NO: 2014 - protein, 7 aa, Artificial Sequence
  Description of Artificial Sequence: Synthetic peptide
KTATPSL

SEQ ID NO: 2015 - protein, 7 aa, Artificial Sequence
  Description of Artificial Sequence: Synthetic peptide
SEKAQPH

SEQ ID NO: 2016 - protein, 7 aa, Artificial Sequence
  Description of Artificial Sequence: Synthetic peptide
NGHTSTL

SEQ ID NO: 2017 - protein, 7 aa, Artificial Sequence
  Description of Artificial Sequence: Synthetic peptide
STTSEPR

SEQ ID NO: 2018 - protein, 7 aa, Artificial Sequence
  Description of Artificial Sequence: Synthetic peptide
SGTSPHL

SEQ ID NO: 2019 - protein, 7 aa, Artificial Sequence
  Description of Artificial Sequence: Synthetic peptide
TPSKGAT

SEQ ID NO: 2020 - protein, 7 aa, Artificial Sequence
  Description of Artificial Sequence: Synthetic peptide
GQENKVT

SEQ ID NO: 2021 - protein, 7 aa, Artificial Sequence
  Description of Artificial Sequence: Synthetic peptide
GTSQLSK

SEQ ID NO: 2022 - protein, 7 aa, Artificial Sequence
  Description of Artificial Sequence: Synthetic peptide
QSVKPPV

SEQ ID NO: 2023 - protein, 7 aa, Artificial Sequence
  Description of Artificial Sequence: Synthetic peptide
DNGRPSQ

SEQ ID NO: 2024 - protein, 7 aa, Artificial Sequence
  Description of Artificial Sequence: Synthetic peptide
ASGKPTS

SEQ ID NO: 2025 - protein, 7 aa, Artificial Sequence
  Description of Artificial Sequence: Synthetic peptide
CNNSGKG

SEQ ID NO: 2026 - protein, 7 aa, Artificial Sequence
  Description of Artificial Sequence: Synthetic peptide
FTEPGQK

SEQ ID NO: 2027 - protein, 7 aa, Artificial Sequence
  Description of Artificial Sequence: Synthetic peptide
SGASTGS

SEQ ID NO: 2028 - protein, 7 aa, Artificial Sequence
  Description of Artificial Sequence: Synthetic peptide
ASQTSNK

SEQ ID NO: 2029 - protein, 7 aa, Artificial Sequence
  Description of Artificial Sequence: Synthetic peptide
SSASKGN

SEQ ID NO: 2030 - protein, 7 aa, Artificial Sequence
  Description of Artificial Sequence: Synthetic peptide
STSGRHE

SEQ ID NO: 2031 - protein, 7 aa, Artificial Sequence
  Description of Artificial Sequence: Synthetic peptide
LGDSRTM

SEQ ID NO: 2032 - protein, 7 aa, Artificial Sequence
  Description of Artificial Sequence: Synthetic peptide
AATPGTH

SEQ ID NO: 2033 - protein, 7 aa, Artificial Sequence
  Description of Artificial Sequence: Synthetic peptide
SGNSRQS

SEQ ID NO: 2034 - protein, 7 aa, Artificial Sequence
  Description of Artificial Sequence: Synthetic peptide
RQGNAPS

SEQ ID NO: 2035 - protein, 7 aa, Artificial Sequence
  Description of Artificial Sequence: Synthetic peptide
STQSPTH

SEQ ID NO: 2036 - protein, 7 aa, Artificial Sequence
  Description of Artificial Sequence: Synthetic peptide
QGGSHQL

SEQ ID NO: 2037 - protein, 7 aa, Artificial Sequence
  Description of Artificial Sequence: Synthetic peptide
TPSTAGG

SEQ ID NO: 2038 - protein, 7 aa, Artificial Sequence
  Description of Artificial Sequence: Synthetic peptide
TLEQKSV

SEQ ID NO: 2039 - protein, 7 aa, Artificial Sequence
  Description of Artificial Sequence: Synthetic peptide
NVGNSSV

SEQ ID NO: 2040 - protein, 7 aa, Artificial Sequence
  Description of Artificial Sequence: Synthetic peptide
ITSKVAT

SEQ ID NO: 2041 - protein, 7 aa, Artificial Sequence
  Description of Artificial Sequence: Synthetic peptide
TTNRPGD

SEQ ID NO: 2042 - protein, 7 aa, Artificial Sequence
  Description of Artificial Sequence: Synthetic peptide
SASNTPR

SEQ ID NO: 2043 - protein, 7 aa, Artificial Sequence
  Description of Artificial Sequence: Synthetic peptide
DGARTAV

SEQ ID NO: 2044 - protein, 7 aa, Artificial Sequence
  Description of Artificial Sequence: Synthetic peptide
GSRAPAL

SEQ ID NO: 2045 - protein, 7 aa, Artificial Sequence
  Description of Artificial Sequence: Synthetic peptide
DSNSPQR

SEQ ID NO: 2046 - protein, 7 aa, Artificial Sequence
  Description of Artificial Sequence: Synthetic peptide
GSKSTIS

SEQ ID NO: 2047 - protein, 7 aa, Artificial Sequence
  Description of Artificial Sequence: Synthetic peptide
SGPSPSS

SEQ ID NO: 2048 - protein, 7 aa, Artificial Sequence
  Description of Artificial Sequence: Synthetic peptide
SKGNSAV

SEQ ID NO: 2049 - protein, 7 aa, Artificial Sequence
  Description of Artificial Sequence: Synthetic peptide
NVSKSSS

SEQ ID NO: 2050 - protein, 7 aa, Artificial Sequence
  Description of Artificial Sequence: Synthetic peptide
TGQGKAS

SEQ ID NO: 2051 - protein, 7 aa, Artificial Sequence
  Description of Artificial Sequence: Synthetic peptide
GRAESPR

SEQ ID NO: 2052 - protein, 7 aa, Artificial Sequence
  Description of Artificial Sequence: Synthetic peptide
QAAKSTS

SEQ ID NO: 2053 - protein, 7 aa, Artificial Sequence
  Description of Artificial Sequence: Synthetic peptide
SPIKSSA

SEQ ID NO: 2054 - protein, 7 aa, Artificial Sequence
  Description of Artificial Sequence: Synthetic peptide
NQAASHK

SEQ ID NO: 2055 - protein, 7 aa, Artificial Sequence
  Description of Artificial Sequence: Synthetic peptide
TATNSPR

SEQ ID NO: 2056 - protein, 7 aa, Artificial Sequence
  Description of Artificial Sequence: Synthetic peptide
RGTSTLA

SEQ ID NO: 2057 - protein, 7 aa, Artificial Sequence
  Description of Artificial Sequence: Synthetic peptide
QPTEKSV

SEQ ID NO: 2058 - protein, 7 aa, Artificial Sequence
  Description of Artificial Sequence: Synthetic peptide
AGMGTNT

SEQ ID NO: 2059 - protein, 7 aa, Artificial Sequence
  Description of Artificial Sequence: Synthetic peptide
GLERNLG

SEQ ID NO: 2060 - protein, 7 aa, Artificial Sequence
  Description of Artificial Sequence: Synthetic peptide
SLTAPAK

SEQ ID NO: 2061 - protein, 7 aa, Artificial Sequence
  Description of Artificial Sequence: Synthetic peptide
TSEPSAK

SEQ ID NO: 2062 - protein, 7 aa, Artificial Sequence
  Description of Artificial Sequence: Synthetic peptide
QRESPTR

SEQ ID NO: 2063 - protein, 7 aa, Artificial Sequence
  Description of Artificial Sequence: Synthetic peptide
LSPGAGS

SEQ ID NO: 2064 - protein, 7 aa, Artificial Sequence
  Description of Artificial Sequence: Synthetic peptide
LAGGSTS

SEQ ID NO: 2065 - protein, 7 aa, Artificial Sequence
  Description of Artificial Sequence: Synthetic peptide
NTGAGQL

SEQ ID NO: 2066 - protein, 7 aa, Artificial Sequence
  Description of Artificial Sequence: Synthetic peptide
TCTKEGC

SEQ ID NO: 2067 - protein, 7 aa, Artificial Sequence
  Description of Artificial Sequence: Synthetic peptide
VTTNKTE

SEQ ID NO: 2068 - protein, 7 aa, Artificial Sequence
  Description of Artificial Sequence: Synthetic peptide
TLSKSAA

SEQ ID NO: 2069 - protein, 7 aa, Artificial Sequence
  Description of Artificial Sequence: Synthetic peptide
RGEQSTF

SEQ ID NO: 2070 - protein, 7 aa, Artificial Sequence
  Description of Artificial Sequence: Synthetic peptide
ATTPGHT

SEQ ID NO: 2071 - protein, 7 aa, Artificial Sequence
  Description of Artificial Sequence: Synthetic peptide
HASSQSK

SEQ ID NO: 2072 - protein, 7 aa, Artificial Sequence
  Description of Artificial Sequence: Synthetic peptide
RSHDKAA

SEQ ID NO: 2073 - protein, 7 aa, Artificial Sequence
  Description of Artificial Sequence: Synthetic peptide
QKEDRIA

SEQ ID NO: 2074 - protein, 7 aa, Artificial Sequence
  Description of Artificial Sequence: Synthetic peptide
VTNTKPQ

SEQ ID NO: 2075 - protein, 7 aa, Artificial Sequence
  Description of Artificial Sequence: Synthetic peptide
SGSNKFS

SEQ ID NO: 2076 - protein, 7 aa, Artificial Sequence
  Description of Artificial Sequence: Synthetic peptide
VAKSPMT

SEQ ID NO: 2077 - protein, 7 aa, Artificial Sequence
  Description of Artificial Sequence: Synthetic peptide
NSSSPTH

SEQ ID NO: 2078 - protein, 7 aa, Artificial Sequence
  Description of Artificial Sequence: Synthetic peptide
DSTAKPR

SEQ ID NO: 2079 - protein, 7 aa, Artificial Sequence
  Description of Artificial Sequence: Synthetic peptide
NISGSSK

SEQ ID NO: 2080 - protein, 7 aa, Artificial Sequence
  Description of Artificial Sequence: Synthetic peptide
TGGGQSL

SEQ ID NO: 2081 - protein, 7 aa, Artificial Sequence
  Description of Artificial Sequence: Synthetic peptide
RDGGSSR

SEQ ID NO: 2082 - protein, 7 aa, Artificial Sequence
  Description of Artificial Sequence: Synthetic peptide
AGTGKLI

SEQ ID NO: 2083 - protein, 7 aa, Artificial Sequence
  Description of Artificial Sequence: Synthetic peptide
ISTDKMK

SEQ ID NO: 2084 - protein, 7 aa, Artificial Sequence
  Description of Artificial Sequence: Synthetic peptide
MSSGKNL

SEQ ID NO: 2085 - protein, 7 aa, Artificial Sequence
  Description of Artificial Sequence: Synthetic peptide
GSGLGGV

SEQ ID NO: 2086 - protein, 7 aa, Artificial Sequence
  Description of Artificial Sequence: Synthetic peptide
FGSTKHE

SEQ ID NO: 2087 - protein, 7 aa, Artificial Sequence
  Description of Artificial Sequence: Synthetic peptide
SENSKPG

SEQ ID NO: 2088 - protein, 7 aa, Artificial Sequence
  Description of Artificial Sequence: Synthetic peptide
ERSTAGV

SEQ ID NO: 2089 - protein, 7 aa, Artificial Sequence
  Description of Artificial Sequence: Synthetic peptide
TISGNRE

SEQ ID NO: 2090 - protein, 7 aa, Artificial Sequence
  Description of Artificial Sequence: Synthetic peptide
TGNSSTM

SEQ ID NO: 2091 - protein, 7 aa, Artificial Sequence
  Description of Artificial Sequence: Synthetic peptide
MGGQVPA

SEQ ID NO: 2092 - protein, 7 aa, Artificial Sequence
  Description of Artificial Sequence: Synthetic peptide
QSLKPVS

SEQ ID NO: 2093 - protein, 7 aa, Artificial Sequence
  Description of Artificial Sequence: Synthetic peptide
QNDSRTS

SEQ ID NO: 2094 - protein, 7 aa, Artificial Sequence
  Description of Artificial Sequence: Synthetic peptide
HVKTSPG

SEQ ID NO: 2095 - protein, 7 aa, Artificial Sequence
  Description of Artificial Sequence: Synthetic peptide
LTNKPVS

SEQ ID NO: 2096 - protein, 7 aa, Artificial Sequence
  Description of Artificial Sequence: Synthetic peptide
DSGKQSS

SEQ ID NO: 2097 - protein, 7 aa, Artificial Sequence
  Description of Artificial Sequence: Synthetic peptide
ERGDGGR

SEQ ID NO: 2098 - protein, 7 aa, Artificial Sequence
  Description of Artificial Sequence: Synthetic peptide
GNASKGG

SEQ ID NO: 2099 - protein, 7 aa, Artificial Sequence
  Description of Artificial Sequence: Synthetic peptide
VASGSSG

SEQ ID NO: 2100 - protein, 7 aa, Artificial Sequence
  Description of Artificial Sequence: Synthetic peptide
TGIGTPK

SEQ ID NO: 2101 - protein, 7 aa, Artificial Sequence
  Description of Artificial Sequence: Synthetic peptide
SRAPSSA

SEQ ID NO: 2102 - protein, 7 aa, Artificial Sequence
  Description of Artificial Sequence: Synthetic peptide
TSRGTQA

SEQ ID NO: 2103 - protein, 7 aa, Artificial Sequence
  Description of Artificial Sequence: Synthetic peptide
KRENTAV

SEQ ID NO: 2104 - protein, 7 aa, Artificial Sequence
  Description of Artificial Sequence: Synthetic peptide
AGTSSIS

SEQ ID NO: 2105 - protein, 7 aa, Artificial Sequence
  Description of Artificial Sequence: Synthetic peptide
STSRSNT

SEQ ID NO: 2106 - protein, 7 aa, Artificial Sequence
  Description of Artificial Sequence: Synthetic peptide
TSAVKTN

SEQ ID NO: 2107 - protein, 7 aa, Artificial Sequence
  Description of Artificial Sequence: Synthetic peptide
QRSPDQK

SEQ ID NO: 2108 - protein, 7 aa, Artificial Sequence
  Description of Artificial Sequence: Synthetic peptide
QIGGTGS

SEQ ID NO: 2109 - protein, 7 aa, Artificial Sequence
  Description of Artificial Sequence: Synthetic peptide
REGTHNS

SEQ ID NO: 2110 - protein, 7 aa, Artificial Sequence
  Description of Artificial Sequence: Synthetic peptide
QSSPKVS

SEQ ID NO: 2111 - protein, 7 aa, Artificial Sequence
  Description of Artificial Sequence: Synthetic peptide
VQGKPSQ

SEQ ID NO: 2112 - protein, 7 aa, Artificial Sequence
  Description of Artificial Sequence: Synthetic peptide
NSSNNGS

SEQ ID NO: 2113 - protein, 7 aa, Artificial Sequence
  Description of Artificial Sequence: Synthetic peptide
VQSKGSM

SEQ ID NO: 2114 - protein, 7 aa, Artificial Sequence
  Description of Artificial Sequence: Synthetic peptide
TNDSRSH

SEQ ID NO: 2115 - protein, 7 aa, Artificial Sequence
  Description of Artificial Sequence: Synthetic peptide
LSTKSNV

SEQ ID NO: 2116 - protein, 7 aa, Artificial Sequence
  Description of Artificial Sequence: Synthetic peptide
AQNTVGR

SEQ ID NO: 2117 - protein, 7 aa, Artificial Sequence
  Description of Artificial Sequence: Synthetic peptide
GMNSSSK

SEQ ID NO: 2118 - protein, 7 aa, Artificial Sequence
  Description of Artificial Sequence: Synthetic peptide
SSVTKSA

SEQ ID NO: 2119 - protein, 7 aa, Artificial Sequence
  Description of Artificial Sequence: Synthetic peptide
SHTSKAS

SEQ ID NO: 2120 - protein, 7 aa, Artificial Sequence
  Description of Artificial Sequence: Synthetic peptide
GTTSPTT

SEQ ID NO: 2121 - protein, 7 aa, Artificial Sequence
  Description of Artificial Sequence: Synthetic peptide
SMVSDSK

SEQ ID NO: 2122 - protein, 7 aa, Artificial Sequence
  Description of Artificial Sequence: Synthetic peptide
GTKSALG

SEQ ID NO: 2123 - protein, 7 aa, Artificial Sequence
  Description of Artificial Sequence: Synthetic peptide
KMGSASS

SEQ ID NO: 2124 - protein, 7 aa, Artificial Sequence
  Description of Artificial Sequence: Synthetic peptide
ITSGKQE

SEQ ID NO: 2125 - protein, 7 aa, Artificial Sequence
  Description of Artificial Sequence: Synthetic peptide
DASRAPS

SEQ ID NO: 2126 - protein, 7 aa, Artificial Sequence
  Description of Artificial Sequence: Synthetic peptide
GINTGNG

SEQ ID NO: 2127 - protein, 7 aa, Artificial Sequence
  Description of Artificial Sequence: Synthetic peptide
VRTGTPN

SEQ ID NO: 2128 - protein, 7 aa, Artificial Sequence
  Description of Artificial Sequence: Synthetic peptide
SVGQKPL

SEQ ID NO: 2129 - protein, 7 aa, Artificial Sequence
  Description of Artificial Sequence: Synthetic peptide
SPARAAV

SEQ ID NO: 2130 - protein, 7 aa, Artificial Sequence
  Description of Artificial Sequence: Synthetic peptide
AVGSPTQ

SEQ ID NO: 2131 - protein, 7 aa, Artificial Sequence
  Description of Artificial Sequence: Synthetic peptide
EAKVKPD

SEQ ID NO: 2132 - protein, 7 aa, Artificial Sequence
  Description of Artificial Sequence: Synthetic peptide
HTGSGQA

SEQ ID NO: 2133 - protein, 7 aa, Artificial Sequence
  Description of Artificial Sequence: Synthetic peptide
APSKSHE

SEQ ID NO: 2134 - protein, 7 aa, Artificial Sequence
  Description of Artificial Sequence: Synthetic peptide
GSNGAGP

SEQ ID NO: 2135 - protein, 7 aa, Artificial Sequence
  Description of Artificial Sequence: Synthetic peptide
GQTLGGK

SEQ ID NO: 2136 - protein, 7 aa, Artificial Sequence
  Description of Artificial Sequence: Synthetic peptide
LRTEHTQ

SEQ ID NO: 2137 - protein, 7 aa, Artificial Sequence
  Description of Artificial Sequence: Synthetic peptide
TKNASAV

SEQ ID NO: 2138 - protein, 7 aa, Artificial Sequence
  Description of Artificial Sequence: Synthetic peptide
TSGGSFI

SEQ ID NO: 2139 - protein, 7 aa, Artificial Sequence
  Description of Artificial Sequence: Synthetic peptide
MRSDSQL

SEQ ID NO: 2140 - protein, 7 aa, Artificial Sequence
  Description of Artificial Sequence: Synthetic peptide
NGERQTH

SEQ ID NO: 2141 - protein, 7 aa, Artificial Sequence
  Description of Artificial Sequence: Synthetic peptide
STGKITT

SEQ ID NO: 2142 - protein, 7 aa, Artificial Sequence
  Description of Artificial Sequence: Synthetic peptide
SSQAVGQ

SEQ ID NO: 2143 - protein, 7 aa, Artificial Sequence
  Description of Artificial Sequence: Synthetic peptide
QQVSKPV

SEQ ID NO: 2144 - protein, 7 aa, Artificial Sequence
  Description of Artificial Sequence: Synthetic peptide
HSSNATR

SEQ ID NO: 2145 - protein, 7 aa, Artificial Sequence
  Description of Artificial Sequence: Synthetic peptide
SSPGTVV

SEQ ID NO: 2146 - protein, 7 aa, Artificial Sequence
  Description of Artificial Sequence: Synthetic peptide
NDSADRR

SEQ ID NO: 2147 - protein, 7 aa, Artificial Sequence
  Description of Artificial Sequence: Synthetic peptide
GRDTSSS

SEQ ID NO: 2148 - protein, 7 aa, Artificial Sequence
  Description of Artificial Sequence: Synthetic peptide
QQAGKVA

SEQ ID NO: 2149 - protein, 7 aa, Artificial Sequence
  Description of Artificial Sequence: Synthetic peptide
SSEAKQS

SEQ ID NO: 2150 - protein, 7 aa, Artificial Sequence
  Description of Artificial Sequence: Synthetic peptide
QTGKSSY

SEQ ID NO: 2151 - protein, 7 aa, Artificial Sequence
  Description of Artificial Sequence: Synthetic peptide
QATSTRL

SEQ ID NO: 2152 - protein, 7 aa, Artificial Sequence
  Description of Artificial Sequence: Synthetic peptide
EKNNALS

SEQ ID NO: 2153 - protein, 7 aa, Artificial Sequence
  Description of Artificial Sequence: Synthetic peptide
GNARDNT

SEQ ID NO: 2154 - protein, 7 aa, Artificial Sequence
  Description of Artificial Sequence: Synthetic peptide
GTGARTS

SEQ ID NO: 2155 - protein, 7 aa, Artificial Sequence
  Description of Artificial Sequence: Synthetic peptide
QTSTPLV

SEQ ID NO: 2156 - protein, 7 aa, Artificial Sequence
  Description of Artificial Sequence: Synthetic peptide
MGGKLNG

SEQ ID NO: 2157 - protein, 7 aa, Artificial Sequence
  Description of Artificial Sequence: Synthetic peptide
GSGDMRS

SEQ ID NO: 2158 - protein, 7 aa, Artificial Sequence
  Description of Artificial Sequence: Synthetic peptide
REESRSL

SEQ ID NO: 2159 - protein, 7 aa, Artificial Sequence
  Description of Artificial Sequence: Synthetic peptide
LSDKKVL

SEQ ID NO: 2160 - protein, 7 aa, Artificial Sequence
  Description of Artificial Sequence: Synthetic peptide
ATKTSPE

SEQ ID NO: 2161 - protein, 7 aa, Artificial Sequence
  Description of Artificial Sequence: Synthetic peptide
TRSTGTA

SEQ ID NO: 2162 - protein, 7 aa, Artificial Sequence
  Description of Artificial Sequence: Synthetic peptide
STARDVN

SEQ ID NO: 2163 - protein, 7 aa, Artificial Sequence
  Description of Artificial Sequence: Synthetic peptide
MGSGKAN

SEQ ID NO: 2164 - protein, 7 aa, Artificial Sequence
  Description of Artificial Sequence: Synthetic peptide
GGSGDRV

SEQ ID NO: 2165 - protein, 7 aa, Artificial Sequence
  Description of Artificial Sequence: Synthetic peptide
SNERSHA

SEQ ID NO: 2166 - protein, 7 aa, Artificial Sequence
  Description of Artificial Sequence: Synthetic peptide
TSSRSTQ

SEQ ID NO: 2167 - protein, 7 aa, Artificial Sequence
  Description of Artificial Sequence: Synthetic peptide
NGNTVSG

SEQ ID NO: 2168 - protein, 7 aa, Artificial Sequence
  Description of Artificial Sequence: Synthetic peptide
NAGKSAY

SEQ ID NO: 2169 - protein, 7 aa, Artificial Sequence
  Description of Artificial Sequence: Synthetic peptide
EDNSKSA

SEQ ID NO: 2170 - protein, 7 aa, Artificial Sequence
  Description of Artificial Sequence: Synthetic peptide
DVISNPK

SEQ ID NO: 2171 - protein, 7 aa, Artificial Sequence
  Description of Artificial Sequence: Synthetic peptide
DGMSKHV

SEQ ID NO: 2172 - protein, 7 aa, Artificial Sequence
  Description of Artificial Sequence: Synthetic peptide
NLSSSNK

SEQ ID NO: 2173 - protein, 7 aa, Artificial Sequence
  Description of Artificial Sequence: Synthetic peptide
AGGSAFK

SEQ ID NO: 2174 - protein, 7 aa, Artificial Sequence
  Description of Artificial Sequence: Synthetic peptide
SDNAKPR

SEQ ID NO: 2175 - protein, 7 aa, Artificial Sequence
  Description of Artificial Sequence: Synthetic peptide
SRTSQGV

SEQ ID NO: 2176 - protein, 7 aa, Artificial Sequence
  Description of Artificial Sequence: Synthetic peptide
SAATSAS

SEQ ID NO: 2177 - protein, 7 aa, Artificial Sequence
  Description of Artificial Sequence: Synthetic peptide
LSDKSAR

SEQ ID NO: 2178 - protein, 7 aa, Artificial Sequence
  Description of Artificial Sequence: Synthetic peptide
GRTDSSR

SEQ ID NO: 2179 - protein, 7 aa, Artificial Sequence
  Description of Artificial Sequence: Synthetic peptide
YNDAASR

SEQ ID NO: 2180 - protein, 7 aa, Artificial Sequence
  Description of Artificial Sequence: Synthetic peptide
AGATSIA

SEQ ID NO: 2181 - protein, 7 aa, Artificial Sequence
  Description of Artificial Sequence: Synthetic peptide
SHSSSSL

SEQ ID NO: 2182 - protein, 7 aa, Artificial Sequence
  Description of Artificial Sequence: Synthetic peptide
SGRETGK

SEQ ID NO: 2183 - protein, 7 aa, Artificial Sequence
  Description of Artificial Sequence: Synthetic peptide
QGAHTTH

SEQ ID NO: 2184 - protein, 7 aa, Artificial Sequence
  Description of Artificial Sequence: Synthetic peptide
SGRSQSN

SEQ ID NO: 2185 - protein, 7 aa, Artificial Sequence
  Description of Artificial Sequence: Synthetic peptide
QGSNKVE

SEQ ID NO: 2186 - protein, 7 aa, Artificial Sequence
  Description of Artificial Sequence: Synthetic peptide
ESAGPGK

SEQ ID NO: 2187 - protein, 7 aa, Artificial Sequence
  Description of Artificial Sequence: Synthetic peptide
GDRQTPK

SEQ ID NO: 2188 - protein, 7 aa, Artificial Sequence
  Description of Artificial Sequence: Synthetic peptide
TSSTSHS

SEQ ID NO: 2189 - protein, 7 aa, Artificial Sequence
  Description of Artificial Sequence: Synthetic peptide
TQPGKAM

SEQ ID NO: 2190 - protein, 7 aa, Artificial Sequence
  Description of Artificial Sequence: Synthetic peptide
AQSGTHT

SEQ ID NO: 2191 - protein, 7 aa, Artificial Sequence
  Description of Artificial Sequence: Synthetic peptide
SASDRKS

SEQ ID NO: 2192 - protein, 7 aa, Artificial Sequence
  Description of Artificial Sequence: Synthetic peptide
FAGKVQA

SEQ ID NO: 2193 - protein, 7 aa, Artificial Sequence
  Description of Artificial Sequence: Synthetic peptide
NHESKER

SEQ ID NO: 2194 - protein, 7 aa, Artificial Sequence
  Description of Artificial Sequence: Synthetic peptide
SAGRTAA

SEQ ID NO: 2195 - protein, 7 aa, Artificial Sequence
  Description of Artificial Sequence: Synthetic peptide
GIKGQQS

SEQ ID NO: 2196 - protein, 7 aa, Artificial Sequence
  Description of Artificial Sequence: Synthetic peptide
VAHDKVL

SEQ ID NO: 2197 - protein, 7 aa, Artificial Sequence
  Description of Artificial Sequence: Synthetic peptide
ASSGTRS

SEQ ID NO: 2198 - protein, 7 aa, Artificial Sequence
  Description of Artificial Sequence: Synthetic peptide
SGRDKLM

SEQ ID NO: 2199 - protein, 7 aa, Artificial Sequence
  Description of Artificial Sequence: Synthetic peptide
AGVKSNI

SEQ ID NO: 2200 - protein, 7 aa, Artificial Sequence
  Description of Artificial Sequence: Synthetic peptide
HTSKVSV

SEQ ID NO: 2201 - protein, 7 aa, Artificial Sequence
  Description of Artificial Sequence: Synthetic peptide
QGNKPIV

SEQ ID NO: 2202 - protein, 7 aa, Artificial Sequence
  Description of Artificial Sequence: Synthetic peptide
LVTKTQA

SEQ ID NO: 2203 - protein, 7 aa, Artificial Sequence
  Description of Artificial Sequence: Synthetic peptide
NRTSSTN

SEQ ID NO: 2204 - protein, 7 aa, Artificial Sequence
  Description of Artificial Sequence: Synthetic peptide
TRNTAVS

SEQ ID NO: 2205 - protein, 7 aa, Artificial Sequence
  Description of Artificial Sequence: Synthetic peptide
SQEGRGS

SEQ ID NO: 2206 - protein, 7 aa, Artificial Sequence
  Description of Artificial Sequence: Synthetic peptide
QSAGSTS

SEQ ID NO: 2207 - protein, 7 aa, Artificial Sequence
  Description of Artificial Sequence: Synthetic peptide
EGSRSIT

SEQ ID NO: 2208 - protein, 7 aa, Artificial Sequence
  Description of Artificial Sequence: Synthetic peptide
DRSTKPV

SEQ ID NO: 2209 - protein, 7 aa, Artificial Sequence
  Description of Artificial Sequence: Synthetic peptide
SGKGNVA

SEQ ID NO: 2210 - protein, 7 aa, Artificial Sequence
  Description of Artificial Sequence: Synthetic peptide
NSAPNGK

SEQ ID NO: 2211 - protein, 7 aa, Artificial Sequence
  Description of Artificial Sequence: Synthetic peptide
KADSSTK

SEQ ID NO: 2212 - protein, 7 aa, Artificial Sequence
  Description of Artificial Sequence: Synthetic peptide
TSVGKTT

SEQ ID NO: 2213 - protein, 7 aa, Artificial Sequence
  Description of Artificial Sequence: Synthetic peptide
SPSKPQE

SEQ ID NO: 2214 - protein, 7 aa, Artificial Sequence
  Description of Artificial Sequence: Synthetic peptide
MTSKSAE

SEQ ID NO: 2215 - protein, 7 aa, Artificial Sequence
  Description of Artificial Sequence: Synthetic peptide
HDKPTQG

SEQ ID NO: 2216 - protein, 7 aa, Artificial Sequence
  Description of Artificial Sequence: Synthetic peptide
ENSKGNL

SEQ ID NO: 2217 - protein, 7 aa, Artificial Sequence
  Description of Artificial Sequence: Synthetic peptide
DVRDVNR

SEQ ID NO: 2218 - protein, 7 aa, Artificial Sequence
  Description of Artificial Sequence: Synthetic peptide
ERGQHQT

SEQ ID NO: 2219 - protein, 7 aa, Artificial Sequence
  Description of Artificial Sequence: Synthetic peptide
ANKQPTL

SEQ ID NO: 2220 - protein, 7 aa, Artificial Sequence
  Description of Artificial Sequence: Synthetic peptide
GASKTLV

SEQ ID NO: 2221 - protein, 7 aa, Artificial Sequence
  Description of Artificial Sequence: Synthetic peptide
GDGKSPK

SEQ ID NO: 2222 - protein, 7 aa, Artificial Sequence
  Description of Artificial Sequence: Synthetic peptide
VGQKSSS

SEQ ID NO: 2223 - protein, 7 aa, Artificial Sequence
  Description of Artificial Sequence: Synthetic peptide
TSSTNMT

SEQ ID NO: 2224 - protein, 7 aa, Artificial Sequence
  Description of Artificial Sequence: Synthetic peptide
LTNKATT

SEQ ID NO: 2225 - protein, 7 aa, Artificial Sequence
  Description of Artificial Sequence: Synthetic peptide
VPDSKSM

SEQ ID NO: 2226 - protein, 7 aa, Artificial Sequence
  Description of Artificial Sequence: Synthetic peptide
QNSAAVT

SEQ ID NO: 2227 - protein, 7 aa, Artificial Sequence
  Description of Artificial Sequence: Synthetic peptide
TQVGPSK

SEQ ID NO: 2228 - protein, 7 aa, Artificial Sequence
  Description of Artificial Sequence: Synthetic peptide
VGLKPSA

SEQ ID NO: 2229 - protein, 7 aa, Artificial Sequence
  Description of Artificial Sequence: Synthetic peptide
VGSGAQK

SEQ ID NO: 2230 - protein, 7 aa, Artificial Sequence
  Description of Artificial Sequence: Synthetic peptide
HGNPNPR

SEQ ID NO: 2231 - protein, 7 aa, Artificial Sequence
  Description of Artificial Sequence: Synthetic peptide
LNGGAAM

SEQ ID NO: 2232 - protein, 7 aa, Artificial Sequence
  Description of Artificial Sequence: Synthetic peptide
VSGSTNS

SEQ ID NO: 2233 - protein, 7 aa, Artificial Sequence
  Description of Artificial Sequence: Synthetic peptide
ASDRSPQ

SEQ ID NO: 2234 - protein, 7 aa, Artificial Sequence
  Description of Artificial Sequence: Synthetic peptide
SNPSREA

SEQ ID NO: 2235 - protein, 7 aa, Artificial Sequence
  Description of Artificial Sequence: Synthetic peptide
TLTQKSG

SEQ ID NO: 2236 - protein, 7 aa, Artificial Sequence
  Description of Artificial Sequence: Synthetic peptide
VSEKNTR

SEQ ID NO: 2237 - protein, 7 aa, Artificial Sequence
  Description of Artificial Sequence: Synthetic peptide
SRGNGNV

SEQ ID NO: 2238 - protein, 7 aa, Artificial Sequence
  Description of Artificial Sequence: Synthetic peptide
ASGDSHR

SEQ ID NO: 2239 - protein, 7 aa, Artificial Sequence
  Description of Artificial Sequence: Synthetic peptide
MGGKPGK

SEQ ID NO: 2240 - protein, 7 aa, Artificial Sequence
  Description of Artificial Sequence: Synthetic peptide
GTSNSAH

SEQ ID NO: 2241 - protein, 7 aa, Artificial Sequence
  Description of Artificial Sequence: Synthetic peptide
GKNTVSL

SEQ ID NO: 2242 - protein, 7 aa, Artificial Sequence
  Description of Artificial Sequence: Synthetic peptide
SGNGRSS

SEQ ID NO: 2243 - protein, 7 aa, Artificial Sequence
  Description of Artificial Sequence: Synthetic peptide
NGSTSTR

SEQ ID NO: 2244 - protein, 7 aa, Artificial Sequence
  Description of Artificial Sequence: Synthetic peptide
KSDKSAS

SEQ ID NO: 2245 - protein, 7 aa, Artificial Sequence
  Description of Artificial Sequence: Synthetic peptide
ATSKTIS

SEQ ID NO: 2246 - protein, 7 aa, Artificial Sequence
  Description of Artificial Sequence: Synthetic peptide
RQSGTAG

SEQ ID NO: 2247 - protein, 7 aa, Artificial Sequence
  Description of Artificial Sequence: Synthetic peptide
TRSVGNT

SEQ ID NO: 2248 - protein, 7 aa, Artificial Sequence
  Description of Artificial Sequence: Synthetic peptide
QSTQPSH

SEQ ID NO: 2249 - protein, 7 aa, Artificial Sequence
  Description of Artificial Sequence: Synthetic peptide
HGGSGAG

SEQ ID NO: 2250 - protein, 7 aa, Artificial Sequence
  Description of Artificial Sequence: Synthetic peptide
AKATSSV

SEQ ID NO: 2251 - protein, 7 aa, Artificial Sequence
  Description of Artificial Sequence: Synthetic peptide
TTSNVNL

SEQ ID NO: 2252 - protein, 7 aa, Artificial Sequence
  Description of Artificial Sequence: Synthetic peptide
SDAKPVT

SEQ ID NO: 2253 - protein, 7 aa, Artificial Sequence
  Description of Artificial Sequence: Synthetic peptide
LNSGTIR

SEQ ID NO: 2254 - protein, 7 aa, Artificial Sequence
  Description of Artificial Sequence: Synthetic peptide
SGAAAPA

SEQ ID NO: 2255 - protein, 7 aa, Artificial Sequence
  Description of Artificial Sequence: Synthetic peptide
SSSSKQL

SEQ ID NO: 2256 - protein, 7 aa, Artificial Sequence
  Description of Artificial Sequence: Synthetic peptide
SRNQSNV

SEQ ID NO: 2257 - protein, 7 aa, Artificial Sequence
  Description of Artificial Sequence: Synthetic peptide
ATSSSVK

SEQ ID NO: 2258 - protein, 7 aa, Artificial Sequence
  Description of Artificial Sequence: Synthetic peptide
TRSGTSG

SEQ ID NO: 2259 - protein, 7 aa, Artificial Sequence
  Description of Artificial Sequence: Synthetic peptide
TSLGKPS

SEQ ID NO: 2260 - protein, 7 aa, Artificial Sequence
  Description of Artificial Sequence: Synthetic peptide
SSPGKPV

SEQ ID NO: 2261 - protein, 7 aa, Artificial Sequence
  Description of Artificial Sequence: Synthetic peptide
SSSGVRS

SEQ ID NO: 2262 - protein, 7 aa, Artificial Sequence
  Description of Artificial Sequence: Synthetic peptide
VSSKSAH

SEQ ID NO: 2263 - protein, 7 aa, Artificial Sequence
  Description of Artificial Sequence: Synthetic peptide
TGGKDKG

SEQ ID NO: 2264 - protein, 7 aa, Artificial Sequence
  Description of Artificial Sequence: Synthetic peptide
GISAKPS

SEQ ID NO: 2265 - protein, 7 aa, Artificial Sequence
  Description of Artificial Sequence: Synthetic peptide
NSNTATT

SEQ ID NO: 2266 - protein, 7 aa, Artificial Sequence
  Description of Artificial Sequence: Synthetic peptide
TSGAGAP

SEQ ID NO: 2267 - protein, 7 aa, Artificial Sequence
  Description of Artificial Sequence: Synthetic peptide
SVSNSQA

SEQ ID NO: 2268 - protein, 7 aa, Artificial Sequence
  Description of Artificial Sequence: Synthetic peptide
NMSDKNG

SEQ ID NO: 2269 - protein, 7 aa, Artificial Sequence
  Description of Artificial Sequence: Synthetic peptide
RTSGQTG

SEQ ID NO: 2270 - protein, 7 aa, Artificial Sequence
  Description of Artificial Sequence: Synthetic peptide
DGRGQSG

SEQ ID NO: 2271 - protein, 7 aa, Artificial Sequence
  Description of Artificial Sequence: Synthetic peptide
AQHSGTS

SEQ ID NO: 2272 - protein, 7 aa, Artificial Sequence
  Description of Artificial Sequence: Synthetic peptide
STGHNKE

SEQ ID NO: 2273 - protein, 7 aa, Artificial Sequence
  Description of Artificial Sequence: Synthetic peptide
GVGVTPK

SEQ ID NO: 2274 - protein, 7 aa, Artificial Sequence
  Description of Artificial Sequence: Synthetic peptide
TSDRSSM

SEQ ID NO: 2275 - protein, 7 aa, Artificial Sequence
  Description of Artificial Sequence: Synthetic peptide
RGNGQSA

SEQ ID NO: 2276 - protein, 7 aa, Artificial Sequence
  Description of Artificial Sequence: Synthetic peptide
ALGSTSK

SEQ ID NO: 2277 - protein, 7 aa, Artificial Sequence
  Description of Artificial Sequence: Synthetic peptide
FSGGKGP

SEQ ID NO: 2278 - protein, 7 aa, Artificial Sequence
  Description of Artificial Sequence: Synthetic peptide
SVSERPS

SEQ ID NO: 2279 - protein, 7 aa, Artificial Sequence
  Description of Artificial Sequence: Synthetic peptide
GSREHQA

SEQ ID NO: 2280 - protein, 7 aa, Artificial Sequence
  Description of Artificial Sequence: Synthetic peptide
GTNSKHN

SEQ ID NO: 2281 - protein, 7 aa, Artificial Sequence
  Description of Artificial Sequence: Synthetic peptide
LTASPSK

SEQ ID NO: 2282 - protein, 7 aa, Artificial Sequence
  Description of Artificial Sequence: Synthetic peptide
DGKNKPM

SEQ ID NO: 2283 - protein, 7 aa, Artificial Sequence
  Description of Artificial Sequence: Synthetic peptide
AATQPTS

SEQ ID NO: 2284 - protein, 7 aa, Artificial Sequence
  Description of Artificial Sequence: Synthetic peptide
GGNSKMV

SEQ ID NO: 2285 - protein, 7 aa, Artificial Sequence
  Description of Artificial Sequence: Synthetic peptide
AVNKNIG

SEQ ID NO: 2286 - protein, 7 aa, Artificial Sequence
  Description of Artificial Sequence: Synthetic peptide
THAVKPA

SEQ ID NO: 2287 - protein, 7 aa, Artificial Sequence
  Description of Artificial Sequence: Synthetic peptide
HTSDRSS

SEQ ID NO: 2288 - protein, 7 aa, Artificial Sequence
  Description of Artificial Sequence: Synthetic peptide
GSSPTLR

SEQ ID NO: 2289 - protein, 7 aa, Artificial Sequence
  Description of Artificial Sequence: Synthetic peptide
LQPGKPQ

SEQ ID NO: 2290 - protein, 7 aa, Artificial Sequence
  Description of Artificial Sequence: Synthetic peptide
STSRPVT

SEQ ID NO: 2291 - protein, 7 aa, Artificial Sequence
  Description of Artificial Sequence: Synthetic peptide
AMRSPTS

SEQ ID NO: 2292 - protein, 7 aa, Artificial Sequence
  Description of Artificial Sequence: Synthetic peptide
NGSRDSR

SEQ ID NO: 2293 - protein, 7 aa, Artificial Sequence
  Description of Artificial Sequence: Synthetic peptide
SSAQGSK

SEQ ID NO: 2294 - protein, 7 aa, Artificial Sequence
  Description of Artificial Sequence: Synthetic peptide
SANSATR

SEQ ID NO: 2295 - protein, 7 aa, Artificial Sequence
  Description of Artificial Sequence: Synthetic peptide
SNGGQRA

SEQ ID NO: 2296 - protein, 7 aa, Artificial Sequence
  Description of Artificial Sequence: Synthetic peptide
GSSSKGV

SEQ ID NO: 2297 - protein, 7 aa, Artificial Sequence
  Description of Artificial Sequence: Synthetic peptide
VVSKGNM

SEQ ID NO: 2298 - protein, 7 aa, Artificial Sequence
  Description of Artificial Sequence: Synthetic peptide
DNGNKLY

SEQ ID NO: 2299 - protein, 7 aa, Artificial Sequence
  Description of Artificial Sequence: Synthetic peptide
DRAQTVR

SEQ ID NO: 2300 - protein, 7 aa, Artificial Sequence
  Description of Artificial Sequence: Synthetic peptide
SHNSSHT

SEQ ID NO: 2301 - protein, 7 aa, Artificial Sequence
  Description of Artificial Sequence: Synthetic peptide
HKNSQQL

SEQ ID NO: 2302 - protein, 7 aa, Artificial Sequence
  Description of Artificial Sequence: Synthetic peptide
STSNKAS

SEQ ID NO: 2303 - protein, 7 aa, Artificial Sequence
  Description of Artificial Sequence: Synthetic peptide
SASNKPH

SEQ ID NO: 2304 - protein, 7 aa, Artificial Sequence
  Description of Artificial Sequence: Synthetic peptide
AAKGSPP

SEQ ID NO: 2305 - protein, 7 aa, Artificial Sequence
  Description of Artificial Sequence: Synthetic peptide
DTGSGRG

SEQ ID NO: 2306 - protein, 7 aa, Artificial Sequence
  Description of Artificial Sequence: Synthetic peptide
QAGTGIT

SEQ ID NO: 2307 - protein, 7 aa, Artificial Sequence
  Description of Artificial Sequence: Synthetic peptide
LGVSSPG

SEQ ID NO: 2308 - protein, 7 aa, Artificial Sequence
  Description of Artificial Sequence: Synthetic peptide
EPVRSPT

SEQ ID NO: 2309 - protein, 7 aa, Artificial Sequence
  Description of Artificial Sequence: Synthetic peptide
TQTQKTF

SEQ ID NO: 2310 - protein, 7 aa, Artificial Sequence
  Description of Artificial Sequence: Synthetic peptide
STKSTAS

SEQ ID NO: 2311 - protein, 7 aa, Artificial Sequence
  Description of Artificial Sequence: Synthetic peptide
LVNSKNS

SEQ ID NO: 2312 - protein, 7 aa, Artificial Sequence
  Description of Artificial Sequence: Synthetic peptide
SRSTKAE

SEQ ID NO: 2313 - protein, 7 aa, Artificial Sequence
  Description of Artificial Sequence: Synthetic peptide
NNSVKPI

SEQ ID NO: 2314 - protein, 7 aa, Artificial Sequence
  Description of Artificial Sequence: Synthetic peptide
NSNKSPS

SEQ ID NO: 2315 - protein, 7 aa, Artificial Sequence
  Description of Artificial Sequence: Synthetic peptide
TGASKPA

SEQ ID NO: 2316 - protein, 7 aa, Artificial Sequence
  Description of Artificial Sequence: Synthetic peptide
SPMTPHV

SEQ ID NO: 2317 - protein, 7 aa, Artificial Sequence
  Description of Artificial Sequence: Synthetic peptide
TPVPSGG

SEQ ID NO: 2318 - protein, 7 aa, Artificial Sequence
  Description of Artificial Sequence: Synthetic peptide
TAQSPVG

SEQ ID NO: 2319 - protein, 7 aa, Artificial Sequence
  Description of Artificial Sequence: Synthetic peptide
TGLKGEK

SEQ ID NO: 2320 - protein, 7 aa, Artificial Sequence
  Description of Artificial Sequence: Synthetic peptide
RSKTDTN

SEQ ID NO: 2321 - protein, 7 aa, Artificial Sequence
  Description of Artificial Sequence: Synthetic peptide
QATSKVD

SEQ ID NO: 2322 - protein, 7 aa, Artificial Sequence
  Description of Artificial Sequence: Synthetic peptide
RSEGKAQ

SEQ ID NO: 2323 - protein, 7 aa, Artificial Sequence
  Description of Artificial Sequence: Synthetic peptide
EASKGIS

SEQ ID NO: 2324 - protein, 7 aa, Artificial Sequence
  Description of Artificial Sequence: Synthetic peptide
DRADRTV

SEQ ID NO: 2325 - protein, 7 aa, Artificial Sequence
  Description of Artificial Sequence: Synthetic peptide
ATSPNNH

SEQ ID NO: 2326 - protein, 7 aa, Artificial Sequence
  Description of Artificial Sequence: Synthetic peptide
TTNNDRH

SEQ ID NO: 2327 - protein, 7 aa, Artificial Sequence
  Description of Artificial Sequence: Synthetic peptide
STTVKPN

SEQ ID NO: 2328 - protein, 7 aa, Artificial Sequence
  Description of Artificial Sequence: Synthetic peptide
RNSSPTT

SEQ ID NO: 2329 - protein, 7 aa, Artificial Sequence
  Description of Artificial Sequence: Synthetic peptide
SPSPTLV

SEQ ID NO: 2330 - protein, 7 aa, Artificial Sequence
  Description of Artificial Sequence: Synthetic peptide
NMASNAK

SEQ ID NO: 2331 - protein, 7 aa, Artificial Sequence
  Description of Artificial Sequence: Synthetic peptide
TKNSKTS

SEQ ID NO: 2332 - protein, 7 aa, Artificial Sequence
  Description of Artificial Sequence: Synthetic peptide
HSGQKTP

SEQ ID NO: 2333 - protein, 7 aa, Artificial Sequence
  Description of Artificial Sequence: Synthetic peptide
GSQAPVR

SEQ ID NO: 2334 - protein, 7 aa, Artificial Sequence
  Description of Artificial Sequence: Synthetic peptide
GDSRPIS

SEQ ID NO: 2335 - protein, 7 aa, Artificial Sequence
  Description of Artificial Sequence: Synthetic peptide
LTNKAVI

SEQ ID NO: 2336 - protein, 7 aa, Artificial Sequence
  Description of Artificial Sequence: Synthetic peptide
GVNKVTS

SEQ ID NO: 2337 - protein, 7 aa, Artificial Sequence
  Description of Artificial Sequence: Synthetic peptide
VGSGTPL

SEQ ID NO: 2338 - protein, 7 aa, Artificial Sequence
  Description of Artificial Sequence: Synthetic peptide
SGGTTVL

SEQ ID NO: 2339 - protein, 7 aa, Artificial Sequence
  Description of Artificial Sequence: Synthetic peptide
ERPSSAS

SEQ ID NO: 2340 - protein, 7 aa, Artificial Sequence
  Description of Artificial Sequence: Synthetic peptide
DGREAIR

SEQ ID NO: 2341 - protein, 7 aa, Artificial Sequence
  Description of Artificial Sequence: Synthetic peptide
STQGAAT

SEQ ID NO: 2342 - protein, 7 aa, Artificial Sequence
  Description of Artificial Sequence: Synthetic peptide
SSHGSSG

SEQ ID NO: 2343 - protein, 7 aa, Artificial Sequence
  Description of Artificial Sequence: Synthetic peptide
VGTSKFQ

SEQ ID NO: 2344 - protein, 7 aa, Artificial Sequence
  Description of Artificial Sequence: Synthetic peptide
HGSPKPS

SEQ ID NO: 2345 - protein, 7 aa, Artificial Sequence
  Description of Artificial Sequence: Synthetic peptide
KSGAGNS

SEQ ID NO: 2346 - protein, 7 aa, Artificial Sequence
  Description of Artificial Sequence: Synthetic peptide
TNDNPKH

SEQ ID NO: 2347 - protein, 7 aa, Artificial Sequence
  Description of Artificial Sequence: Synthetic peptide
LGSGNQH

SEQ ID NO: 2348 - protein, 7 aa, Artificial Sequence
  Description of Artificial Sequence: Synthetic peptide
DGSHSTS

SEQ ID NO: 2349 - protein, 7 aa, Artificial Sequence
  Description of Artificial Sequence: Synthetic peptide
GQAGKVK

SEQ ID NO: 2350 - protein, 7 aa, Artificial Sequence
  Description of Artificial Sequence: Synthetic peptide
SLTKSTE

SEQ ID NO: 2351 - protein, 7 aa, Artificial Sequence
  Description of Artificial Sequence: Synthetic peptide
TTHSKQN

SEQ ID NO: 2352 - protein, 7 aa, Artificial Sequence
  Description of Artificial Sequence: Synthetic peptide
GTKAPSS

SEQ ID NO: 2353 - protein, 7 aa, Artificial Sequence
  Description of Artificial Sequence: Synthetic peptide
NPVGQKS

SEQ ID NO: 2354 - protein, 7 aa, Artificial Sequence
  Description of Artificial Sequence: Synthetic peptide
SASNSTA

SEQ ID NO: 2355 - protein, 7 aa, Artificial Sequence
  Description of Artificial Sequence: Synthetic peptide
LGSKANE

SEQ ID NO: 2356 - protein, 7 aa, Artificial Sequence
  Description of Artificial Sequence: Synthetic peptide
AATGSQG

SEQ ID NO: 2357 - protein, 7 aa, Artificial Sequence
  Description of Artificial Sequence: Synthetic peptide
GPDKSNR

SEQ ID NO: 2358 - protein, 7 aa, Artificial Sequence
  Description of Artificial Sequence: Synthetic peptide
SSGSQNS

SEQ ID NO: 2359 - protein, 7 aa, Artificial Sequence
  Description of Artificial Sequence: Synthetic peptide
HGGSSNS

SEQ ID NO: 2360 - protein, 7 aa, Artificial Sequence
  Description of Artificial Sequence: Synthetic peptide
NGPGQNQ

SEQ ID NO: 2361 - protein, 7 aa, Artificial Sequence
  Description of Artificial Sequence: Synthetic peptide
GTVTKNA

SEQ ID NO: 2362 - protein, 7 aa, Artificial Sequence
  Description of Artificial Sequence: Synthetic peptide
GSTSANT

SEQ ID NO: 2363 - protein, 7 aa, Artificial Sequence
  Description of Artificial Sequence: Synthetic peptide
SGSSKVI

SEQ ID NO: 2364 - protein, 7 aa, Artificial Sequence
  Description of Artificial Sequence: Synthetic peptide
IRTGKTD

SEQ ID NO: 2365 - protein, 7 aa, Artificial Sequence
  Description of Artificial Sequence: Synthetic peptide
HGVEKRT

SEQ ID NO: 2366 - protein, 7 aa, Artificial Sequence
  Description of Artificial Sequence: Synthetic peptide
TETDKAH

SEQ ID NO: 2367 - protein, 7 aa, Artificial Sequence
  Description of Artificial Sequence: Synthetic peptide
DRANSAT

SEQ ID NO: 2368 - protein, 7 aa, Artificial Sequence
  Description of Artificial Sequence: Synthetic peptide
NQGDRNF

SEQ ID NO: 2369 - protein, 7 aa, Artificial Sequence
  Description of Artificial Sequence: Synthetic peptide
RQDAKTD

SEQ ID NO: 2370 - protein, 7 aa, Artificial Sequence
  Description of Artificial Sequence: Synthetic peptide
SRSTSNS

SEQ ID NO: 2371 - protein, 7 aa, Artificial Sequence
  Description of Artificial Sequence: Synthetic peptide
QGVNKVG

SEQ ID NO: 2372 - protein, 7 aa, Artificial Sequence
  Description of Artificial Sequence: Synthetic peptide
QGTTNHQ

SEQ ID NO: 2373 - protein, 7 aa, Artificial Sequence
  Description of Artificial Sequence: Synthetic peptide
RQQTSIS

SEQ ID NO: 2374 - protein, 7 aa, Artificial Sequence
  Description of Artificial Sequence: Synthetic peptide
DGQGTKM

SEQ ID NO: 2375 - protein, 7 aa, Artificial Sequence
  Description of Artificial Sequence: Synthetic peptide
GTNSKNL

SEQ ID NO: 2376 - protein, 7 aa, Artificial Sequence
  Description of Artificial Sequence: Synthetic peptide
VAVAPTK

SEQ ID NO: 2377 - protein, 7 aa, Artificial Sequence
  Description of Artificial Sequence: Synthetic peptide
YSGKSVV

SEQ ID NO: 2378 - protein, 7 aa, Artificial Sequence
  Description of Artificial Sequence: Synthetic peptide
LPSQSPQ

SEQ ID NO: 2379 - protein, 7 aa, Artificial Sequence
  Description of Artificial Sequence: Synthetic peptide
GDASMRS

SEQ ID NO: 2380 - protein, 7 aa, Artificial Sequence
  Description of Artificial Sequence: Synthetic peptide
VGNSQKL

SEQ ID NO: 2381 - protein, 7 aa, Artificial Sequence
  Description of Artificial Sequence: Synthetic peptide
WGTAKPA

SEQ ID NO: 2382 - protein, 7 aa, Artificial Sequence
  Description of Artificial Sequence: Synthetic peptide
TQSDRAR

SEQ ID NO: 2383 - protein, 7 aa, Artificial Sequence
  Description of Artificial Sequence: Synthetic peptide
APVSKTA

SEQ ID NO: 2384 - protein, 7 aa, Artificial Sequence
  Description of Artificial Sequence: Synthetic peptide
VGNQNNI

SEQ ID NO: 2385 - protein, 7 aa, Artificial Sequence
  Description of Artificial Sequence: Synthetic peptide
RGGSGSS

SEQ ID NO: 2386 - protein, 7 aa, Artificial Sequence
  Description of Artificial Sequence: Synthetic peptide
DLSGKRS

SEQ ID NO: 2387 - protein, 7 aa, Artificial Sequence
  Description of Artificial Sequence: Synthetic peptide
VAVGAAK

SEQ ID NO: 2388 - protein, 7 aa, Artificial Sequence
  Description of Artificial Sequence: Synthetic peptide
VGQSTSR

SEQ ID NO: 2389 - protein, 7 aa, Artificial Sequence
  Description of Artificial Sequence: Synthetic peptide
LAAGAGH

SEQ ID NO: 2390 - protein, 7 aa, Artificial Sequence
  Description of Artificial Sequence: Synthetic peptide
TQAKSIG

SEQ ID NO: 2391 - protein, 7 aa, Artificial Sequence
  Description of Artificial Sequence: Synthetic peptide
RTDTKIL

SEQ ID NO: 2392 - protein, 7 aa, Artificial Sequence
  Description of Artificial Sequence: Synthetic peptide
LNHNSQG

SEQ ID NO: 2393 - protein, 7 aa, Artificial Sequence
  Description of Artificial Sequence: Synthetic peptide
GTGSTMR

SEQ ID NO: 2394 - protein, 7 aa, Artificial Sequence
  Description of Artificial Sequence: Synthetic peptide
SASSGHS

SEQ ID NO: 2395 - protein, 7 aa, Artificial Sequence
  Description of Artificial Sequence: Synthetic peptide
TTSSTLT

SEQ ID NO: 2396 - protein, 7 aa, Artificial Sequence
  Description of Artificial Sequence: Synthetic peptide
GNHSGSH

SEQ ID NO: 2397 - protein, 7 aa, Artificial Sequence
  Description of Artificial Sequence: Synthetic peptide
GSSSKPA

SEQ ID NO: 2398 - protein, 7 aa, Artificial Sequence
  Description of Artificial Sequence: Synthetic peptide
GATPPSK

SEQ ID NO: 2399 - protein, 7 aa, Artificial Sequence
  Description of Artificial Sequence: Synthetic peptide
VPQSKPV

SEQ ID NO: 2400 - protein, 7 aa, Artificial Sequence
  Description of Artificial Sequence: Synthetic peptide
VQGKSQL

SEQ ID NO: 2401 - protein, 7 aa, Artificial Sequence
  Description of Artificial Sequence: Synthetic peptide
TGERTAL

SEQ ID NO: 2402 - protein, 7 aa, Artificial Sequence
  Description of Artificial Sequence: Synthetic peptide
TGSGKVV

SEQ ID NO: 2403 - protein, 7 aa, Artificial Sequence
  Description of Artificial Sequence: Synthetic peptide
SGTTPIR

SEQ ID NO: 2404 - protein, 7 aa, Artificial Sequence
  Description of Artificial Sequence: Synthetic peptide
SQDSHRS

SEQ ID NO: 2405 - protein, 7 aa, Artificial Sequence
  Description of Artificial Sequence: Synthetic peptide
TNTQSTL

SEQ ID NO: 2406 - protein, 7 aa, Artificial Sequence
  Description of Artificial Sequence: Synthetic peptide
TMGTKPS

SEQ ID NO: 2407 - protein, 7 aa, Artificial Sequence
  Description of Artificial Sequence: Synthetic peptide
RQSEKTQ

SEQ ID NO: 2408 - protein, 7 aa, Artificial Sequence
  Description of Artificial Sequence: Synthetic peptide
GTQARQG

SEQ ID NO: 2409 - protein, 7 aa, Artificial Sequence
  Description of Artificial Sequence: Synthetic peptide
VGTDASR

SEQ ID NO: 2410 - protein, 7 aa, Artificial Sequence
  Description of Artificial Sequence: Synthetic peptide
LDDKKAG

SEQ ID NO: 2411 - protein, 7 aa, Artificial Sequence
  Description of Artificial Sequence: Synthetic peptide
SLPTANN

SEQ ID NO: 2412 - protein, 7 aa, Artificial Sequence
  Description of Artificial Sequence: Synthetic peptide
TSGKAGT

SEQ ID NO: 2413 - protein, 7 aa, Artificial Sequence
  Description of Artificial Sequence: Synthetic peptide
IQETRSN

SEQ ID NO: 2414 - protein, 7 aa, Artificial Sequence
  Description of Artificial Sequence: Synthetic peptide
ARSDKLH

SEQ ID NO: 2415 - protein, 7 aa, Artificial Sequence
  Description of Artificial Sequence: Synthetic peptide
QGSQTQV

SEQ ID NO: 2416 - protein, 7 aa, Artificial Sequence
  Description of Artificial Sequence: Synthetic peptide
STDGTQR

SEQ ID NO: 2417 - protein, 7 aa, Artificial Sequence
  Description of Artificial Sequence: Synthetic peptide
QTVKGSS

SEQ ID NO: 2418 - protein, 7 aa, Artificial Sequence
  Description of Artificial Sequence: Synthetic peptide
QKTDHPA

SEQ ID NO: 2419 - protein, 7 aa, Artificial Sequence
  Description of Artificial Sequence: Synthetic peptide
DTRPNKD

SEQ ID NO: 2420 - protein, 7 aa, Artificial Sequence
  Description of Artificial Sequence: Synthetic peptide
VRNDKTE

SEQ ID NO: 2421 - protein, 7 aa, Artificial Sequence
  Description of Artificial Sequence: Synthetic peptide
GTGDMRR

SEQ ID NO: 2422 - protein, 7 aa, Artificial Sequence
  Description of Artificial Sequence: Synthetic peptide
LGDKKVV

SEQ ID NO: 2423 - protein, 7 aa, Artificial Sequence
  Description of Artificial Sequence: Synthetic peptide
SPTGKTV

SEQ ID NO: 2424 - protein, 7 aa, Artificial Sequence
  Description of Artificial Sequence: Synthetic peptide
LPGNSTK

SEQ ID NO: 2425 - protein, 7 aa, Artificial Sequence
  Description of Artificial Sequence: Synthetic peptide
HGNKPMV

SEQ ID NO: 2426 - protein, 7 aa, Artificial Sequence
  Description of Artificial Sequence: Synthetic peptide
GKSTNMH

SEQ ID NO: 2427 - protein, 7 aa, Artificial Sequence
  Description of Artificial Sequence: Synthetic peptide
EGGSVGR

SEQ ID NO: 2428 - protein, 7 aa, Artificial Sequence
  Description of Artificial Sequence: Synthetic peptide
NISTPRN

SEQ ID NO: 2429 - protein, 7 aa, Artificial Sequence
  Description of Artificial Sequence: Synthetic peptide
SANNSTV

SEQ ID NO: 2430 - protein, 7 aa, Artificial Sequence
  Description of Artificial Sequence: Synthetic peptide
SAGQGLK

SEQ ID NO: 2431 - protein, 7 aa, Artificial Sequence
  Description of Artificial Sequence: Synthetic peptide
HGTAKSG

SEQ ID NO: 2432 - protein, 7 aa, Artificial Sequence
  Description of Artificial Sequence: Synthetic peptide
VANKSSG

SEQ ID NO: 2433 - protein, 7 aa, Artificial Sequence
  Description of Artificial Sequence: Synthetic peptide
TSVPQHG

SEQ ID NO: 2434 - protein, 7 aa, Artificial Sequence
  Description of Artificial Sequence: Synthetic peptide
LTAKTPS

SEQ ID NO: 2435 - protein, 7 aa, Artificial Sequence
  Description of Artificial Sequence: Synthetic peptide
EDHRPTV

SEQ ID NO: 2436 - protein, 7 aa, Artificial Sequence
  Description of Artificial Sequence: Synthetic peptide
GTAARTE

SEQ ID NO: 2437 - protein, 7 aa, Artificial Sequence
  Description of Artificial Sequence: Synthetic peptide
GMNPRDS

SEQ ID NO: 2438 - protein, 7 aa, Artificial Sequence
  Description of Artificial Sequence: Synthetic peptide
VSAPGNT

SEQ ID NO: 2439 - protein, 7 aa, Artificial Sequence
  Description of Artificial Sequence: Synthetic peptide
SADKTQN

SEQ ID NO: 2440 - protein, 7 aa, Artificial Sequence
  Description of Artificial Sequence: Synthetic peptide
TSANVSS

SEQ ID NO: 2441 - protein, 7 aa, Artificial Sequence
  Description of Artificial Sequence: Synthetic peptide
CTGKPDS

SEQ ID NO: 2442 - protein, 7 aa, Artificial Sequence
  Description of Artificial Sequence: Synthetic peptide
TSHTTSN

SEQ ID NO: 2443 - protein, 7 aa, Artificial Sequence
  Description of Artificial Sequence: Synthetic peptide
SGMGGTS

SEQ ID NO: 2444 - protein, 7 aa, Artificial Sequence
  Description of Artificial Sequence: Synthetic peptide
TREKSSL

SEQ ID NO: 2445 - protein, 7 aa, Artificial Sequence
  Description of Artificial Sequence: Synthetic peptide
SLTSPAS

SEQ ID NO: 2446 - protein, 7 aa, Artificial Sequence
  Description of Artificial Sequence: Synthetic peptide
SGTHKGQ

SEQ ID NO: 2447 - protein, 7 aa, Artificial Sequence
  Description of Artificial Sequence: Synthetic peptide
ISGSTPT

SEQ ID NO: 2448 - protein, 7 aa, Artificial Sequence
  Description of Artificial Sequence: Synthetic peptide
LRSKETI

SEQ ID NO: 2449 - protein, 7 aa, Artificial Sequence
  Description of Artificial Sequence: Synthetic peptide
DVPNKHS

SEQ ID NO: 2450 - protein, 7 aa, Artificial Sequence
  Description of Artificial Sequence: Synthetic peptide
VKTDRAS

SEQ ID NO: 2451 - protein, 7 aa, Artificial Sequence
  Description of Artificial Sequence: Synthetic peptide
DGTKGKS

SEQ ID NO: 2452 - protein, 7 aa, Artificial Sequence
  Description of Artificial Sequence: Synthetic peptide
ASNGSKQ

SEQ ID NO: 2453 - protein, 7 aa, Artificial Sequence
  Description of Artificial Sequence: Synthetic peptide
AGSSKLS

SEQ ID NO: 2454 - protein, 7 aa, Artificial Sequence
  Description of Artificial Sequence: Synthetic peptide
TKGDKHD

SEQ ID NO: 2455 - protein, 7 aa, Artificial Sequence
  Description of Artificial Sequence: Synthetic peptide
DGNKNKL

SEQ ID NO: 2456 - protein, 7 aa, Artificial Sequence
  Description of Artificial Sequence: Synthetic peptide
ARGGDQP

SEQ ID NO: 2457 - protein, 7 aa, Artificial Sequence
  Description of Artificial Sequence: Synthetic peptide
TTAANYQ

SEQ ID NO: 2458 - protein, 7 aa, Artificial Sequence
  Description of Artificial Sequence: Synthetic peptide
SGVGSGL

SEQ ID NO: 2459 - protein, 7 aa, Artificial Sequence
  Description of Artificial Sequence: Synthetic peptide
NCSKSNC

SEQ ID NO: 2460 - protein, 7 aa, Artificial Sequence
  Description of Artificial Sequence: Synthetic peptide
SRNGSPV

SEQ ID NO: 2461 - protein, 7 aa, Artificial Sequence
  Description of Artificial Sequence: Synthetic peptide
SEKKNSL

SEQ ID NO: 2462 - protein, 7 aa, Artificial Sequence
  Description of Artificial Sequence: Synthetic peptide
GATSERR

SEQ ID NO: 2463 - protein, 7 aa, Artificial Sequence
  Description of Artificial Sequence: Synthetic peptide
TTGKHSQ

SEQ ID NO: 2464 - protein, 7 aa, Artificial Sequence
  Description of Artificial Sequence: Synthetic peptide
RHGESTT

SEQ ID NO: 2465 - protein, 7 aa, Artificial Sequence
  Description of Artificial Sequence: Synthetic peptide
NTNKPMS

SEQ ID NO: 2466 - protein, 7 aa, Artificial Sequence
  Description of Artificial Sequence: Synthetic peptide
MGDKPTR

SEQ ID NO: 2467 - protein, 7 aa, Artificial Sequence
  Description of Artificial Sequence: Synthetic peptide
SNQTPTR

SEQ ID NO: 2468 - protein, 7 aa, Artificial Sequence
  Description of Artificial Sequence: Synthetic peptide
MSGHSQA

SEQ ID NO: 2469 - protein, 7 aa, Artificial Sequence
  Description of Artificial Sequence: Synthetic peptide
QGVDSRS

SEQ ID NO: 2470 - protein, 7 aa, Artificial Sequence
  Description of Artificial Sequence: Synthetic peptide
SGGSSRV

SEQ ID NO: 2471 - protein, 7 aa, Artificial Sequence
  Description of Artificial Sequence: Synthetic peptide
TPGGHQA

SEQ ID NO: 2472 - protein, 7 aa, Artificial Sequence
  Description of Artificial Sequence: Synthetic peptide
TGRDSIQ

SEQ ID NO: 2473 - protein, 7 aa, Artificial Sequence
  Description of Artificial Sequence: Synthetic peptide
RDGTPRD

SEQ ID NO: 2474 - protein, 7 aa, Artificial Sequence
  Description of Artificial Sequence: Synthetic peptide
TAPAAGS

SEQ ID NO: 2475 - protein, 7 aa, Artificial Sequence
  Description of Artificial Sequence: Synthetic peptide
TLGEHSR

SEQ ID NO: 2476 - protein, 7 aa, Artificial Sequence
  Description of Artificial Sequence: Synthetic peptide
QNNAPAH

SEQ ID NO: 2477 - protein, 7 aa, Artificial Sequence
  Description of Artificial Sequence: Synthetic peptide
EGSSSLT

SEQ ID NO: 2478 - protein, 7 aa, Artificial Sequence
  Description of Artificial Sequence: Synthetic peptide
SGKPNER

SEQ ID NO: 2479 - protein, 7 aa, Artificial Sequence
  Description of Artificial Sequence: Synthetic peptide
NQSTSAK

SEQ ID NO: 2480 - protein, 7 aa, Artificial Sequence
  Description of Artificial Sequence: Synthetic peptide
TGKNENL

SEQ ID NO: 2481 - protein, 7 aa, Artificial Sequence
  Description of Artificial Sequence: Synthetic peptide
DSASSSR

SEQ ID NO: 2482 - protein, 7 aa, Artificial Sequence
  Description of Artificial Sequence: Synthetic peptide
NSTREAA

SEQ ID NO: 2483 - protein, 7 aa, Artificial Sequence
  Description of Artificial Sequence: Synthetic peptide
SATSRPV

SEQ ID NO: 2484 - protein, 7 aa, Artificial Sequence
  Description of Artificial Sequence: Synthetic peptide
AGQTAST

SEQ ID NO: 2485 - protein, 7 aa, Artificial Sequence
  Description of Artificial Sequence: Synthetic peptide
SPDRSSS

SEQ ID NO: 2486 - protein, 7 aa, Artificial Sequence
  Description of Artificial Sequence: Synthetic peptide
NEARATQ

SEQ ID NO: 2487 - protein, 7 aa, Artificial Sequence
  Description of Artificial Sequence: Synthetic peptide
TVGGRGS

SEQ ID NO: 2488 - protein, 7 aa, Artificial Sequence
  Description of Artificial Sequence: Synthetic peptide
STLPPQK

SEQ ID NO: 2489 - protein, 7 aa, Artificial Sequence
  Description of Artificial Sequence: Synthetic peptide
ENNSGPR

SEQ ID NO: 2490 - protein, 7 aa, Artificial Sequence
  Description of Artificial Sequence: Synthetic peptide
APPSSGK

SEQ ID NO: 2491 - protein, 7 aa, Artificial Sequence
  Description of Artificial Sequence: Synthetic peptide
SSNSASS

SEQ ID NO: 2492 - protein, 7 aa, Artificial Sequence
  Description of Artificial Sequence: Synthetic peptide
SIATAQK

SEQ ID NO: 2493 - protein, 7 aa, Artificial Sequence
  Description of Artificial Sequence: Synthetic peptide
DKCSGCA

SEQ ID NO: 2494 - protein, 7 aa, Artificial Sequence
  Description of Artificial Sequence: Synthetic peptide
NNNVPVQ

SEQ ID NO: 2495 - protein, 7 aa, Artificial Sequence
  Description of Artificial Sequence: Synthetic peptide
RQDVSNG

SEQ ID NO: 2496 - protein, 7 aa, Artificial Sequence
  Description of Artificial Sequence: Synthetic peptide
SREKGSN

SEQ ID NO: 2497 - protein, 7 aa, Artificial Sequence
  Description of Artificial Sequence: Synthetic peptide
SGVNSSG

SEQ ID NO: 2498 - protein, 7 aa, Artificial Sequence
  Description of Artificial Sequence: Synthetic peptide
VSSPPNR

SEQ ID NO: 2499 - protein, 7 aa, Artificial Sequence
  Description of Artificial Sequence: Synthetic peptide
FTGSNST

SEQ ID NO: 2500 - protein, 7 aa, Artificial Sequence
  Description of Artificial Sequence: Synthetic peptide
ASTSGMH

SEQ ID NO: 2501 - protein, 7 aa, Artificial Sequence
  Description of Artificial Sequence: Synthetic peptide
SRTSSNV

SEQ ID NO: 2502 - protein, 7 aa, Artificial Sequence
  Description of Artificial Sequence: Synthetic peptide
QTGSATA

SEQ ID NO: 2503 - protein, 7 aa, Artificial Sequence
  Description of Artificial Sequence: Synthetic peptide
ESVGKSA

SEQ ID NO: 2504 - protein, 7 aa, Artificial Sequence
  Description of Artificial Sequence: Synthetic peptide
DGSQRPK

SEQ ID NO: 2505 - protein, 7 aa, Artificial Sequence
  Description of Artificial Sequence: Synthetic peptide
QGNEGHI

SEQ ID NO: 2506 - protein, 7 aa, Artificial Sequence
  Description of Artificial Sequence: Synthetic peptide
LALGGKG

SEQ ID NO: 2507 - protein, 7 aa, Artificial Sequence
  Description of Artificial Sequence: Synthetic peptide
SNSSKLN

SEQ ID NO: 2508 - protein, 7 aa, Artificial Sequence
  Description of Artificial Sequence: Synthetic peptide
LSNQPKD

SEQ ID NO: 2509 - protein, 7 aa, Artificial Sequence
  Description of Artificial Sequence: Synthetic peptide
SGGGQAH

SEQ ID NO: 2510 - protein, 7 aa, Artificial Sequence
  Description of Artificial Sequence: Synthetic peptide
SANSGHS

SEQ ID NO: 2511 - protein, 7 aa, Artificial Sequence
  Description of Artificial Sequence: Synthetic peptide
GSAKTSN

SEQ ID NO: 2512 - protein, 7 aa, Artificial Sequence
  Description of Artificial Sequence: Synthetic peptide
QSSKPNI

SEQ ID NO: 2513 - protein, 7 aa, Artificial Sequence
  Description of Artificial Sequence: Synthetic peptide
SGANTLH

SEQ ID NO: 2514 - protein, 7 aa, Artificial Sequence
  Description of Artificial Sequence: Synthetic peptide
GRQNSAQ

SEQ ID NO: 2515 - protein, 7 aa, Artificial Sequence
  Description of Artificial Sequence: Synthetic peptide
KGADRQS

SEQ ID NO: 2516 - protein, 7 aa, Artificial Sequence
  Description of Artificial Sequence: Synthetic peptide
TDGSGNK

SEQ ID NO: 2517 - protein, 7 aa, Artificial Sequence
  Description of Artificial Sequence: Synthetic peptide
TKDNHSS

SEQ ID NO: 2518 - protein, 7 aa, Artificial Sequence
  Description of Artificial Sequence: Synthetic peptide
TVSKSTM

SEQ ID NO: 2519 - protein, 7 aa, Artificial Sequence
  Description of Artificial Sequence: Synthetic peptide
SGTPRNA

SEQ ID NO: 2520 - protein, 7 aa, Artificial Sequence
  Description of Artificial Sequence: Synthetic peptide
QSTSPSL

SEQ ID NO: 2521 - protein, 7 aa, Artificial Sequence
  Description of Artificial Sequence: Synthetic peptide
HGNSTLQ

SEQ ID NO: 2522 - protein, 7 aa, Artificial Sequence
  Description of Artificial Sequence: Synthetic peptide
GTAKQFA

SEQ ID NO: 2523 - protein, 7 aa, Artificial Sequence
  Description of Artificial Sequence: Synthetic peptide
NQTPALG

SEQ ID NO: 2524 - protein, 7 aa, Artificial Sequence
  Description of Artificial Sequence: Synthetic peptide
TRTDSSS

SEQ ID NO: 2525 - protein, 7 aa, Artificial Sequence
  Description of Artificial Sequence: Synthetic peptide
TSSNVPG

SEQ ID NO: 2526 - protein, 7 aa, Artificial Sequence
  Description of Artificial Sequence: Synthetic peptide
SIDSAHR

SEQ ID NO: 2527 - protein, 7 aa, Artificial Sequence
  Description of Artificial Sequence: Synthetic peptide
SGSTKGT

SEQ ID NO: 2528 - protein, 7 aa, Artificial Sequence
  Description of Artificial Sequence: Synthetic peptide
HSNTTSN

SEQ ID NO: 2529 - protein, 7 aa, Artificial Sequence
  Description of Artificial Sequence: Synthetic peptide
QINSKST

SEQ ID NO: 2530 - protein, 7 aa, Artificial Sequence
  Description of Artificial Sequence: Synthetic peptide
ETVKKSS

SEQ ID NO: 2531 - protein, 7 aa, Artificial Sequence
  Description of Artificial Sequence: Synthetic peptide
DGVNKMR

SEQ ID NO: 2532 - protein, 7 aa, Artificial Sequence
  Description of Artificial Sequence: Synthetic peptide
ANSVPNT

SEQ ID NO: 2533 - protein, 7 aa, Artificial Sequence
  Description of Artificial Sequence: Synthetic peptide
GSQSGKV

SEQ ID NO: 2534 - protein, 7 aa, Artificial Sequence
  Description of Artificial Sequence: Synthetic peptide
STSQAGN

SEQ ID NO: 2535 - protein, 7 aa, Artificial Sequence
  Description of Artificial Sequence: Synthetic peptide
SPGKGLV

SEQ ID NO: 2536 - protein, 7 aa, Artificial Sequence
  Description of Artificial Sequence: Synthetic peptide
FRTESVA

SEQ ID NO: 2537 - protein, 7 aa, Artificial Sequence
  Description of Artificial Sequence: Synthetic peptide
DRQHTNI

SEQ ID NO: 2538 - protein, 7 aa, Artificial Sequence
  Description of Artificial Sequence: Synthetic peptide
TQAKVSG

SEQ ID NO: 2539 - protein, 7 aa, Artificial Sequence
  Description of Artificial Sequence: Synthetic peptide
SSGHGAS

SEQ ID NO: 2540 - protein, 7 aa, Artificial Sequence
  Description of Artificial Sequence: Synthetic peptide
NGSTKIT

SEQ ID NO: 2541 - protein, 7 aa, Artificial Sequence
  Description of Artificial Sequence: Synthetic peptide
EGHPRTS

SEQ ID NO: 2542 - protein, 7 aa, Artificial Sequence
  Description of Artificial Sequence: Synthetic peptide
SPSTNRE

SEQ ID NO: 2543 - protein, 7 aa, Artificial Sequence
  Description of Artificial Sequence: Synthetic peptide
NTGRDPR

SEQ ID NO: 2544 - protein, 7 aa, Artificial Sequence
  Description of Artificial Sequence: Synthetic peptide
SSSAGSL

SEQ ID NO: 2545 - protein, 7 aa, Artificial Sequence
  Description of Artificial Sequence: Synthetic peptide
HTSKVAH

SEQ ID NO: 2546 - protein, 7 aa, Artificial Sequence
  Description of Artificial Sequence: Synthetic peptide
LNPHGSG

SEQ ID NO: 2547 - protein, 7 aa, Artificial Sequence
  Description of Artificial Sequence: Synthetic peptide
VPNNGQK

SEQ ID NO: 2548 - protein, 7 aa, Artificial Sequence
  Description of Artificial Sequence: Synthetic peptide
AQPAGKI

SEQ ID NO: 2549 - protein, 7 aa, Artificial Sequence
  Description of Artificial Sequence: Synthetic peptide
GTKGSNT

SEQ ID NO: 2550 - protein, 7 aa, Artificial Sequence
  Description of Artificial Sequence: Synthetic peptide
TNGPQTK

SEQ ID NO: 2551 - protein, 7 aa, Artificial Sequence
  Description of Artificial Sequence: Synthetic peptide
TISDKSL

SEQ ID NO: 2552 - protein, 7 aa, Artificial Sequence
  Description of Artificial Sequence: Synthetic peptide
STGAGGQ

SEQ ID NO: 2553 - protein, 7 aa, Artificial Sequence
  Description of Artificial Sequence: Synthetic peptide
SAGNNNR

SEQ ID NO: 2554 - protein, 7 aa, Artificial Sequence
  Description of Artificial Sequence: Synthetic peptide
AQGNPAK

SEQ ID NO: 2555 - protein, 7 aa, Artificial Sequence
  Description of Artificial Sequence: Synthetic peptide
AINEKAV

SEQ ID NO: 2556 - protein, 7 aa, Artificial Sequence
  Description of Artificial Sequence: Synthetic peptide
IGSTTQS

SEQ ID NO: 2557 - protein, 7 aa, Artificial Sequence
  Description of Artificial Sequence: Synthetic peptide
DGRVSQG

SEQ ID NO: 2558 - protein, 7 aa, Artificial Sequence
  Description of Artificial Sequence: Synthetic peptide
ATGATPR

SEQ ID NO: 2559 - protein, 7 aa, Artificial Sequence
  Description of Artificial Sequence: Synthetic peptide
VSSKKTE

SEQ ID NO: 2560 - protein, 7 aa, Artificial Sequence
  Description of Artificial Sequence: Synthetic peptide
MASKTSQ

SEQ ID NO: 2561 - protein, 7 aa, Artificial Sequence
  Description of Artificial Sequence: Synthetic peptide
GRQQQSG

SEQ ID NO: 2562 - protein, 7 aa, Artificial Sequence
  Description of Artificial Sequence: Synthetic peptide
TANASHS

SEQ ID NO: 2563 - protein, 7 aa, Artificial Sequence
  Description of Artificial Sequence: Synthetic peptide
GGVSSNT

SEQ ID NO: 2564 - protein, 7 aa, Artificial Sequence
  Description of Artificial Sequence: Synthetic peptide
NSQGSTL

SEQ ID NO: 2565 - protein, 7 aa, Artificial Sequence
  Description of Artificial Sequence: Synthetic peptide
NTGSGLK

SEQ ID NO: 2566 - protein, 7 aa, Artificial Sequence
  Description of Artificial Sequence: Synthetic peptide
RSASPPV

SEQ ID NO: 2567 - protein, 7 aa, Artificial Sequence
  Description of Artificial Sequence: Synthetic peptide
ESGDRVK

SEQ ID NO: 2568 - protein, 7 aa, Artificial Sequence
  Description of Artificial Sequence: Synthetic peptide
AGNQSTG

SEQ ID NO: 2569 - protein, 7 aa, Artificial Sequence
  Description of Artificial Sequence: Synthetic peptide
SLTKNGA

SEQ ID NO: 2570 - protein, 7 aa, Artificial Sequence
  Description of Artificial Sequence: Synthetic peptide
SPGKGAS

SEQ ID NO: 2571 - protein, 7 aa, Artificial Sequence
  Description of Artificial Sequence: Synthetic peptide
SNVNSMK

SEQ ID NO: 2572 - protein, 7 aa, Artificial Sequence
  Description of Artificial Sequence: Synthetic peptide
KQAGAME

SEQ ID NO: 2573 - protein, 7 aa, Artificial Sequence
  Description of Artificial Sequence: Synthetic peptide
LSSGSMG

SEQ ID NO: 2574 - protein, 7 aa, Artificial Sequence
  Description of Artificial Sequence: Synthetic peptide
ALNSKTN

SEQ ID NO: 2575 - protein, 7 aa, Artificial Sequence
  Description of Artificial Sequence: Synthetic peptide
GVESRQK

SEQ ID NO: 2576 - protein, 7 aa, Artificial Sequence
  Description of Artificial Sequence: Synthetic peptide
TGRTPAV

SEQ ID NO: 2577 - protein, 7 aa, Artificial Sequence
  Description of Artificial Sequence: Synthetic peptide
DSNNANR

SEQ ID NO: 2578 - protein, 7 aa, Artificial Sequence
  Description of Artificial Sequence: Synthetic peptide
KSNSAIT

SEQ ID NO: 2579 - protein, 7 aa, Artificial Sequence
  Description of Artificial Sequence: Synthetic peptide
MTGGAGS

SEQ ID NO: 2580 - protein, 7 aa, Artificial Sequence
  Description of Artificial Sequence: Synthetic peptide
SVEHKGG

SEQ ID NO: 2581 - protein, 7 aa, Artificial Sequence
  Description of Artificial Sequence: Synthetic peptide
SNGRANA

SEQ ID NO: 2582 - protein, 7 aa, Artificial Sequence
  Description of Artificial Sequence: Synthetic peptide
GNSSSKS

SEQ ID NO: 2583 - protein, 7 aa, Artificial Sequence
  Description of Artificial Sequence: Synthetic peptide
SQTTKTS

SEQ ID NO: 2584 - protein, 7 aa, Artificial Sequence
  Description of Artificial Sequence: Synthetic peptide
LTSQKPA

SEQ ID NO: 2585 - protein, 7 aa, Artificial Sequence
  Description of Artificial Sequence: Synthetic peptide
ETESRAA

SEQ ID NO: 2586 - protein, 7 aa, Artificial Sequence
  Description of Artificial Sequence: Synthetic peptide
GVPSSTK

SEQ ID NO: 2587 - protein, 7 aa, Artificial Sequence
  Description of Artificial Sequence: Synthetic peptide
QGPSKGS

SEQ ID NO: 2588 - protein, 7 aa, Artificial Sequence
  Description of Artificial Sequence: Synthetic peptide
LSGSSNL

SEQ ID NO: 2589 - protein, 7 aa, Artificial Sequence
  Description of Artificial Sequence: Synthetic peptide
VTDTPHQ

SEQ ID NO: 2590 - protein, 7 aa, Artificial Sequence
  Description of Artificial Sequence: Synthetic peptide
LTGSNSK

SEQ ID NO: 2591 - protein, 7 aa, Artificial Sequence
  Description of Artificial Sequence: Synthetic peptide
TISSTPS

SEQ ID NO: 2592 - protein, 7 aa, Artificial Sequence
  Description of Artificial Sequence: Synthetic peptide
NPGGSKL

SEQ ID NO: 2593 - protein, 7 aa, Artificial Sequence
  Description of Artificial Sequence: Synthetic peptide
TQEHKST

SEQ ID NO: 2594 - protein, 7 aa, Artificial Sequence
  Description of Artificial Sequence: Synthetic peptide
DKVPHGV

SEQ ID NO: 2595 - protein, 7 aa, Artificial Sequence
  Description of Artificial Sequence: Synthetic peptide
VGSRPDK

SEQ ID NO: 2596 - protein, 7 aa, Artificial Sequence
  Description of Artificial Sequence: Synthetic peptide
GTAGGQS

SEQ ID NO: 2597 - protein, 7 aa, Artificial Sequence
  Description of Artificial Sequence: Synthetic peptide
QSERTPT

SEQ ID NO: 2598 - protein, 7 aa, Artificial Sequence
  Description of Artificial Sequence: Synthetic peptide
ANAAPLK

SEQ ID NO: 2599 - protein, 7 aa, Artificial Sequence
  Description of Artificial Sequence: Synthetic peptide
NHSTSAP

SEQ ID NO: 2600 - protein, 7 aa, Artificial Sequence
  Description of Artificial Sequence: Synthetic peptide
TVSGSTK

SEQ ID NO: 2601 - protein, 7 aa, Artificial Sequence
  Description of Artificial Sequence: Synthetic peptide
ASSPINK

SEQ ID NO: 2602 - protein, 7 aa, Artificial Sequence
  Description of Artificial Sequence: Synthetic peptide
GTSGKSM

SEQ ID NO: 2603 - protein, 7 aa, Artificial Sequence
  Description of Artificial Sequence: Synthetic peptide
LANVPTQ

SEQ ID NO: 2604 - protein, 7 aa, Artificial Sequence
  Description of Artificial Sequence: Synthetic peptide
SQAASPR

SEQ ID NO: 2605 - protein, 7 aa, Artificial Sequence
  Description of Artificial Sequence: Synthetic peptide
SVDKNNR

SEQ ID NO: 2606 - protein, 7 aa, Artificial Sequence
  Description of Artificial Sequence: Synthetic peptide
GSDRKSE

SEQ ID NO: 2607 - protein, 7 aa, Artificial Sequence
  Description of Artificial Sequence: Synthetic peptide
TSTSRPN

SEQ ID NO: 2608 - protein, 7 aa, Artificial Sequence
  Description of Artificial Sequence: Synthetic peptide
QGSGKMS

SEQ ID NO: 2609 - protein, 7 aa, Artificial Sequence
  Description of Artificial Sequence: Synthetic peptide
DTRSANQ

SEQ ID NO: 2610 - protein, 7 aa, Artificial Sequence
  Description of Artificial Sequence: Synthetic peptide
KTGQSSS

SEQ ID NO: 2611 - protein, 7 aa, Artificial Sequence
  Description of Artificial Sequence: Synthetic peptide
GRDKTVS

SEQ ID NO: 2612 - protein, 7 aa, Artificial Sequence
  Description of Artificial Sequence: Synthetic peptide
GLSEHKV

SEQ ID NO: 2613 - protein, 7 aa, Artificial Sequence
  Description of Artificial Sequence: Synthetic peptide
TTNTKDR

SEQ ID NO: 2614 - protein, 7 aa, Artificial Sequence
  Description of Artificial Sequence: Synthetic peptide
ERPGPAK

SEQ ID NO: 2615 - protein, 7 aa, Artificial Sequence
  Description of Artificial Sequence: Synthetic peptide
GAGPSPT

SEQ ID NO: 2616 - protein, 7 aa, Artificial Sequence
  Description of Artificial Sequence: Synthetic peptide
ERDGKNF

SEQ ID NO: 2617 - protein, 7 aa, Artificial Sequence
  Description of Artificial Sequence: Synthetic peptide
SADRENR

SEQ ID NO: 2618 - protein, 7 aa, Artificial Sequence
  Description of Artificial Sequence: Synthetic peptide
DSNRGSA

SEQ ID NO: 2619 - protein, 7 aa, Artificial Sequence
  Description of Artificial Sequence: Synthetic peptide
ALKNSNQ

SEQ ID NO: 2620 - protein, 7 aa, Artificial Sequence
  Description of Artificial Sequence: Synthetic peptide
LNSGKLS

SEQ ID NO: 2621 - protein, 7 aa, Artificial Sequence
  Description of Artificial Sequence: Synthetic peptide
GQHNATT

SEQ ID NO: 2622 - protein, 7 aa, Artificial Sequence
  Description of Artificial Sequence: Synthetic peptide
LVGSKSE

SEQ ID NO: 2623 - protein, 7 aa, Artificial Sequence
  Description of Artificial Sequence: Synthetic peptide
ATVSKTA

SEQ ID NO: 2624 - protein, 7 aa, Artificial Sequence
  Description of Artificial Sequence: Synthetic peptide
ARTGSST

SEQ ID NO: 2625 - protein, 7 aa, Artificial Sequence
  Description of Artificial Sequence: Synthetic peptide
TQHKDKP

SEQ ID NO: 2626 - protein, 7 aa, Artificial Sequence
  Description of Artificial Sequence: Synthetic peptide
TPHTANK

SEQ ID NO: 2627 - protein, 7 aa, Artificial Sequence
  Description of Artificial Sequence: Synthetic peptide
SGTKAHD

SEQ ID NO: 2628 - protein, 7 aa, Artificial Sequence
  Description of Artificial Sequence: Synthetic peptide
SGSNSRD

SEQ ID NO: 2629 - protein, 7 aa, Artificial Sequence
  Description of Artificial Sequence: Synthetic peptide
MRVDKQI

SEQ ID NO: 2630 - protein, 7 aa, Artificial Sequence
  Description of Artificial Sequence: Synthetic peptide
IPRQQPG

SEQ ID NO: 2631 - protein, 7 aa, Artificial Sequence
  Description of Artificial Sequence: Synthetic peptide
SPSSQGG

SEQ ID NO: 2632 - protein, 7 aa, Artificial Sequence
  Description of Artificial Sequence: Synthetic peptide
SPGGRDS

SEQ ID NO: 2633 - protein, 7 aa, Artificial Sequence
  Description of Artificial Sequence: Synthetic peptide
ATGSGSR

SEQ ID NO: 2634 - protein, 7 aa, Artificial Sequence
  Description of Artificial Sequence: Synthetic peptide
GRSDTPS

SEQ ID NO: 2635 - protein, 7 aa, Artificial Sequence
  Description of Artificial Sequence: Synthetic peptide
RGSSTST

SEQ ID NO: 2636 - protein, 7 aa, Artificial Sequence
  Description of Artificial Sequence: Synthetic peptide
GRLSSEK

SEQ ID NO: 2637 - protein, 7 aa, Artificial Sequence
  Description of Artificial Sequence: Synthetic peptide
AVGTTPS

SEQ ID NO: 2638 - protein, 7 aa, Artificial Sequence
  Description of Artificial Sequence: Synthetic peptide
APSMSGK

SEQ ID NO: 2639 - protein, 7 aa, Artificial Sequence
  Description of Artificial Sequence: Synthetic peptide
NGNGPGK

SEQ ID NO: 2640 - protein, 7 aa, Artificial Sequence
  Description of Artificial Sequence: Synthetic peptide
TSDARPS

SEQ ID NO: 2641 - protein, 7 aa, Artificial Sequence
  Description of Artificial Sequence: Synthetic peptide
TPERVGG

SEQ ID NO: 2642 - protein, 7 aa, Artificial Sequence
  Description of Artificial Sequence: Synthetic peptide
SSATKSI

SEQ ID NO: 2643 - protein, 7 aa, Artificial Sequence
  Description of Artificial Sequence: Synthetic peptide
AGNSDKR

SEQ ID NO: 2644 - protein, 7 aa, Artificial Sequence
  Description of Artificial Sequence: Synthetic peptide
NPVARSE

SEQ ID NO: 2645 - protein, 7 aa, Artificial Sequence
  Description of Artificial Sequence: Synthetic peptide
TRDASVH

SEQ ID NO: 2646 - protein, 7 aa, Artificial Sequence
  Description of Artificial Sequence: Synthetic peptide
NPSTPKG

SEQ ID NO: 2647 - protein, 7 aa, Artificial Sequence
  Description of Artificial Sequence: Synthetic peptide
TGKGSSG

SEQ ID NO: 2648 - protein, 7 aa, Artificial Sequence
  Description of Artificial Sequence: Synthetic peptide
QGATGNR

SEQ ID NO: 2649 - protein, 7 aa, Artificial Sequence
  Description of Artificial Sequence: Synthetic peptide
SVREKPA

SEQ ID NO: 2650 - protein, 7 aa, Artificial Sequence
  Description of Artificial Sequence: Synthetic peptide
TTKTTAS

SEQ ID NO: 2651 - protein, 7 aa, Artificial Sequence
  Description of Artificial Sequence: Synthetic peptide
TGDRSNT

SEQ ID NO: 2652 - protein, 7 aa, Artificial Sequence
  Description of Artificial Sequence: Synthetic peptide
HVGSKSG

SEQ ID NO: 2653 - protein, 7 aa, Artificial Sequence
  Description of Artificial Sequence: Synthetic peptide
ATSKPTT

SEQ ID NO: 2654 - protein, 7 aa, Artificial Sequence
  Description of Artificial Sequence: Synthetic peptide
YANGKVG

SEQ ID NO: 2655 - protein, 7 aa, Artificial Sequence
  Description of Artificial Sequence: Synthetic peptide
LASSHST

SEQ ID NO: 2656 - protein, 7 aa, Artificial Sequence
  Description of Artificial Sequence: Synthetic peptide
AGSDHTR

SEQ ID NO: 2657 - protein, 7 aa, Artificial Sequence
  Description of Artificial Sequence: Synthetic peptide
VPEKGTL

SEQ ID NO: 2658 - protein, 7 aa, Artificial Sequence
  Description of Artificial Sequence: Synthetic peptide
SAGGGAS

SEQ ID NO: 2659 - protein, 7 aa, Artificial Sequence
  Description of Artificial Sequence: Synthetic peptide
GTAARDV

SEQ ID NO: 2660 - protein, 7 aa, Artificial Sequence
  Description of Artificial Sequence: Synthetic peptide
QGSERSR

SEQ ID NO: 2661 - protein, 7 aa, Artificial Sequence
  Description of Artificial Sequence: Synthetic peptide
QSKASQV

SEQ ID NO: 2662 - protein, 7 aa, Artificial Sequence
  Description of Artificial Sequence: Synthetic peptide
RQGEVQS

SEQ ID NO: 2663 - protein, 7 aa, Artificial Sequence
  Description of Artificial Sequence: Synthetic peptide
DRSPGAQ

SEQ ID NO: 2664 - protein, 7 aa, Artificial Sequence
  Description of Artificial Sequence: Synthetic peptide
LSATKTP

SEQ ID NO: 2665 - protein, 7 aa, Artificial Sequence
  Description of Artificial Sequence: Synthetic peptide
KQGSGLS

SEQ ID NO: 2666 - protein, 7 aa, Artificial Sequence
  Description of Artificial Sequence: Synthetic peptide
NSTPTVR

SEQ ID NO: 2667 - protein, 7 aa, Artificial Sequence
  Description of Artificial Sequence: Synthetic peptide
TTGKEKN

SEQ ID NO: 2668 - protein, 7 aa, Artificial Sequence
  Description of Artificial Sequence: Synthetic peptide
TSSKSPT

SEQ ID NO: 2669 - protein, 7 aa, Artificial Sequence
  Description of Artificial Sequence: Synthetic peptide
RQGQATA

SEQ ID NO: 2670 - protein, 7 aa, Artificial Sequence
  Description of Artificial Sequence: Synthetic peptide
SLGQPGS

SEQ ID NO: 2671 - protein, 7 aa, Artificial Sequence
  Description of Artificial Sequence: Synthetic peptide
SAGDSRN

SEQ ID NO: 2672 - protein, 7 aa, Artificial Sequence
  Description of Artificial Sequence: Synthetic peptide
QPSGGNT

SEQ ID NO: 2673 - protein, 7 aa, Artificial Sequence
  Description of Artificial Sequence: Synthetic peptide
DPGPSSS

SEQ ID NO: 2674 - protein, 7 aa, Artificial Sequence
  Description of Artificial Sequence: Synthetic peptide
AATEKGR

SEQ ID NO: 2675 - protein, 7 aa, Artificial Sequence
  Description of Artificial Sequence: Synthetic peptide
SSGTLGS

SEQ ID NO: 2676 - protein, 7 aa, Artificial Sequence
  Description of Artificial Sequence: Synthetic peptide
SSSPSLK

SEQ ID NO: 2677 - protein, 7 aa, Artificial Sequence
  Description of Artificial Sequence: Synthetic peptide
FEGSGAK

SEQ ID NO: 2678 - protein, 7 aa, Artificial Sequence
  Description of Artificial Sequence: Synthetic peptide
DSGRPTT

SEQ ID NO: 2679 - protein, 7 aa, Artificial Sequence
  Description of Artificial Sequence: Synthetic peptide
HASASPT

SEQ ID NO: 2680 - protein, 7 aa, Artificial Sequence
  Description of Artificial Sequence: Synthetic peptide
DTRKASA

SEQ ID NO: 2681 - protein, 7 aa, Artificial Sequence
  Description of Artificial Sequence: Synthetic peptide
SQGVNPP

SEQ ID NO: 2682 - protein, 7 aa, Artificial Sequence
  Description of Artificial Sequence: Synthetic peptide
VQNSGGN

SEQ ID NO: 2683 - protein, 7 aa, Artificial Sequence
  Description of Artificial Sequence: Synthetic peptide
SLPDHKT

SEQ ID NO: 2684 - protein, 7 aa, Artificial Sequence
  Description of Artificial Sequence: Synthetic peptide
DTTNGNV

SEQ ID NO: 2685 - protein, 7 aa, Artificial Sequence
  Description of Artificial Sequence: Synthetic peptide
GKNQSSM

SEQ ID NO: 2686 - protein, 7 aa, Artificial Sequence
  Description of Artificial Sequence: Synthetic peptide
SRSTSPS

SEQ ID NO: 2687 - protein, 7 aa, Artificial Sequence
  Description of Artificial Sequence: Synthetic peptide
SNSGGSK

SEQ ID NO: 2688 - protein, 7 aa, Artificial Sequence
  Description of Artificial Sequence: Synthetic peptide
EGHTKML

SEQ ID NO: 2689 - protein, 7 aa, Artificial Sequence
  Description of Artificial Sequence: Synthetic peptide
AAGSTVH

SEQ ID NO: 2690 - protein, 7 aa, Artificial Sequence
  Description of Artificial Sequence: Synthetic peptide
VQAANSQ

SEQ ID NO: 2691 - protein, 7 aa, Artificial Sequence
  Description of Artificial Sequence: Synthetic peptide
TVGKGLQ

SEQ ID NO: 2692 - protein, 7 aa, Artificial Sequence
  Description of Artificial Sequence: Synthetic peptide
SGAVKPN

SEQ ID NO: 2693 - protein, 7 aa, Artificial Sequence
  Description of Artificial Sequence: Synthetic peptide
DRTPTHT

SEQ ID NO: 2694 - protein, 7 aa, Artificial Sequence
  Description of Artificial Sequence: Synthetic peptide
GGSREQS

SEQ ID NO: 2695 - protein, 7 aa, Artificial Sequence
  Description of Artificial Sequence: Synthetic peptide
GKTGTHM

SEQ ID NO: 2696 - protein, 7 aa, Artificial Sequence
  Description of Artificial Sequence: Synthetic peptide
TTSSSSM

SEQ ID NO: 2697 - protein, 7 aa, Artificial Sequence
  Description of Artificial Sequence: Synthetic peptide
SRSTQAE

SEQ ID NO: 2698 - protein, 7 aa, Artificial Sequence
  Description of Artificial Sequence: Synthetic peptide
QTSGKPM

SEQ ID NO: 2699 - protein, 7 aa, Artificial Sequence
  Description of Artificial Sequence: Synthetic peptide
SGSGNGS

SEQ ID NO: 2700 - protein, 7 aa, Artificial Sequence
  Description of Artificial Sequence: Synthetic peptide
NAVKPYS

SEQ ID NO: 2701 - protein, 7 aa, Artificial Sequence
  Description of Artificial Sequence: Synthetic peptide
SSGQRTS

SEQ ID NO: 2702 - protein, 7 aa, Artificial Sequence
  Description of Artificial Sequence: Synthetic peptide
AGNHPAT

SEQ ID NO: 2703 - protein, 7 aa, Artificial Sequence
  Description of Artificial Sequence: Synthetic peptide
HSRESQQ

SEQ ID NO: 2704 - protein, 7 aa, Artificial Sequence
  Description of Artificial Sequence: Synthetic peptide
SRTDRPI

SEQ ID NO: 2705 - protein, 7 aa, Artificial Sequence
  Description of Artificial Sequence: Synthetic peptide
MGSSKTT

SEQ ID NO: 2706 - protein, 7 aa, Artificial Sequence
  Description of Artificial Sequence: Synthetic peptide
LQTNSTA

SEQ ID NO: 2707 - protein, 7 aa, Artificial Sequence
  Description of Artificial Sequence: Synthetic peptide
DSPPSKH

SEQ ID NO: 2708 - protein, 7 aa, Artificial Sequence
  Description of Artificial Sequence: Synthetic peptide
TGVTKPS

SEQ ID NO: 2709 - protein, 7 aa, Artificial Sequence
  Description of Artificial Sequence: Synthetic peptide
SLTNSRS

SEQ ID NO: 2710 - protein, 7 aa, Artificial Sequence
  Description of Artificial Sequence: Synthetic peptide
GPSPPTT

SEQ ID NO: 2711 - protein, 7 aa, Artificial Sequence
  Description of Artificial Sequence: Synthetic peptide
KSGANTV

SEQ ID NO: 2712 - protein, 7 aa, Artificial Sequence
  Description of Artificial Sequence: Synthetic peptide
RNSEGPK

SEQ ID NO: 2713 - protein, 7 aa, Artificial Sequence
  Description of Artificial Sequence: Synthetic peptide
STKSVST

SEQ ID NO: 2714 - protein, 7 aa, Artificial Sequence
  Description of Artificial Sequence: Synthetic peptide
SNHSPNV

SEQ ID NO: 2715 - protein, 7 aa, Artificial Sequence
  Description of Artificial Sequence: Synthetic peptide
SSVQKQQ

SEQ ID NO: 2716 - protein, 7 aa, Artificial Sequence
  Description of Artificial Sequence: Synthetic peptide
SGRGSNS

SEQ ID NO: 2717 - protein, 7 aa, Artificial Sequence
  Description of Artificial Sequence: Synthetic peptide
MDNQKAR

SEQ ID NO: 2718 - protein, 7 aa, Artificial Sequence
  Description of Artificial Sequence: Synthetic peptide
LASGSRS

SEQ ID NO: 2719 - protein, 7 aa, Artificial Sequence
  Description of Artificial Sequence: Synthetic peptide
DQNGSRL

SEQ ID NO: 2720 - protein, 7 aa, Artificial Sequence
  Description of Artificial Sequence: Synthetic peptide
ETTRPTT

SEQ ID NO: 2721 - protein, 7 aa, Artificial Sequence
  Description of Artificial Sequence: Synthetic peptide
GSLGTGN

SEQ ID NO: 2722 - protein, 7 aa, Artificial Sequence
  Description of Artificial Sequence: Synthetic peptide
TGTSTAT

SEQ ID NO: 2723 - protein, 7 aa, Artificial Sequence
  Description of Artificial Sequence: Synthetic peptide
NSGRPST

SEQ ID NO: 2724 - protein, 7 aa, Artificial Sequence
  Description of Artificial Sequence: Synthetic peptide
TQLGAPK

SEQ ID NO: 2725 - protein, 7 aa, Artificial Sequence
  Description of Artificial Sequence: Synthetic peptide
QQRQSTG

SEQ ID NO: 2726 - protein, 7 aa, Artificial Sequence
  Description of Artificial Sequence: Synthetic peptide
ATGIPST

SEQ ID NO: 2727 - protein, 7 aa, Artificial Sequence
  Description of Artificial Sequence: Synthetic peptide
GQSQPFK

SEQ ID NO: 2728 - protein, 7 aa, Artificial Sequence
  Description of Artificial Sequence: Synthetic peptide
VAAKGSS

SEQ ID NO: 2729 - protein, 7 aa, Artificial Sequence
  Description of Artificial Sequence: Synthetic peptide
AVSKSTI

SEQ ID NO: 2730 - protein, 7 aa, Artificial Sequence
  Description of Artificial Sequence: Synthetic peptide
MSSQGGS

SEQ ID NO: 2731 - protein, 7 aa, Artificial Sequence
  Description of Artificial Sequence: Synthetic peptide
QHSGSST

SEQ ID NO: 2732 - protein, 7 aa, Artificial Sequence
  Description of Artificial Sequence: Synthetic peptide
HTDLKTT

SEQ ID NO: 2733 - protein, 7 aa, Artificial Sequence
  Description of Artificial Sequence: Synthetic peptide
AVEGSKN

SEQ ID NO: 2734 - protein, 7 aa, Artificial Sequence
  Description of Artificial Sequence: Synthetic peptide
ARSGNNI

SEQ ID NO: 2735 - protein, 7 aa, Artificial Sequence
  Description of Artificial Sequence: Synthetic peptide
GPGAPSK

SEQ ID NO: 2736 - protein, 7 aa, Artificial Sequence
  Description of Artificial Sequence: Synthetic peptide
SAADPKV

SEQ ID NO: 2737 - protein, 7 aa, Artificial Sequence
  Description of Artificial Sequence: Synthetic peptide
SHGTENK

SEQ ID NO: 2738 - protein, 7 aa, Artificial Sequence
  Description of Artificial Sequence: Synthetic peptide
SPVSGTT

SEQ ID NO: 2739 - protein, 7 aa, Artificial Sequence
  Description of Artificial Sequence: Synthetic peptide
VNTSNTT

SEQ ID NO: 2740 - protein, 7 aa, Artificial Sequence
  Description of Artificial Sequence: Synthetic peptide
SSTSGAG

SEQ ID NO: 2741 - protein, 7 aa, Artificial Sequence
  Description of Artificial Sequence: Synthetic peptide
GTPSKAG

SEQ ID NO: 2742 - protein, 7 aa, Artificial Sequence
  Description of Artificial Sequence: Synthetic peptide
DKTTAGQ

SEQ ID NO: 2743 - protein, 7 aa, Artificial Sequence
  Description of Artificial Sequence: Synthetic peptide
TTGGHSS

SEQ ID NO: 2744 - protein, 7 aa, Artificial Sequence
  Description of Artificial Sequence: Synthetic peptide
GASNSTG

SEQ ID NO: 2745 - protein, 7 aa, Artificial Sequence
  Description of Artificial Sequence: Synthetic peptide
AINGKAG

SEQ ID NO: 2746 - protein, 7 aa, Artificial Sequence
  Description of Artificial Sequence: Synthetic peptide
VIDTKAG

SEQ ID NO: 2747 - protein, 7 aa, Artificial Sequence
  Description of Artificial Sequence: Synthetic peptide
NASSSTG

SEQ ID NO: 2748 - protein, 7 aa, Artificial Sequence
  Description of Artificial Sequence: Synthetic peptide
GTSSPAN

SEQ ID NO: 2749 - protein, 7 aa, Artificial Sequence
  Description of Artificial Sequence: Synthetic peptide
GPGDTRS

SEQ ID NO: 2750 - protein, 7 aa, Artificial Sequence
  Description of Artificial Sequence: Synthetic peptide
GNGSSAL

SEQ ID NO: 2751 - protein, 7 aa, Artificial Sequence
  Description of Artificial Sequence: Synthetic peptide
GRSGGTG

SEQ ID NO: 2752 - protein, 7 aa, Artificial Sequence
  Description of Artificial Sequence: Synthetic peptide
STGPTPA

SEQ ID NO: 2753 - protein, 7 aa, Artificial Sequence
  Description of Artificial Sequence: Synthetic peptide
HGGRDSS

SEQ ID NO: 2754 - protein, 7 aa, Artificial Sequence
  Description of Artificial Sequence: Synthetic peptide
GSGTPNG

SEQ ID NO: 2755 - protein, 7 aa, Artificial Sequence
  Description of Artificial Sequence: Synthetic peptide
GKAGSTG

SEQ ID NO: 2756 - protein, 7 aa, Artificial Sequence
  Description of Artificial Sequence: Synthetic peptide
LSAGKGE

SEQ ID NO: 2757 - protein, 7 aa, Artificial Sequence
  Description of Artificial Sequence: Synthetic peptide
VGIPSAG

SEQ ID NO: 2758 - protein, 7 aa, Artificial Sequence
  Description of Artificial Sequence: Synthetic peptide
SGGQKDN

SEQ ID NO: 2759 - protein, 7 aa, Artificial Sequence
  Description of Artificial Sequence: Synthetic peptide
ETGGSPK

SEQ ID NO: 2760 - protein, 7 aa, Artificial Sequence
  Description of Artificial Sequence: Synthetic peptide
QGHTNVA

SEQ ID NO: 2761 - protein, 7 aa, Artificial Sequence
  Description of Artificial Sequence: Synthetic peptide
SHGSPAS

SEQ ID NO: 2762 - protein, 7 aa, Artificial Sequence
  Description of Artificial Sequence: Synthetic peptide
SQKSVAG

SEQ ID NO: 2763 - protein, 7 aa, Artificial Sequence
  Description of Artificial Sequence: Synthetic peptide
VGQSAAQ

SEQ ID NO: 2764 - protein, 7 aa, Artificial Sequence
  Description of Artificial Sequence: Synthetic peptide
DGQSSKS

SEQ ID NO: 2765 - protein, 7 aa, Artificial Sequence
  Description of Artificial Sequence: Synthetic peptide
AQAKPAG

SEQ ID NO: 2766 - protein, 7 aa, Artificial Sequence
  Description of Artificial Sequence: Synthetic peptide
TGHNSSM

SEQ ID NO: 2767 - protein, 7 aa, Artificial Sequence
  Description of Artificial Sequence: Synthetic peptide
GQSTSSG

SEQ ID NO: 2768 - protein, 7 aa, Artificial Sequence
  Description of Artificial Sequence: Synthetic peptide
TGISGAG

SEQ ID NO: 2769 - protein, 7 aa, Artificial Sequence
  Description of Artificial Sequence: Synthetic peptide
VRDTSSS

SEQ ID NO: 2770 - protein, 7 aa, Artificial Sequence
  Description of Artificial Sequence: Synthetic peptide
VSSKGLA

SEQ ID NO: 2771 - protein, 7 aa, Artificial Sequence
  Description of Artificial Sequence: Synthetic peptide
DGRSTSA

SEQ ID NO: 2772 - protein, 7 aa, Artificial Sequence
  Description of Artificial Sequence: Synthetic peptide
SSNTGHT

SEQ ID NO: 2773 - protein, 7 aa, Artificial Sequence
  Description of Artificial Sequence: Synthetic peptide
QNNSKTE

SEQ ID NO: 2774 - protein, 7 aa, Artificial Sequence
  Description of Artificial Sequence: Synthetic peptide
QEGSSSK

SEQ ID NO: 2775 - protein, 7 aa, Artificial Sequence
  Description of Artificial Sequence: Synthetic peptide
NTKTTTG

SEQ ID NO: 2776 - protein, 7 aa, Artificial Sequence
  Description of Artificial Sequence: Synthetic peptide
ASNSGST

SEQ ID NO: 2777 - protein, 7 aa, Artificial Sequence
  Description of Artificial Sequence: Synthetic peptide
LGGGKES

SEQ ID NO: 2778 - protein, 7 aa, Artificial Sequence
  Description of Artificial Sequence: Synthetic peptide
GNGKSDG

SEQ ID NO: 2779 - protein, 7 aa, Artificial Sequence
  Description of Artificial Sequence: Synthetic peptide
SEANQKL

SEQ ID NO: 2780 - protein, 7 aa, Artificial Sequence
  Description of Artificial Sequence: Synthetic peptide
ASSPSGG

SEQ ID NO: 2781 - protein, 7 aa, Artificial Sequence
  Description of Artificial Sequence: Synthetic peptide
DTGKASM

SEQ ID NO: 2782 - protein, 7 aa, Artificial Sequence
  Description of Artificial Sequence: Synthetic peptide
ETSKERA

SEQ ID NO: 2783 - protein, 7 aa, Artificial Sequence
  Description of Artificial Sequence: Synthetic peptide
GGGHKES

SEQ ID NO: 2784 - protein, 7 aa, Artificial Sequence
  Description of Artificial Sequence: Synthetic peptide
DNGTKVI

SEQ ID NO: 2785 - protein, 7 aa, Artificial Sequence
  Description of Artificial Sequence: Synthetic peptide
QVGKDSH

SEQ ID NO: 2786 - protein, 7 aa, Artificial Sequence
  Description of Artificial Sequence: Synthetic peptide
TTSATSV

SEQ ID NO: 2787 - protein, 7 aa, Artificial Sequence
  Description of Artificial Sequence: Synthetic peptide
QATGGTQ

SEQ ID NO: 2788 - protein, 7 aa, Artificial Sequence
  Description of Artificial Sequence: Synthetic peptide
ESGKGSL

SEQ ID NO: 2789 - protein, 7 aa, Artificial Sequence
  Description of Artificial Sequence: Synthetic peptide
ENSSGHA

SEQ ID NO: 2790 - protein, 7 aa, Artificial Sequence
  Description of Artificial Sequence: Synthetic peptide
DTKTSPG

SEQ ID NO: 2791 - protein, 7 aa, Artificial Sequence
  Description of Artificial Sequence: Synthetic peptide
HGNTTSG

SEQ ID NO: 2792 - protein, 7 aa, Artificial Sequence
  Description of Artificial Sequence: Synthetic peptide
NVGATST

SEQ ID NO: 2793 - protein, 7 aa, Artificial Sequence
  Description of Artificial Sequence: Synthetic peptide
NGNGQSK

SEQ ID NO: 2794 - protein, 7 aa, Artificial Sequence
  Description of Artificial Sequence: Synthetic peptide
GLSGSAG

SEQ ID NO: 2795 - protein, 7 aa, Artificial Sequence
  Description of Artificial Sequence: Synthetic peptide
TNGSKPD

SEQ ID NO: 2796 - protein, 7 aa, Artificial Sequence
  Description of Artificial Sequence: Synthetic peptide
YPEAKGA

SEQ ID NO: 2797 - protein, 7 aa, Artificial Sequence
  Description of Artificial Sequence: Synthetic peptide
GQSSGGG

SEQ ID NO: 2798 - protein, 7 aa, Artificial Sequence
  Description of Artificial Sequence: Synthetic peptide
DMNGAGK

SEQ ID NO: 2799 - protein, 7 aa, Artificial Sequence
  Description of Artificial Sequence: Synthetic peptide
GNGNKVI

SEQ ID NO: 2800 - protein, 7 aa, Artificial Sequence
  Description of Artificial Sequence: Synthetic peptide
TSDSKNT

SEQ ID NO: 2801 - protein, 7 aa, Artificial Sequence
  Description of Artificial Sequence: Synthetic peptide
AGKGTSE

SEQ ID NO: 2802 - protein, 7 aa, Artificial Sequence
  Description of Artificial Sequence: Synthetic peptide
TSEDRSK

SEQ ID NO: 2803 - protein, 7 aa, Artificial Sequence
  Description of Artificial Sequence: Synthetic peptide
VQSSSTT

SEQ ID NO: 2804 - protein, 7 aa, Artificial Sequence
  Description of Artificial Sequence: Synthetic peptide
SGVSERG

SEQ ID NO: 2805 - protein, 7 aa, Artificial Sequence
  Description of Artificial Sequence: Synthetic peptide
KEGSNGV

SEQ ID NO: 2806 - protein, 7 aa, Artificial Sequence
  Description of Artificial Sequence: Synthetic peptide
DRGQESR

SEQ ID NO: 2807 - protein, 7 aa, Artificial Sequence
  Description of Artificial Sequence: Synthetic peptide
DGVSDRK

SEQ ID NO: 2808 - protein, 7 aa, Artificial Sequence
  Description of Artificial Sequence: Synthetic peptide
TGQGTNV

SEQ ID NO: 2809 - protein, 7 aa, Artificial Sequence
  Description of Artificial Sequence: Synthetic peptide
ENGTKPG

SEQ ID NO: 2810 - protein, 7 aa, Artificial Sequence
  Description of Artificial Sequence: Synthetic peptide
EAGHGNG

SEQ ID NO: 2811 - protein, 7 aa, Artificial Sequence
  Description of Artificial Sequence: Synthetic peptide
DGSGKIN

SEQ ID NO: 2812 - protein, 7 aa, Artificial Sequence
  Description of Artificial Sequence: Synthetic peptide
QNGSSQS

SEQ ID NO: 2813 - protein, 7 aa, Artificial Sequence
  Description of Artificial Sequence: Synthetic peptide
SNGKTSV

SEQ ID NO: 2814 - protein, 7 aa, Artificial Sequence
  Description of Artificial Sequence: Synthetic peptide
SSAGKGD

SEQ ID NO: 2815 - protein, 7 aa, Artificial Sequence
  Description of Artificial Sequence: Synthetic peptide
QSKSSQG

SEQ ID NO: 2816 - protein, 7 aa, Artificial Sequence
  Description of Artificial Sequence: Synthetic peptide
DPSDKPR

SEQ ID NO: 2817 - protein, 7 aa, Artificial Sequence
  Description of Artificial Sequence: Synthetic peptide
GSSEARG

SEQ ID NO: 2818 - protein, 7 aa, Artificial Sequence
  Description of Artificial Sequence: Synthetic peptide
NGTKQGT

SEQ ID NO: 2819 - protein, 7 aa, Artificial Sequence
  Description of Artificial Sequence: Synthetic peptide
EGGSSVN

SEQ ID NO: 2820 - protein, 7 aa, Artificial Sequence
  Description of Artificial Sequence: Synthetic peptide
GSGKGSG

SEQ ID NO: 2821 - protein, 7 aa, Artificial Sequence
  Description of Artificial Sequence: Synthetic peptide
DATKAGL

SEQ ID NO: 2822 - protein, 7 aa, Artificial Sequence
  Description of Artificial Sequence: Synthetic peptide
QKTSNTE

SEQ ID NO: 2823 - protein, 7 aa, Artificial Sequence
  Description of Artificial Sequence: Synthetic peptide
HNSKDTV

SEQ ID NO: 2824 - protein, 7 aa, Artificial Sequence
  Description of Artificial Sequence: Synthetic peptide
NGTDKKQ

SEQ ID NO: 2825 - protein, 7 aa, Artificial Sequence
  Description of Artificial Sequence: Synthetic peptide
SSGGGSS

SEQ ID NO: 2826 - protein, 7 aa, Artificial Sequence
  Description of Artificial Sequence: Synthetic peptide
GNQTTAG

SEQ ID NO: 2827 - protein, 7 aa, Artificial Sequence
  Description of Artificial Sequence: Synthetic peptide
QGSTSLS

SEQ ID NO: 2828 - protein, 7 aa, Artificial Sequence
  Description of Artificial Sequence: Synthetic peptide
GHSNPSS

SEQ ID NO: 2829 - protein, 7 aa, Artificial Sequence
  Description of Artificial Sequence: Synthetic peptide
NGTGNAS

SEQ ID NO: 2830 - protein, 7 aa, Artificial Sequence
  Description of Artificial Sequence: Synthetic peptide
GSQDSKS

SEQ ID NO: 2831 - protein, 7 aa, Artificial Sequence
  Description of Artificial Sequence: Synthetic peptide
AGDTHKT

SEQ ID NO: 2832 - protein, 7 aa, Artificial Sequence
  Description of Artificial Sequence: Synthetic peptide
SNVGKQD

SEQ ID NO: 2833 - protein, 7 aa, Artificial Sequence
  Description of Artificial Sequence: Synthetic peptide
SRGEHSQ

SEQ ID NO: 2834 - protein, 7 aa, Artificial Sequence
  Description of Artificial Sequence: Synthetic peptide
ASGSGNS

SEQ ID NO: 2835 - protein, 7 aa, Artificial Sequence
  Description of Artificial Sequence: Synthetic peptide
LGSQSPS

SEQ ID NO: 2836 - protein, 7 aa, Artificial Sequence
  Description of Artificial Sequence: Synthetic peptide
TGLTSSA

SEQ ID NO: 2837 - protein, 7 aa, Artificial Sequence
  Description of Artificial Sequence: Synthetic peptide
TSSGKGD

SEQ ID NO: 2838 - protein, 7 aa, Artificial Sequence
  Description of Artificial Sequence: Synthetic peptide
ADGKPSS

SEQ ID NO: 2839 - protein, 7 aa, Artificial Sequence
  Description of Artificial Sequence: Synthetic peptide
MTGSSSS

SEQ ID NO: 2840 - protein, 7 aa, Artificial Sequence
  Description of Artificial Sequence: Synthetic peptide
SNGSKTD

SEQ ID NO: 2841 - protein, 7 aa, Artificial Sequence
  Description of Artificial Sequence: Synthetic peptide
DSSSKAL

SEQ ID NO: 2842 - protein, 7 aa, Artificial Sequence
  Description of Artificial Sequence: Synthetic peptide
RSEKVAG

SEQ ID NO: 2843 - protein, 7 aa, Artificial Sequence
  Description of Artificial Sequence: Synthetic peptide
QMERKAG

SEQ ID NO: 2844 - protein, 7 aa, Artificial Sequence
  Description of Artificial Sequence: Synthetic peptide
ESSTRPG

SEQ ID NO: 2845 - protein, 7 aa, Artificial Sequence
  Description of Artificial Sequence: Synthetic peptide
GNSPSNT

SEQ ID NO: 2846 - protein, 7 aa, Artificial Sequence
  Description of Artificial Sequence: Synthetic peptide
SLSNKSE

SEQ ID NO: 2847 - protein, 7 aa, Artificial Sequence
  Description of Artificial Sequence: Synthetic peptide
SGSTSPT

SEQ ID NO: 2848 - protein, 7 aa, Artificial Sequence
  Description of Artificial Sequence: Synthetic peptide
GMGTSGT

SEQ ID NO: 2849 - protein, 7 aa, Artificial Sequence
  Description of Artificial Sequence: Synthetic peptide
DVNSNSR

SEQ ID NO: 2850 - protein, 7 aa, Artificial Sequence
  Description of Artificial Sequence: Synthetic peptide
ATSDKAA

SEQ ID NO: 2851 - protein, 7 aa, Artificial Sequence
  Description of Artificial Sequence: Synthetic peptide
NSGSDRN

SEQ ID NO: 2852 - protein, 7 aa, Artificial Sequence
  Description of Artificial Sequence: Synthetic peptide
QGESKFT

SEQ ID NO: 2853 - protein, 7 aa, Artificial Sequence
  Description of Artificial Sequence: Synthetic peptide
SMSKEST

SEQ ID NO: 2854 - protein, 7 aa, Artificial Sequence
  Description of Artificial Sequence: Synthetic peptide
GTSSDTK

SEQ ID NO: 2855 - protein, 7 aa, Artificial Sequence
  Description of Artificial Sequence: Synthetic peptide
NPGNSSG

SEQ ID NO: 2856 - protein, 7 aa, Artificial Sequence
  Description of Artificial Sequence: Synthetic peptide
SHSSGSS

SEQ ID NO: 2857 - protein, 7 aa, Artificial Sequence
  Description of Artificial Sequence: Synthetic peptide
ESGTNSR

SEQ ID NO: 2858 - protein, 7 aa, Artificial Sequence
  Description of Artificial Sequence: Synthetic peptide
DTSHKSE

SEQ ID NO: 2859 - protein, 7 aa, Artificial Sequence
  Description of Artificial Sequence: Synthetic peptide
SGAQPGN

SEQ ID NO: 2860 - protein, 7 aa, Artificial Sequence
  Description of Artificial Sequence: Synthetic peptide
TDGQTSR

SEQ ID NO: 2861 - protein, 7 aa, Artificial Sequence
  Description of Artificial Sequence: Synthetic peptide
GHSDAPR

SEQ ID NO: 2862 - protein, 7 aa, Artificial Sequence
  Description of Artificial Sequence: Synthetic peptide
DSAGTPR

SEQ ID NO: 2863 - protein, 7 aa, Artificial Sequence
  Description of Artificial Sequence: Synthetic peptide
VGTSTSK

SEQ ID NO: 2864 - protein, 7 aa, Artificial Sequence
  Description of Artificial Sequence: Synthetic peptide
VGQGAQS

SEQ ID NO: 2865 - protein, 7 aa, Artificial Sequence
  Description of Artificial Sequence: Synthetic peptide
EGTKQGT

SEQ ID NO: 2866 - protein, 7 aa, Artificial Sequence
  Description of Artificial Sequence: Synthetic peptide
NIPSGTG

SEQ ID NO: 2867 - protein, 7 aa, Artificial Sequence
  Description of Artificial Sequence: Synthetic peptide
NPGQTIS

SEQ ID NO: 2868 - protein, 7 aa, Artificial Sequence
  Description of Artificial Sequence: Synthetic peptide
TSGTGQP

SEQ ID NO: 2869 - protein, 7 aa, Artificial Sequence
  Description of Artificial Sequence: Synthetic peptide
STNVSPG

SEQ ID NO: 2870 - protein, 7 aa, Artificial Sequence
  Description of Artificial Sequence: Synthetic peptide
SGIGHTD

SEQ ID NO: 2871 - protein, 7 aa, Artificial Sequence
  Description of Artificial Sequence: Synthetic peptide
QVGNKPG

SEQ ID NO: 2872 - protein, 7 aa, Artificial Sequence
  Description of Artificial Sequence: Synthetic peptide
EGTRTPG

SEQ ID NO: 2873 - protein, 7 aa, Artificial Sequence
  Description of Artificial Sequence: Synthetic peptide
STSSQPL

SEQ ID NO: 2874 - protein, 7 aa, Artificial Sequence
  Description of Artificial Sequence: Synthetic peptide
DSSTKSI

SEQ ID NO: 2875 - protein, 7 aa, Artificial Sequence
  Description of Artificial Sequence: Synthetic peptide
AQSSTSV

SEQ ID NO: 2876 - protein, 7 aa, Artificial Sequence
  Description of Artificial Sequence: Synthetic peptide
TGGGKDG

SEQ ID NO: 2877 - protein, 7 aa, Artificial Sequence
  Description of Artificial Sequence: Synthetic peptide
GISEKAS

SEQ ID NO: 2878 - protein, 7 aa, Artificial Sequence
  Description of Artificial Sequence: Synthetic peptide
SGNTGSS

SEQ ID NO: 2879 - protein, 7 aa, Artificial Sequence
  Description of Artificial Sequence: Synthetic peptide
EPVSAGK

SEQ ID NO: 2880 - protein, 7 aa, Artificial Sequence
  Description of Artificial Sequence: Synthetic peptide
GSSEAQK

SEQ ID NO: 2881 - protein, 7 aa, Artificial Sequence
  Description of Artificial Sequence: Synthetic peptide
GLNGGKS

SEQ ID NO: 2882 - protein, 7 aa, Artificial Sequence
  Description of Artificial Sequence: Synthetic peptide
NSSSSVA

SEQ ID NO: 2883 - protein, 7 aa, Artificial Sequence
  Description of Artificial Sequence: Synthetic peptide
NGAGQNQ

SEQ ID NO: 2884 - protein, 7 aa, Artificial Sequence
  Description of Artificial Sequence: Synthetic peptide
DGNNQKT

SEQ ID NO: 2885 - protein, 7 aa, Artificial Sequence
  Description of Artificial Sequence: Synthetic peptide
ESRPSSA

SEQ ID NO: 2886 - protein, 7 aa, Artificial Sequence
  Description of Artificial Sequence: Synthetic peptide
VQGTSST

SEQ ID NO: 2887 - protein, 7 aa, Artificial Sequence
  Description of Artificial Sequence: Synthetic peptide
GSSSPSQ

SEQ ID NO: 2888 - protein, 7 aa, Artificial Sequence
  Description of Artificial Sequence: Synthetic peptide
SNSTPSV

SEQ ID NO: 2889 - protein, 7 aa, Artificial Sequence
  Description of Artificial Sequence: Synthetic peptide
GSSDKAR

SEQ ID NO: 2890 - protein, 7 aa, Artificial Sequence
  Description of Artificial Sequence: Synthetic peptide
GKVEGNK

SEQ ID NO: 2891 - protein, 7 aa, Artificial Sequence
  Description of Artificial Sequence: Synthetic peptide
TMSTKSE

SEQ ID NO: 2892 - protein, 7 aa, Artificial Sequence
  Description of Artificial Sequence: Synthetic peptide
GVGQNPQ

SEQ ID NO: 2893 - protein, 7 aa, Artificial Sequence
  Description of Artificial Sequence: Synthetic peptide
GTVGKPM

SEQ ID NO: 2894 - protein, 7 aa, Artificial Sequence
  Description of Artificial Sequence: Synthetic peptide
QVSDKNQ

SEQ ID NO: 2895 - protein, 7 aa, Artificial Sequence
  Description of Artificial Sequence: Synthetic peptide
QGAQSSV

SEQ ID NO: 2896 - protein, 7 aa, Artificial Sequence
  Description of Artificial Sequence: Synthetic peptide
EANKVAV

SEQ ID NO: 2897 - protein, 7 aa, Artificial Sequence
  Description of Artificial Sequence: Synthetic peptide
NTKESSG

SEQ ID NO: 2898 - protein, 7 aa, Artificial Sequence
  Description of Artificial Sequence: Synthetic peptide
SGGQSVS

SEQ ID NO: 2899 - protein, 7 aa, Artificial Sequence
  Description of Artificial Sequence: Synthetic peptide
HQESRPG

SEQ ID NO: 2900 - protein, 7 aa, Artificial Sequence
  Description of Artificial Sequence: Synthetic peptide
TTSDKSI

SEQ ID NO: 2901 - protein, 7 aa, Artificial Sequence
  Description of Artificial Sequence: Synthetic peptide
TTDSKSQ

SEQ ID NO: 2902 - protein, 7 aa, Artificial Sequence
  Description of Artificial Sequence: Synthetic peptide
NAGGHAS

SEQ ID NO: 2903 - protein, 7 aa, Artificial Sequence
  Description of Artificial Sequence: Synthetic peptide
GPATNNG

SEQ ID NO: 2904 - protein, 7 aa, Artificial Sequence
  Description of Artificial Sequence: Synthetic peptide
VGKTSNV

SEQ ID NO: 2905 - protein, 7 aa, Artificial Sequence
  Description of Artificial Sequence: Synthetic peptide
SESRSVS

SEQ ID NO: 2906 - protein, 7 aa, Artificial Sequence
  Description of Artificial Sequence: Synthetic peptide
TSASKSD

SEQ ID NO: 2907 - protein, 7 aa, Artificial Sequence
  Description of Artificial Sequence: Synthetic peptide
TSSSGNM

SEQ ID NO: 2908 - protein, 7 aa, Artificial Sequence
  Description of Artificial Sequence: Synthetic peptide
MNSGSTT

SEQ ID NO: 2909 - protein, 7 aa, Artificial Sequence
  Description of Artificial Sequence: Synthetic peptide
GPTQPNN

SEQ ID NO: 2910 - protein, 7 aa, Artificial Sequence
  Description of Artificial Sequence: Synthetic peptide
TKAQGAG

SEQ ID NO: 2911 - protein, 7 aa, Artificial Sequence
  Description of Artificial Sequence: Synthetic peptide
SVNHEAG

SEQ ID NO: 2912 - protein, 7 aa, Artificial Sequence
  Description of Artificial Sequence: Synthetic peptide
TGTASIT

SEQ ID NO: 2913 - protein, 7 aa, Artificial Sequence
  Description of Artificial Sequence: Synthetic peptide
TGGTHNS

SEQ ID NO: 2914 - protein, 7 aa, Artificial Sequence
  Description of Artificial Sequence: Synthetic peptide
NQGSSSS

SEQ ID NO: 2915 - protein, 7 aa, Artificial Sequence
  Description of Artificial Sequence: Synthetic peptide
DGVSSNR

SEQ ID NO: 2916 - protein, 7 aa, Artificial Sequence
  Description of Artificial Sequence: Synthetic peptide
MTSTGST

SEQ ID NO: 2917 - protein, 7 aa, Artificial Sequence
  Description of Artificial Sequence: Synthetic peptide
GTATGNQ

SEQ ID NO: 2918 - protein, 7 aa, Artificial Sequence
  Description of Artificial Sequence: Synthetic peptide
EKSTKPN

SEQ ID NO: 2919 - protein, 7 aa, Artificial Sequence
  Description of Artificial Sequence: Synthetic peptide
GGSGEKT

SEQ ID NO: 2920 - protein, 7 aa, Artificial Sequence
  Description of Artificial Sequence: Synthetic peptide
NVQSSNV

SEQ ID NO: 2921 - protein, 7 aa, Artificial Sequence
  Description of Artificial Sequence: Synthetic peptide
GSGSHSG

SEQ ID NO: 2922 - protein, 7 aa, Artificial Sequence
  Description of Artificial Sequence: Synthetic peptide
NSGNSGK

SEQ ID NO: 2923 - protein, 7 aa, Artificial Sequence
  Description of Artificial Sequence: Synthetic peptide
SSSNGSK

SEQ ID NO: 2924 - protein, 7 aa, Artificial Sequence
  Description of Artificial Sequence: Synthetic peptide
QGASSGS

SEQ ID NO: 2925 - protein, 7 aa, Artificial Sequence
  Description of Artificial Sequence: Synthetic peptide
SGTENVR

SEQ ID NO: 2926 - protein, 7 aa, Artificial Sequence
  Description of Artificial Sequence: Synthetic peptide
GTSNGPS

SEQ ID NO: 2927 - protein, 7 aa, Artificial Sequence
  Description of Artificial Sequence: Synthetic peptide
NASPSPG

SEQ ID NO: 2928 - protein, 7 aa, Artificial Sequence
  Description of Artificial Sequence: Synthetic peptide
QGNGNQG

SEQ ID NO: 2929 - protein, 7 aa, Artificial Sequence
  Description of Artificial Sequence: Synthetic peptide
HGTNSAG

SEQ ID NO: 2930 - protein, 7 aa, Artificial Sequence
  Description of Artificial Sequence: Synthetic peptide
ATSSTSI

SEQ ID NO: 2931 - protein, 7 aa, Artificial Sequence
  Description of Artificial Sequence: Synthetic peptide
SNGSTHS

SEQ ID NO: 2932 - protein, 7 aa, Artificial Sequence
  Description of Artificial Sequence: Synthetic peptide
GNKSTPS

SEQ ID NO: 2933 - protein, 7 aa, Artificial Sequence
  Description of Artificial Sequence: Synthetic peptide
LQTSSPG

SEQ ID NO: 2934 - protein, 7 aa, Artificial Sequence
  Description of Artificial Sequence: Synthetic peptide
GPNNSGS

SEQ ID NO: 2935 - protein, 7 aa, Artificial Sequence
  Description of Artificial Sequence: Synthetic peptide
RANGANS

SEQ ID NO: 2936 - protein, 7 aa, Artificial Sequence
  Description of Artificial Sequence: Synthetic peptide
TASGERA

SEQ ID NO: 2937 - protein, 7 aa, Artificial Sequence
  Description of Artificial Sequence: Synthetic peptide
NSTSSPG

SEQ ID NO: 2938 - protein, 7 aa, Artificial Sequence
  Description of Artificial Sequence: Synthetic peptide
QGDSHKG

SEQ ID NO: 2939 - protein, 7 aa, Artificial Sequence
  Description of Artificial Sequence: Synthetic peptide
DSTAVPK

SEQ ID NO: 2940 - protein, 7 aa, Artificial Sequence
  Description of Artificial Sequence: Synthetic peptide
TSNSKTL

SEQ ID NO: 2941 - protein, 7 aa, Artificial Sequence
  Description of Artificial Sequence: Synthetic peptide
ERTENSR

SEQ ID NO: 2942 - protein, 7 aa, Artificial Sequence
  Description of Artificial Sequence: Synthetic peptide
GSQQSTG

SEQ ID NO: 2943 - protein, 7 aa, Artificial Sequence
  Description of Artificial Sequence: Synthetic peptide
HGGQSTS

SEQ ID NO: 2944 - protein, 7 aa, Artificial Sequence
  Description of Artificial Sequence: Synthetic peptide
GGGNPAR

SEQ ID NO: 2945 - protein, 7 aa, Artificial Sequence
  Description of Artificial Sequence: Synthetic peptide
SATGTNS

SEQ ID NO: 2946 - protein, 7 aa, Artificial Sequence
  Description of Artificial Sequence: Synthetic peptide
SGGQAGM

SEQ ID NO: 2947 - protein, 7 aa, Artificial Sequence
  Description of Artificial Sequence: Synthetic peptide
GNASGQA

SEQ ID NO: 2948 - protein, 7 aa, Artificial Sequence
  Description of Artificial Sequence: Synthetic peptide
NVGNNAQ

SEQ ID NO: 2949 - protein, 7 aa, Artificial Sequence
  Description of Artificial Sequence: Synthetic peptide
GVGSSSQ

SEQ ID NO: 2950 - protein, 7 aa, Artificial Sequence
  Description of Artificial Sequence: Synthetic peptide
SSGSTPS

SEQ ID NO: 2951 - protein, 7 aa, Artificial Sequence
  Description of Artificial Sequence: Synthetic peptide
NTSQSSG

SEQ ID NO: 2952 - protein, 7 aa, Artificial Sequence
  Description of Artificial Sequence: Synthetic peptide
LSGKENV

SEQ ID NO: 2953 - protein, 7 aa, Artificial Sequence
  Description of Artificial Sequence: Synthetic peptide
GGKESHA

SEQ ID NO: 2954 - protein, 7 aa, Artificial Sequence
  Description of Artificial Sequence: Synthetic peptide
MGGGSST

SEQ ID NO: 2955 - protein, 7 aa, Artificial Sequence
  Description of Artificial Sequence: Synthetic peptide
TGVTTQG

SEQ ID NO: 2956 - protein, 7 aa, Artificial Sequence
  Description of Artificial Sequence: Synthetic peptide
SGGSGTM

SEQ ID NO: 2957 - protein, 7 aa, Artificial Sequence
  Description of Artificial Sequence: Synthetic peptide
VAEKASS

SEQ ID NO: 2958 - protein, 7 aa, Artificial Sequence
  Description of Artificial Sequence: Synthetic peptide
DSAGKSS

SEQ ID NO: 2959 - protein, 7 aa, Artificial Sequence
  Description of Artificial Sequence: Synthetic peptide
STAQPTG

SEQ ID NO: 2960 - protein, 7 aa, Artificial Sequence
  Description of Artificial Sequence: Synthetic peptide
STGHGNV

SEQ ID NO: 2961 - protein, 7 aa, Artificial Sequence
  Description of Artificial Sequence: Synthetic peptide
SASQSAG

SEQ ID NO: 2962 - protein, 7 aa, Artificial Sequence
  Description of Artificial Sequence: Synthetic peptide
LTEGKAN

SEQ ID NO: 2963 - protein, 7 aa, Artificial Sequence
  Description of Artificial Sequence: Synthetic peptide
LGADKIQ

SEQ ID NO: 2964 - protein, 7 aa, Artificial Sequence
  Description of Artificial Sequence: Synthetic peptide
GAGSSST

SEQ ID NO: 2965 - protein, 7 aa, Artificial Sequence
  Description of Artificial Sequence: Synthetic peptide
EGGNKVM

SEQ ID NO: 2966 - protein, 7 aa, Artificial Sequence
  Description of Artificial Sequence: Synthetic peptide
SSQKSEG

SEQ ID NO: 2967 - protein, 7 aa, Artificial Sequence
  Description of Artificial Sequence: Synthetic peptide
ASSNGNV

SEQ ID NO: 2968 - protein, 7 aa, Artificial Sequence
  Description of Artificial Sequence: Synthetic peptide
TSNSENR

SEQ ID NO: 2969 - protein, 7 aa, Artificial Sequence
  Description of Artificial Sequence: Synthetic peptide
SGSERST

SEQ ID NO: 2970 - protein, 7 aa, Artificial Sequence
  Description of Artificial Sequence: Synthetic peptide
AQAKETN

SEQ ID NO: 2971 - protein, 7 aa, Artificial Sequence
  Description of Artificial Sequence: Synthetic peptide
LEGKASS

SEQ ID NO: 2972 - protein, 7 aa, Artificial Sequence
  Description of Artificial Sequence: Synthetic peptide
NSAGSSS

SEQ ID NO: 2973 - protein, 7 aa, Artificial Sequence
  Description of Artificial Sequence: Synthetic peptide
STASPRE

SEQ ID NO: 2974 - protein, 7 aa, Artificial Sequence
  Description of Artificial Sequence: Synthetic peptide
DGTTSKV

SEQ ID NO: 2975 - protein, 7 aa, Artificial Sequence
  Description of Artificial Sequence: Synthetic peptide
SDNKTMQ

SEQ ID NO: 2976 - protein, 7 aa, Artificial Sequence
  Description of Artificial Sequence: Synthetic peptide
HSAPVAG

SEQ ID NO: 2977 - protein, 7 aa, Artificial Sequence
  Description of Artificial Sequence: Synthetic peptide
GTGGNNT

SEQ ID NO: 2978 - protein, 7 aa, Artificial Sequence
  Description of Artificial Sequence: Synthetic peptide
QGETTRT

SEQ ID NO: 2979 - protein, 7 aa, Artificial Sequence
  Description of Artificial Sequence: Synthetic peptide
GNAPSST

SEQ ID NO: 2980 - protein, 7 aa, Artificial Sequence
  Description of Artificial Sequence: Synthetic peptide
VQGSAPG

SEQ ID NO: 2981 - protein, 7 aa, Artificial Sequence
  Description of Artificial Sequence: Synthetic peptide
LGSSKDN

SEQ ID NO: 2982 - protein, 7 aa, Artificial Sequence
  Description of Artificial Sequence: Synthetic peptide
STVDKGT

SEQ ID NO: 2983 - protein, 7 aa, Artificial Sequence
  Description of Artificial Sequence: Synthetic peptide
SSKASTV

SEQ ID NO: 2984 - protein, 7 aa, Artificial Sequence
  Description of Artificial Sequence: Synthetic peptide
DNTNKAS

SEQ ID NO: 2985 - protein, 7 aa, Artificial Sequence
  Description of Artificial Sequence: Synthetic peptide
SIGDPRS

SEQ ID NO: 2986 - protein, 7 aa, Artificial Sequence
  Description of Artificial Sequence: Synthetic peptide
EKNSTVM

SEQ ID NO: 2987 - protein, 7 aa, Artificial Sequence
  Description of Artificial Sequence: Synthetic peptide
SESQKGS

SEQ ID NO: 2988 - protein, 7 aa, Artificial Sequence
  Description of Artificial Sequence: Synthetic peptide
TKNGAQA

SEQ ID NO: 2989 - protein, 7 aa, Artificial Sequence
  Description of Artificial Sequence: Synthetic peptide
DGSPVNK

SEQ ID NO: 2990 - protein, 7 aa, Artificial Sequence
  Description of Artificial Sequence: Synthetic peptide
STTGDSK

SEQ ID NO: 2991 - protein, 7 aa, Artificial Sequence
  Description of Artificial Sequence: Synthetic peptide
SPGQTSS

SEQ ID NO: 2992 - protein, 7 aa, Artificial Sequence
  Description of Artificial Sequence: Synthetic peptide
QAGGKPG

SEQ ID NO: 2993 - protein, 7 aa, Artificial Sequence
  Description of Artificial Sequence: Synthetic peptide
GSSNTAG

SEQ ID NO: 2994 - protein, 7 aa, Artificial Sequence
  Description of Artificial Sequence: Synthetic peptide
GDIKNGA

SEQ ID NO: 2995 - protein, 7 aa, Artificial Sequence
  Description of Artificial Sequence: Synthetic peptide
SGGNTLS

SEQ ID NO: 2996 - protein, 7 aa, Artificial Sequence
  Description of Artificial Sequence: Synthetic peptide
SNGNTRN

SEQ ID NO: 2997 - protein, 7 aa, Artificial Sequence
  Description of Artificial Sequence: Synthetic peptide
ENSTSTK

SEQ ID NO: 2998 - protein, 7 aa, Artificial Sequence
  Description of Artificial Sequence: Synthetic peptide
GGATPQG

SEQ ID NO: 2999 - protein, 7 aa, Artificial Sequence
  Description of Artificial Sequence: Synthetic peptide
SPSEPIK

SEQ ID NO: 3000 - protein, 7 aa, Artificial Sequence
  Description of Artificial Sequence: Synthetic peptide
TSGSSAA

SEQ ID NO: 3001 - protein, 7 aa, Artificial Sequence
  Description of Artificial Sequence: Synthetic peptide
ESKAASS

SEQ ID NO: 3002 - protein, 7 aa, Artificial Sequence
  Description of Artificial Sequence: Synthetic peptide
ASTDKLA

SEQ ID NO: 3003 - protein, 7 aa, Artificial Sequence
  Description of Artificial Sequence: Synthetic peptide
LQDHSKG

SEQ ID NO: 3004 - protein, 7 aa, Artificial Sequence
  Description of Artificial Sequence: Synthetic peptide
SGTPSTG

SEQ ID NO: 3005 - protein, 7 aa, Artificial Sequence
  Description of Artificial Sequence: Synthetic peptide
ESGKGIL

SEQ ID NO: 3006 - protein, 7 aa, Artificial Sequence
  Description of Artificial Sequence: Synthetic peptide
IGANSSA

SEQ ID NO: 3007 - protein, 7 aa, Artificial Sequence
  Description of Artificial Sequence: Synthetic peptide
GPGSPGK

SEQ ID NO: 3008 - protein, 7 aa, Artificial Sequence
  Description of Artificial Sequence: Synthetic peptide
TTGGNGQ

SEQ ID NO: 3009 - protein, 7 aa, Artificial Sequence
  Description of Artificial Sequence: Synthetic peptide
NNSGSNS

SEQ ID NO: 3010 - protein, 7 aa, Artificial Sequence
  Description of Artificial Sequence: Synthetic peptide
YGTGSSP

SEQ ID NO: 3011 - protein, 7 aa, Artificial Sequence
  Description of Artificial Sequence: Synthetic peptide
DSGSQRG

SEQ ID NO: 3012 - protein, 7 aa, Artificial Sequence
  Description of Artificial Sequence: Synthetic peptide
TSVPGAG

SEQ ID NO: 3013 - protein, 7 aa, Artificial Sequence
  Description of Artificial Sequence: Synthetic peptide
SPSDKPV

SEQ ID NO: 3014 - protein, 7 aa, Artificial Sequence
  Description of Artificial Sequence: Synthetic peptide
TNGSNSK

SEQ ID NO: 3015 - protein, 7 aa, Artificial Sequence
  Description of Artificial Sequence: Synthetic peptide
NASGARD

SEQ ID NO: 3016 - protein, 7 aa, Artificial Sequence
  Description of Artificial Sequence: Synthetic peptide
SVGSSGS

SEQ ID NO: 3017 - protein, 7 aa, Artificial Sequence
  Description of Artificial Sequence: Synthetic peptide
QGGNNGS

SEQ ID NO: 3018 - protein, 7 aa, Artificial Sequence
  Description of Artificial Sequence: Synthetic peptide
ETSKSPV

SEQ ID NO: 3019 - protein, 7 aa, Artificial Sequence
  Description of Artificial Sequence: Synthetic peptide
GGVGSSN

SEQ ID NO: 3020 - protein, 7 aa, Artificial Sequence
  Description of Artificial Sequence: Synthetic peptide
TSGSSTA

SEQ ID NO: 3021 - protein, 7 aa, Artificial Sequence
  Description of Artificial Sequence: Synthetic peptide
TTNSTPS

SEQ ID NO: 3022 - protein, 7 aa, Artificial Sequence
  Description of Artificial Sequence: Synthetic peptide
NTDKHAG

SEQ ID NO: 3023 - protein, 7 aa, Artificial Sequence
  Description of Artificial Sequence: Synthetic peptide
GTGAGSN

SEQ ID NO: 3024 - protein, 7 aa, Artificial Sequence
  Description of Artificial Sequence: Synthetic peptide
QGSPAAS

SEQ ID NO: 3025 - protein, 7 aa, Artificial Sequence
  Description of Artificial Sequence: Synthetic peptide
ESSNRGS

SEQ ID NO: 3026 - protein, 7 aa, Artificial Sequence
  Description of Artificial Sequence: Synthetic peptide
GGKATQG

SEQ ID NO: 3027 - protein, 7 aa, Artificial Sequence
  Description of Artificial Sequence: Synthetic peptide
NTIPKPG

SEQ ID NO: 3028 - protein, 7 aa, Artificial Sequence
  Description of Artificial Sequence: Synthetic peptide
SGSERAS

SEQ ID NO: 3029 - protein, 7 aa, Artificial Sequence
  Description of Artificial Sequence: Synthetic peptide
SNSKDSS

SEQ ID NO: 3030 - protein, 7 aa, Artificial Sequence
  Description of Artificial Sequence: Synthetic peptide
SGVSTHN

SEQ ID NO: 3031 - protein, 7 aa, Artificial Sequence
  Description of Artificial Sequence: Synthetic peptide
HSGTGST

SEQ ID NO: 3032 - protein, 7 aa, Artificial Sequence
  Description of Artificial Sequence: Synthetic peptide
ESGKATT

SEQ ID NO: 3033 - protein, 7 aa, Artificial Sequence
  Description of Artificial Sequence: Synthetic peptide
GHTEGKT

SEQ ID NO: 3034 - protein, 7 aa, Artificial Sequence
  Description of Artificial Sequence: Synthetic peptide
GSSSGGT

SEQ ID NO: 3035 - protein, 7 aa, Artificial Sequence
  Description of Artificial Sequence: Synthetic peptide
TSPNPST

SEQ ID NO: 3036 - protein, 7 aa, Artificial Sequence
  Description of Artificial Sequence: Synthetic peptide
TAGGSSQ

SEQ ID NO: 3037 - protein, 7 aa, Artificial Sequence
  Description of Artificial Sequence: Synthetic peptide
NGNASSG

SEQ ID NO: 3038 - protein, 7 aa, Artificial Sequence
  Description of Artificial Sequence: Synthetic peptide
GSGTPTH

SEQ ID NO: 3039 - protein, 7 aa, Artificial Sequence
  Description of Artificial Sequence: Synthetic peptide
SQGTDGK

SEQ ID NO: 3040 - protein, 7 aa, Artificial Sequence
  Description of Artificial Sequence: Synthetic peptide
SGQPGNT

SEQ ID NO: 3041 - protein, 7 aa, Artificial Sequence
  Description of Artificial Sequence: Synthetic peptide
GAVNNKS

SEQ ID NO: 3042 - protein, 7 aa, Artificial Sequence
  Description of Artificial Sequence: Synthetic peptide
SSSHSAS

SEQ ID NO: 3043 - protein, 7 aa, Artificial Sequence
  Description of Artificial Sequence: Synthetic peptide
NNATATS

SEQ ID NO: 3044 - protein, 7 aa, Artificial Sequence
  Description of Artificial Sequence: Synthetic peptide
SSNEKLA

SEQ ID NO: 3045 - protein, 7 aa, Artificial Sequence
  Description of Artificial Sequence: Synthetic peptide
GHSVKAE

SEQ ID NO: 3046 - protein, 7 aa, Artificial Sequence
  Description of Artificial Sequence: Synthetic peptide
STGANPI

SEQ ID NO: 3047 - protein, 7 aa, Artificial Sequence
  Description of Artificial Sequence: Synthetic peptide
SDQQKGA

SEQ ID NO: 3048 - protein, 7 aa, Artificial Sequence
  Description of Artificial Sequence: Synthetic peptide
TGTSQPT

SEQ ID NO: 3049 - protein, 7 aa, Artificial Sequence
  Description of Artificial Sequence: Synthetic peptide
GVSATPT

SEQ ID NO: 3050 - protein, 7 aa, Artificial Sequence
  Description of Artificial Sequence: Synthetic peptide
QGSNTAT

SEQ ID NO: 3051 - protein, 7 aa, Artificial Sequence
  Description of Artificial Sequence: Synthetic peptide
NSAGATT

SEQ ID NO: 3052 - protein, 7 aa, Artificial Sequence
  Description of Artificial Sequence: Synthetic peptide
SSGEGMR

SEQ ID NO: 3053 - protein, 7 aa, Artificial Sequence
  Description of Artificial Sequence: Synthetic peptide
RQTPAAG

SEQ ID NO: 3054 - protein, 7 aa, Artificial Sequence
  Description of Artificial Sequence: Synthetic peptide
SGGTAAI

SEQ ID NO: 3055 - protein, 7 aa, Artificial Sequence
  Description of Artificial Sequence: Synthetic peptide
LTGQNNQ

SEQ ID NO: 3056 - protein, 7 aa, Artificial Sequence
  Description of Artificial Sequence: Synthetic peptide
LQSVSPG

SEQ ID NO: 3057 - protein, 7 aa, Artificial Sequence
  Description of Artificial Sequence: Synthetic peptide
AGQQASQ

SEQ ID NO: 3058 - protein, 7 aa, Artificial Sequence
  Description of Artificial Sequence: Synthetic peptide
GRNTSNA

SEQ ID NO: 3059 - protein, 7 aa, Artificial Sequence
  Description of Artificial Sequence: Synthetic peptide
NDASKGN

SEQ ID NO: 3060 - protein, 7 aa, Artificial Sequence
  Description of Artificial Sequence: Synthetic peptide
TGTGSPA

SEQ ID NO: 3061 - protein, 7 aa, Artificial Sequence
  Description of Artificial Sequence: Synthetic peptide
GLNSSAK

SEQ ID NO: 3062 - protein, 7 aa, Artificial Sequence
  Description of Artificial Sequence: Synthetic peptide
GVTSSPH

SEQ ID NO: 3063 - protein, 7 aa, Artificial Sequence
  Description of Artificial Sequence: Synthetic peptide
GQGTGLS

SEQ ID NO: 3064 - protein, 7 aa, Artificial Sequence
  Description of Artificial Sequence: Synthetic peptide
GTTKTSE

SEQ ID NO: 3065 - protein, 7 aa, Artificial Sequence
  Description of Artificial Sequence: Synthetic peptide
DSLKGNG

SEQ ID NO: 3066 - protein, 7 aa, Artificial Sequence
  Description of Artificial Sequence: Synthetic peptide
GMTNSGG

SEQ ID NO: 3067 - protein, 7 aa, Artificial Sequence
  Description of Artificial Sequence: Synthetic peptide
SATKVNE

SEQ ID NO: 3068 - protein, 7 aa, Artificial Sequence
  Description of Artificial Sequence: Synthetic peptide
GSDKAAP

SEQ ID NO: 3069 - protein, 7 aa, Artificial Sequence
  Description of Artificial Sequence: Synthetic peptide
NGGPQST

SEQ ID NO: 3070 - protein, 7 aa, Artificial Sequence
  Description of Artificial Sequence: Synthetic peptide
GNGKDGN

SEQ ID NO: 3071 - protein, 7 aa, Artificial Sequence
  Description of Artificial Sequence: Synthetic peptide
GQATSAK

SEQ ID NO: 3072 - protein, 7 aa, Artificial Sequence
  Description of Artificial Sequence: Synthetic peptide
GNPTGGS

SEQ ID NO: 3073 - protein, 7 aa, Artificial Sequence
  Description of Artificial Sequence: Synthetic peptide
DNTKSNQ

SEQ ID NO: 3074 - protein, 7 aa, Artificial Sequence
  Description of Artificial Sequence: Synthetic peptide
DAVSSPK

SEQ ID NO: 3075 - protein, 7 aa, Artificial Sequence
  Description of Artificial Sequence: Synthetic peptide
SKTERSV

SEQ ID NO: 3076 - protein, 7 aa, Artificial Sequence
  Description of Artificial Sequence: Synthetic peptide
NGSGASS

SEQ ID NO: 3077 - protein, 7 aa, Artificial Sequence
  Description of Artificial Sequence: Synthetic peptide
GTASGSG

SEQ ID NO: 3078 - protein, 7 aa, Artificial Sequence
  Description of Artificial Sequence: Synthetic peptide
SSGTSTV

SEQ ID NO: 3079 - protein, 7 aa, Artificial Sequence
  Description of Artificial Sequence: Synthetic peptide
NSSGPPG

SEQ ID NO: 3080 - protein, 7 aa, Artificial Sequence
  Description of Artificial Sequence: Synthetic peptide
LKSQSTG

SEQ ID NO: 3081 - protein, 7 aa, Artificial Sequence
  Description of Artificial Sequence: Synthetic peptide
LGQTGQL

SEQ ID NO: 3082 - protein, 7 aa, Artificial Sequence
  Description of Artificial Sequence: Synthetic peptide
ESNSRPG

SEQ ID NO: 3083 - protein, 7 aa, Artificial Sequence
  Description of Artificial Sequence: Synthetic peptide
TTSGQHG

SEQ ID NO: 3084 - protein, 7 aa, Artificial Sequence
  Description of Artificial Sequence: Synthetic peptide
QGSQKVS

SEQ ID NO: 3085 - protein, 7 aa, Artificial Sequence
  Description of Artificial Sequence: Synthetic peptide
SASDLKS

SEQ ID NO: 3086 - protein, 7 aa, Artificial Sequence
  Description of Artificial Sequence: Synthetic peptide
STGGSSQ

SEQ ID NO: 3087 - protein, 7 aa, Artificial Sequence
  Description of Artificial Sequence: Synthetic peptide
SAGPSSA

SEQ ID NO: 3088 - protein, 7 aa, Artificial Sequence
  Description of Artificial Sequence: Synthetic peptide
SGGTSSV

SEQ ID NO: 3089 - protein, 7 aa, Artificial Sequence
  Description of Artificial Sequence: Synthetic peptide
GSGHKGE

SEQ ID NO: 3090 - protein, 7 aa, Artificial Sequence
  Description of Artificial Sequence: Synthetic peptide
TGTTHTT

SEQ ID NO: 3091 - protein, 7 aa, Artificial Sequence
  Description of Artificial Sequence: Synthetic peptide
IATKGNV

SEQ ID NO: 3092 - protein, 7 aa, Artificial Sequence
  Description of Artificial Sequence: Synthetic peptide
LQSPRTG

SEQ ID NO: 3093 - protein, 7 aa, Artificial Sequence
  Description of Artificial Sequence: Synthetic peptide
AGQNSSV

SEQ ID NO: 3094 - protein, 7 aa, Artificial Sequence
  Description of Artificial Sequence: Synthetic peptide
VPSHAAG

SEQ ID NO: 3095 - protein, 7 aa, Artificial Sequence
  Description of Artificial Sequence: Synthetic peptide
QASSGAS

SEQ ID NO: 3096 - protein, 7 aa, Artificial Sequence
  Description of Artificial Sequence: Synthetic peptide
SSSNKDA

SEQ ID NO: 3097 - protein, 7 aa, Artificial Sequence
  Description of Artificial Sequence: Synthetic peptide
QGGSGSS

SEQ ID NO: 3098 - protein, 7 aa, Artificial Sequence
  Description of Artificial Sequence: Synthetic peptide
GPASQSG

SEQ ID NO: 3099 - protein, 7 aa, Artificial Sequence
  Description of Artificial Sequence: Synthetic peptide
NPGSTTA

SEQ ID NO: 3100 - protein, 7 aa, Artificial Sequence
  Description of Artificial Sequence: Synthetic peptide
MNSNSNS

SEQ ID NO: 3101 - protein, 7 aa, Artificial Sequence
  Description of Artificial Sequence: Synthetic peptide
GSDKAKQ

SEQ ID NO: 3102 - protein, 7 aa, Artificial Sequence
  Description of Artificial Sequence: Synthetic peptide
TGSSSVS

SEQ ID NO: 3103 - protein, 7 aa, Artificial Sequence
  Description of Artificial Sequence: Synthetic peptide
DRATPSV

SEQ ID NO: 3104 - protein, 7 aa, Artificial Sequence
  Description of Artificial Sequence: Synthetic peptide
SAGSPGN

SEQ ID NO: 3105 - protein, 7 aa, Artificial Sequence
  Description of Artificial Sequence: Synthetic peptide
SQTSSPQ

SEQ ID NO: 3106 - protein, 7 aa, Artificial Sequence
  Description of Artificial Sequence: Synthetic peptide
SAEGKMM

SEQ ID NO: 3107 - protein, 7 aa, Artificial Sequence
  Description of Artificial Sequence: Synthetic peptide
GPKSSPA

SEQ ID NO: 3108 - protein, 7 aa, Artificial Sequence
  Description of Artificial Sequence: Synthetic peptide
QSPGQTS

SEQ ID NO: 3109 - protein, 7 aa, Artificial Sequence
  Description of Artificial Sequence: Synthetic peptide
VQGAGSS

SEQ ID NO: 3110 - protein, 7 aa, Artificial Sequence
  Description of Artificial Sequence: Synthetic peptide
GQGTSDG

SEQ ID NO: 3111 - protein, 7 aa, Artificial Sequence
  Description of Artificial Sequence: Synthetic peptide
TREGSSG

SEQ ID NO: 3112 - protein, 7 aa, Artificial Sequence
  Description of Artificial Sequence: Synthetic peptide
QNSGTNN

SEQ ID NO: 3113 - protein, 7 aa, Artificial Sequence
  Description of Artificial Sequence: Synthetic peptide
NGGTGSR

SEQ ID NO: 3114 - protein, 7 aa, Artificial Sequence
  Description of Artificial Sequence: Synthetic peptide
NQGSSSV

SEQ ID NO: 3115 - protein, 7 aa, Artificial Sequence
  Description of Artificial Sequence: Synthetic peptide
NGAGQKQ

SEQ ID NO: 3116 - protein, 7 aa, Artificial Sequence
  Description of Artificial Sequence: Synthetic peptide
LSDKKPN

SEQ ID NO: 3117 - protein, 7 aa, Artificial Sequence
  Description of Artificial Sequence: Synthetic peptide
NGVKSQT

SEQ ID NO: 3118 - protein, 7 aa, Artificial Sequence
  Description of Artificial Sequence: Synthetic peptide
VQGGSST

SEQ ID NO: 3119 - protein, 7 aa, Artificial Sequence
  Description of Artificial Sequence: Synthetic peptide
SSGAGSL

SEQ ID NO: 3120 - protein, 7 aa, Artificial Sequence
  Description of Artificial Sequence: Synthetic peptide
SSEHKGS

SEQ ID NO: 3121 - protein, 7 aa, Artificial Sequence
  Description of Artificial Sequence: Synthetic peptide
SSTKQPG

SEQ ID NO: 3122 - protein, 7 aa, Artificial Sequence
  Description of Artificial Sequence: Synthetic peptide
SGQGSSV

SEQ ID NO: 3123 - protein, 7 aa, Artificial Sequence
  Description of Artificial Sequence: Synthetic peptide
MGETHAG

SEQ ID NO: 3124 - protein, 7 aa, Artificial Sequence
  Description of Artificial Sequence: Synthetic peptide
STASDKA

SEQ ID NO: 3125 - protein, 7 aa, Artificial Sequence
  Description of Artificial Sequence: Synthetic peptide
THANPAG

SEQ ID NO: 3126 - protein, 7 aa, Artificial Sequence
  Description of Artificial Sequence: Synthetic peptide
TSSQQSG

SEQ ID NO: 3127 - protein, 7 aa, Artificial Sequence
  Description of Artificial Sequence: Synthetic peptide
SDQQTTK

SEQ ID NO: 3128 - protein, 7 aa, Artificial Sequence
  Description of Artificial Sequence: Synthetic peptide
ESTTRPG

SEQ ID NO: 3129 - protein, 7 aa, Artificial Sequence
  Description of Artificial Sequence: Synthetic peptide
ASYKGAG

SEQ ID NO: 3130 - protein, 7 aa, Artificial Sequence
  Description of Artificial Sequence: Synthetic peptide
GQHAQAG

SEQ ID NO: 3131 - protein, 7 aa, Artificial Sequence
  Description of Artificial Sequence: Synthetic peptide
GSGAPSN

SEQ ID NO: 3132 - protein, 7 aa, Artificial Sequence
  Description of Artificial Sequence: Synthetic peptide
DPKPGST

SEQ ID NO: 3133 - protein, 7 aa, Artificial Sequence
  Description of Artificial Sequence: Synthetic peptide
GGDAKSV

SEQ ID NO: 3134 - protein, 7 aa, Artificial Sequence
  Description of Artificial Sequence: Synthetic peptide
GDQKASN

SEQ ID NO: 3135 - protein, 7 aa, Artificial Sequence
  Description of Artificial Sequence: Synthetic peptide
YRDSASH

SEQ ID NO: 3136 - protein, 7 aa, Artificial Sequence
  Description of Artificial Sequence: Synthetic peptide
GSGRDAV

SEQ ID NO: 3137 - protein, 7 aa, Artificial Sequence
  Description of Artificial Sequence: Synthetic peptide
SNGSQGS

SEQ ID NO: 3138 - protein, 7 aa, Artificial Sequence
  Description of Artificial Sequence: Synthetic peptide
SPGSSSG

SEQ ID NO: 3139 - protein, 7 aa, Artificial Sequence
  Description of Artificial Sequence: Synthetic peptide
DGHKTLV

SEQ ID NO: 3140 - protein, 7 aa, Artificial Sequence
  Description of Artificial Sequence: Synthetic peptide
VGTSQAT

SEQ ID NO: 3141 - protein, 7 aa, Artificial Sequence
  Description of Artificial Sequence: Synthetic peptide
ATGSGSN

SEQ ID NO: 3142 - protein, 7 aa, Artificial Sequence
  Description of Artificial Sequence: Synthetic peptide
NATPTNQ

SEQ ID NO: 3143 - protein, 7 aa, Artificial Sequence
  Description of Artificial Sequence: Synthetic peptide
NTTAPTV

SEQ ID NO: 3144 - protein, 7 aa, Artificial Sequence
  Description of Artificial Sequence: Synthetic peptide
AAPASAG

SEQ ID NO: 3145 - protein, 7 aa, Artificial Sequence
  Description of Artificial Sequence: Synthetic peptide
ASQPASA

SEQ ID NO: 3146 - protein, 7 aa, Artificial Sequence
  Description of Artificial Sequence: Synthetic peptide
QGSSSVV

SEQ ID NO: 3147 - protein, 7 aa, Artificial Sequence
  Description of Artificial Sequence: Synthetic peptide
SQHKEQP

SEQ ID NO: 3148 - protein, 7 aa, Artificial Sequence
  Description of Artificial Sequence: Synthetic peptide
TGTTEKH

SEQ ID NO: 3149 - protein, 7 aa, Artificial Sequence
  Description of Artificial Sequence: Synthetic peptide
VNKSPVT

SEQ ID NO: 3150 - protein, 7 aa, Artificial Sequence
  Description of Artificial Sequence: Synthetic peptide
KGGSNSV

SEQ ID NO: 3151 - protein, 7 aa, Artificial Sequence
  Description of Artificial Sequence: Synthetic peptide
SGTSTSH

SEQ ID NO: 3152 - protein, 7 aa, Artificial Sequence
  Description of Artificial Sequence: Synthetic peptide
SSVGEQK

SEQ ID NO: 3153 - protein, 7 aa, Artificial Sequence
  Description of Artificial Sequence: Synthetic peptide
DNSSKAV

SEQ ID NO: 3154 - protein, 7 aa, Artificial Sequence
  Description of Artificial Sequence: Synthetic peptide
SGGTSAG

SEQ ID NO: 3155 - protein, 7 aa, Artificial Sequence
  Description of Artificial Sequence: Synthetic peptide
ANSEKSP

SEQ ID NO: 3156 - protein, 7 aa, Artificial Sequence
  Description of Artificial Sequence: Synthetic peptide
TKNGSQA

SEQ ID NO: 3157 - protein, 7 aa, Artificial Sequence
  Description of Artificial Sequence: Synthetic peptide
DTTKTSG

SEQ ID NO: 3158 - protein, 7 aa, Artificial Sequence
  Description of Artificial Sequence: Synthetic peptide
SSGASSS

SEQ ID NO: 3159 - protein, 7 aa, Artificial Sequence
  Description of Artificial Sequence: Synthetic peptide
DKSPNSG

SEQ ID NO: 3160 - protein, 7 aa, Artificial Sequence
  Description of Artificial Sequence: Synthetic peptide
DGTKKNA

SEQ ID NO: 3161 - protein, 7 aa, Artificial Sequence
  Description of Artificial Sequence: Synthetic peptide
HGNSSQG

SEQ ID NO: 3162 - protein, 7 aa, Artificial Sequence
  Description of Artificial Sequence: Synthetic peptide
SSNSGTQ

SEQ ID NO: 3163 - protein, 7 aa, Artificial Sequence
  Description of Artificial Sequence: Synthetic peptide
GAGDRSG

SEQ ID NO: 3164 - protein, 7 aa, Artificial Sequence
  Description of Artificial Sequence: Synthetic peptide
KSNTSAA

SEQ ID NO: 3165 - protein, 7 aa, Artificial Sequence
  Description of Artificial Sequence: Synthetic peptide
ESDGKSH

SEQ ID NO: 3166 - protein, 7 aa, Artificial Sequence
  Description of Artificial Sequence: Synthetic peptide
DASSKGL

SEQ ID NO: 3167 - protein, 7 aa, Artificial Sequence
  Description of Artificial Sequence: Synthetic peptide
QSGDKSH

SEQ ID NO: 3168 - protein, 7 aa, Artificial Sequence
  Description of Artificial Sequence: Synthetic peptide
LTGASTS

SEQ ID NO: 3169 - protein, 7 aa, Artificial Sequence
  Description of Artificial Sequence: Synthetic peptide
DGSSSPG

SEQ ID NO: 3170 - protein, 7 aa, Artificial Sequence
  Description of Artificial Sequence: Synthetic peptide
TTTSTPV

SEQ ID NO: 3171 - protein, 7 aa, Artificial Sequence
  Description of Artificial Sequence: Synthetic peptide
DISKSNI

SEQ ID NO: 3172 - protein, 7 aa, Artificial Sequence
  Description of Artificial Sequence: Synthetic peptide
GGSPSNQ

SEQ ID NO: 3173 - protein, 7 aa, Artificial Sequence
  Description of Artificial Sequence: Synthetic peptide
SSGEGNK

SEQ ID NO: 3174 - protein, 7 aa, Artificial Sequence
  Description of Artificial Sequence: Synthetic peptide
GSTGSQG

SEQ ID NO: 3175 - protein, 7 aa, Artificial Sequence
  Description of Artificial Sequence: Synthetic peptide
SESSKSV

SEQ ID NO: 3176 - protein, 7 aa, Artificial Sequence
  Description of Artificial Sequence: Synthetic peptide
DNGTSSR

SEQ ID NO: 3177 - protein, 7 aa, Artificial Sequence
  Description of Artificial Sequence: Synthetic peptide
GLKESNR

SEQ ID NO: 3178 - protein, 7 aa, Artificial Sequence
  Description of Artificial Sequence: Synthetic peptide
TNGSSTS

SEQ ID NO: 3179 - protein, 7 aa, Artificial Sequence
  Description of Artificial Sequence: Synthetic peptide
VDQGGSK

SEQ ID NO: 3180 - protein, 7 aa, Artificial Sequence
  Description of Artificial Sequence: Synthetic peptide
QTEKGRE

SEQ ID NO: 3181 - protein, 7 aa, Artificial Sequence
  Description of Artificial Sequence: Synthetic peptide
GSNPNGT

SEQ ID NO: 3182 - protein, 7 aa, Artificial Sequence
  Description of Artificial Sequence: Synthetic peptide
DGASPSK

SEQ ID NO: 3183 - protein, 7 aa, Artificial Sequence
  Description of Artificial Sequence: Synthetic peptide
NGSTSSS

SEQ ID NO: 3184 - protein, 7 aa, Artificial Sequence
  Description of Artificial Sequence: Synthetic peptide
ENNKSTA

SEQ ID NO: 3185 - protein, 7 aa, Artificial Sequence
  Description of Artificial Sequence: Synthetic peptide
ASGSNPH

SEQ ID NO: 3186 - protein, 7 aa, Artificial Sequence
  Description of Artificial Sequence: Synthetic peptide
DPVAKGT

SEQ ID NO: 3187 - protein, 7 aa, Artificial Sequence
  Description of Artificial Sequence: Synthetic peptide
QGVPSGT

SEQ ID NO: 3188 - protein, 7 aa, Artificial Sequence
  Description of Artificial Sequence: Synthetic peptide
NTGNSGG

SEQ ID NO: 3189 - protein, 7 aa, Artificial Sequence
  Description of Artificial Sequence: Synthetic peptide
QGGGSST

SEQ ID NO: 3190 - protein, 7 aa, Artificial Sequence
  Description of Artificial Sequence: Synthetic peptide
HGVPSSG

SEQ ID NO: 3191 - protein, 7 aa, Artificial Sequence
  Description of Artificial Sequence: Synthetic peptide
EAHASVK

SEQ ID NO: 3192 - protein, 7 aa, Artificial Sequence
  Description of Artificial Sequence: Synthetic peptide
SGNGKDM

SEQ ID NO: 3193 - protein, 7 aa, Artificial Sequence
  Description of Artificial Sequence: Synthetic peptide
NGSNNPT

SEQ ID NO: 3194 - protein, 7 aa, Artificial Sequence
  Description of Artificial Sequence: Synthetic peptide
NVMPDSK

SEQ ID NO: 3195 - protein, 7 aa, Artificial Sequence
  Description of Artificial Sequence: Synthetic peptide
VGDSSSR

SEQ ID NO: 3196 - protein, 7 aa, Artificial Sequence
  Description of Artificial Sequence: Synthetic peptide
SSGSSSV

SEQ ID NO: 3197 - protein, 7 aa, Artificial Sequence
  Description of Artificial Sequence: Synthetic peptide
ATSNDTK

SEQ ID NO: 3198 - protein, 7 aa, Artificial Sequence
  Description of Artificial Sequence: Synthetic peptide
QNGKGNA

SEQ ID NO: 3199 - protein, 7 aa, Artificial Sequence
  Description of Artificial Sequence: Synthetic peptide
APSSENK

SEQ ID NO: 3200 - protein, 7 aa, Artificial Sequence
  Description of Artificial Sequence: Synthetic peptide
NSSQSPS

SEQ ID NO: 3201 - protein, 7 aa, Artificial Sequence
  Description of Artificial Sequence: Synthetic peptide
DNGSNNR

SEQ ID NO: 3202 - protein, 7 aa, Artificial Sequence
  Description of Artificial Sequence: Synthetic peptide
SGASGAG

SEQ ID NO: 3203 - protein, 7 aa, Artificial Sequence
  Description of Artificial Sequence: Synthetic peptide
DPLANKH

SEQ ID NO: 3204 - protein, 7 aa, Artificial Sequence
  Description of Artificial Sequence: Synthetic peptide
SGSSNNV

SEQ ID NO: 3205 - protein, 7 aa, Artificial Sequence
  Description of Artificial Sequence: Synthetic peptide
GHQTGSG

SEQ ID NO: 3206 - protein, 7 aa, Artificial Sequence
  Description of Artificial Sequence: Synthetic peptide
DGKSSVS

SEQ ID NO: 3207 - protein, 7 aa, Artificial Sequence
  Description of Artificial Sequence: Synthetic peptide
QGSDRPV

SEQ ID NO: 3208 - protein, 7 aa, Artificial Sequence
  Description of Artificial Sequence: Synthetic peptide
VSSQKAG

SEQ ID NO: 3209 - protein, 7 aa, Artificial Sequence
  Description of Artificial Sequence: Synthetic peptide
DSTTKTG

SEQ ID NO: 3210 - protein, 7 aa, Artificial Sequence
  Description of Artificial Sequence: Synthetic peptide
GQTGAPV

SEQ ID NO: 3211 - protein, 7 aa, Artificial Sequence
  Description of Artificial Sequence: Synthetic peptide
STAVTTG

SEQ ID NO: 3212 - protein, 7 aa, Artificial Sequence
  Description of Artificial Sequence: Synthetic peptide
QANNSPT

SEQ ID NO: 3213 - protein, 7 aa, Artificial Sequence
  Description of Artificial Sequence: Synthetic peptide
MGNGASN

SEQ ID NO: 3214 - protein, 7 aa, Artificial Sequence
  Description of Artificial Sequence: Synthetic peptide
MNNKENH

SEQ ID NO: 3215 - protein, 7 aa, Artificial Sequence
  Description of Artificial Sequence: Synthetic peptide
TGNKSNE

SEQ ID NO: 3216 - protein, 7 aa, Artificial Sequence
  Description of Artificial Sequence: Synthetic peptide
DLSTKSR

SEQ ID NO: 3217 - protein, 7 aa, Artificial Sequence
  Description of Artificial Sequence: Synthetic peptide
TPSQDRH

SEQ ID NO: 3218 - protein, 7 aa, Artificial Sequence
  Description of Artificial Sequence: Synthetic peptide
AQEKSSR

SEQ ID NO: 3219 - protein, 7 aa, Artificial Sequence
  Description of Artificial Sequence: Synthetic peptide
EPSKSNT

SEQ ID NO: 3220 - protein, 7 aa, Artificial Sequence
  Description of Artificial Sequence: Synthetic peptide
TDGTKSQ

SEQ ID NO: 3221 - protein, 7 aa, Artificial Sequence
  Description of Artificial Sequence: Synthetic peptide
GHEKGNN

SEQ ID NO: 3222 - protein, 7 aa, Artificial Sequence
  Description of Artificial Sequence: Synthetic peptide
TSGAGSL

SEQ ID NO: 3223 - protein, 7 aa, Artificial Sequence
  Description of Artificial Sequence: Synthetic peptide
EGSKQGA

SEQ ID NO: 3224 - protein, 7 aa, Artificial Sequence
  Description of Artificial Sequence: Synthetic peptide
QPDNKGG

SEQ ID NO: 3225 - protein, 7 aa, Artificial Sequence
  Description of Artificial Sequence: Synthetic peptide
ERQGSTL

SEQ ID NO: 3226 - protein, 7 aa, Artificial Sequence
  Description of Artificial Sequence: Synthetic peptide
EGSTGSR

SEQ ID NO: 3227 - protein, 7 aa, Artificial Sequence
  Description of Artificial Sequence: Synthetic peptide
EGGTSTS

SEQ ID NO: 3228 - protein, 7 aa, Artificial Sequence
  Description of Artificial Sequence: Synthetic peptide
GGESNRL

SEQ ID NO: 3229 - protein, 7 aa, Artificial Sequence
  Description of Artificial Sequence: Synthetic peptide
GLAGNAK

SEQ ID NO: 3230 - protein, 7 aa, Artificial Sequence
  Description of Artificial Sequence: Synthetic peptide
STGHVNG

SEQ ID NO: 3231 - protein, 7 aa, Artificial Sequence
  Description of Artificial Sequence: Synthetic peptide
SLNAGAG

SEQ ID NO: 3232 - protein, 7 aa, Artificial Sequence
  Description of Artificial Sequence: Synthetic peptide
ASNQSTQ

SEQ ID NO: 3233 - protein, 7 aa, Artificial Sequence
  Description of Artificial Sequence: Synthetic peptide
DSHSKTN

SEQ ID NO: 3234 - protein, 7 aa, Artificial Sequence
  Description of Artificial Sequence: Synthetic peptide
QDGTKTS

SEQ ID NO: 3235 - protein, 7 aa, Artificial Sequence
  Description of Artificial Sequence: Synthetic peptide
DQSKQGS

SEQ ID NO: 3236 - protein, 7 aa, Artificial Sequence
  Description of Artificial Sequence: Synthetic peptide
VGSTTPT

SEQ ID NO: 3237 - protein, 7 aa, Artificial Sequence
  Description of Artificial Sequence: Synthetic peptide
TPGGSQA

SEQ ID NO: 3238 - protein, 7 aa, Artificial Sequence
  Description of Artificial Sequence: Synthetic peptide
SGGTASA

SEQ ID NO: 3239 - protein, 7 aa, Artificial Sequence
  Description of Artificial Sequence: Synthetic peptide
NGLDKSQ

SEQ ID NO: 3240 - protein, 7 aa, Artificial Sequence
  Description of Artificial Sequence: Synthetic peptide
AGGGSNT

SEQ ID NO: 3241 - protein, 7 aa, Artificial Sequence
  Description of Artificial Sequence: Synthetic peptide
VKGAASS

SEQ ID NO: 3242 - protein, 7 aa, Artificial Sequence
  Description of Artificial Sequence: Synthetic peptide
DQTDRNQ

SEQ ID NO: 3243 - protein, 7 aa, Artificial Sequence
  Description of Artificial Sequence: Synthetic peptide
SLSQSSK

SEQ ID NO: 3244 - protein, 7 aa, Artificial Sequence
  Description of Artificial Sequence: Synthetic peptide
MGNERAN

SEQ ID NO: 3245 - protein, 7 aa, Artificial Sequence
  Description of Artificial Sequence: Synthetic peptide
QSGADKS

SEQ ID NO: 3246 - protein, 7 aa, Artificial Sequence
  Description of Artificial Sequence: Synthetic peptide
HGGPTSI

SEQ ID NO: 3247 - protein, 7 aa, Artificial Sequence
  Description of Artificial Sequence: Synthetic peptide
DGNSANH

SEQ ID NO: 3248 - protein, 7 aa, Artificial Sequence
  Description of Artificial Sequence: Synthetic peptide
DSNSKLT

SEQ ID NO: 3249 - protein, 7 aa, Artificial Sequence
  Description of Artificial Sequence: Synthetic peptide
DTPQSQK

SEQ ID NO: 3250 - protein, 7 aa, Artificial Sequence
  Description of Artificial Sequence: Synthetic peptide
GAETDKR

SEQ ID NO: 3251 - protein, 7 aa, Artificial Sequence
  Description of Artificial Sequence: Synthetic peptide
QSAASNH

SEQ ID NO: 3252 - protein, 7 aa, Artificial Sequence
  Description of Artificial Sequence: Synthetic peptide
STKATNE

SEQ ID NO: 3253 - protein, 7 aa, Artificial Sequence
  Description of Artificial Sequence: Synthetic peptide
GQSTAPN

SEQ ID NO: 3254 - protein, 7 aa, Artificial Sequence
  Description of Artificial Sequence: Synthetic peptide
RTGNVSS

SEQ ID NO: 3255 - protein, 7 aa, Artificial Sequence
  Description of Artificial Sequence: Synthetic peptide
DGKSGAG

SEQ ID NO: 3256 - protein, 7 aa, Artificial Sequence
  Description of Artificial Sequence: Synthetic peptide
EQAKVNV

SEQ ID NO: 3257 - protein, 7 aa, Artificial Sequence
  Description of Artificial Sequence: Synthetic peptide
DNRSSNS

SEQ ID NO: 3258 - protein, 7 aa, Artificial Sequence
  Description of Artificial Sequence: Synthetic peptide
NTGSGTS

SEQ ID NO: 3259 - protein, 7 aa, Artificial Sequence
  Description of Artificial Sequence: Synthetic peptide
QQESHKL

SEQ ID NO: 3260 - protein, 7 aa, Artificial Sequence
  Description of Artificial Sequence: Synthetic peptide
DSTKTTS

SEQ ID NO: 3261 - protein, 7 aa, Artificial Sequence
  Description of Artificial Sequence: Synthetic peptide
APVSPVK

SEQ ID NO: 3262 - protein, 7 aa, Artificial Sequence
  Description of Artificial Sequence: Synthetic peptide
TSGVSPA

SEQ ID NO: 3263 - protein, 7 aa, Artificial Sequence
  Description of Artificial Sequence: Synthetic peptide
GSDKLHS

SEQ ID NO: 3264 - protein, 7 aa, Artificial Sequence
  Description of Artificial Sequence: Synthetic peptide
DQLSKSQ

SEQ ID NO: 3265 - protein, 7 aa, Artificial Sequence
  Description of Artificial Sequence: Synthetic peptide
SHSDKTS

SEQ ID NO: 3266 - protein, 7 aa, Artificial Sequence
  Description of Artificial Sequence: Synthetic peptide
SVESKST

SEQ ID NO: 3267 - protein, 7 aa, Artificial Sequence
  Description of Artificial Sequence: Synthetic peptide
ATSGTQA

SEQ ID NO: 3268 - protein, 7 aa, Artificial Sequence
  Description of Artificial Sequence: Synthetic peptide
VNTSATQ

SEQ ID NO: 3269 - protein, 7 aa, Artificial Sequence
  Description of Artificial Sequence: Synthetic peptide
GNAGGQN

SEQ ID NO: 3270 - protein, 7 aa, Artificial Sequence
  Description of Artificial Sequence: Synthetic peptide
SDGKGSL

SEQ ID NO: 3271 - protein, 7 aa, Artificial Sequence
  Description of Artificial Sequence: Synthetic peptide
TGNENNR

SEQ ID NO: 3272 - protein, 7 aa, Artificial Sequence
  Description of Artificial Sequence: Synthetic peptide
AANERSS

SEQ ID NO: 3273 - protein, 7 aa, Artificial Sequence
  Description of Artificial Sequence: Synthetic peptide
MPSTKEG

SEQ ID NO: 3274 - protein, 7 aa, Artificial Sequence
  Description of Artificial Sequence: Synthetic peptide
QQGSSGS

SEQ ID NO: 3275 - protein, 7 aa, Artificial Sequence
  Description of Artificial Sequence: Synthetic peptide
SLNSPKN

SEQ ID NO: 3276 - protein, 7 aa, Artificial Sequence
  Description of Artificial Sequence: Synthetic peptide
QTGTGGA

SEQ ID NO: 3277 - protein, 7 aa, Artificial Sequence
  Description of Artificial Sequence: Synthetic peptide
SGGSSAS

SEQ ID NO: 3278 - protein, 7 aa, Artificial Sequence
  Description of Artificial Sequence: Synthetic peptide
GSDTKVL

SEQ ID NO: 3279 - protein, 7 aa, Artificial Sequence
  Description of Artificial Sequence: Synthetic peptide
GTAASNS

SEQ ID NO: 3280 - protein, 7 aa, Artificial Sequence
  Description of Artificial Sequence: Synthetic peptide
EGTSHTK

SEQ ID NO: 3281 - protein, 7 aa, Artificial Sequence
  Description of Artificial Sequence: Synthetic peptide
GTSSTPL

SEQ ID NO: 3282 - protein, 7 aa, Artificial Sequence
  Description of Artificial Sequence: Synthetic peptide
GTGRDQN

SEQ ID NO: 3283 - protein, 7 aa, Artificial Sequence
  Description of Artificial Sequence: Synthetic peptide
DVSASNR

SEQ ID NO: 3284 - protein, 7 aa, Artificial Sequence
  Description of Artificial Sequence: Synthetic peptide
NEARTPQ

SEQ ID NO: 3285 - protein, 7 aa, Artificial Sequence
  Description of Artificial Sequence: Synthetic peptide
AQVKAGA

SEQ ID NO: 3286 - protein, 7 aa, Artificial Sequence
  Description of Artificial Sequence: Synthetic peptide
TQGAAAS

SEQ ID NO: 3287 - protein, 7 aa, Artificial Sequence
  Description of Artificial Sequence: Synthetic peptide
DVTGGKG

SEQ ID NO: 3288 - protein, 7 aa, Artificial Sequence
  Description of Artificial Sequence: Synthetic peptide
GNIDGKK

SEQ ID NO: 3289 - protein, 7 aa, Artificial Sequence
  Description of Artificial Sequence: Synthetic peptide
HNGAPSS

SEQ ID NO: 3290 - protein, 7 aa, Artificial Sequence
  Description of Artificial Sequence: Synthetic peptide
MHDAKSG

SEQ ID NO: 3291 - protein, 7 aa, Artificial Sequence
  Description of Artificial Sequence: Synthetic peptide
DGAGASH

SEQ ID NO: 3292 - protein, 7 aa, Artificial Sequence
  Description of Artificial Sequence: Synthetic peptide
VTDAKSS

SEQ ID NO: 3293 - protein, 7 aa, Artificial Sequence
  Description of Artificial Sequence: Synthetic peptide
ESQRAGG

SEQ ID NO: 3294 - protein, 7 aa, Artificial Sequence
  Description of Artificial Sequence: Synthetic peptide
ESNNGGK

SEQ ID NO: 3295 - protein, 7 aa, Artificial Sequence
  Description of Artificial Sequence: Synthetic peptide
DAGTKAM

SEQ ID NO: 3296 - protein, 7 aa, Artificial Sequence
  Description of Artificial Sequence: Synthetic peptide
GEGQSNR

SEQ ID NO: 3297 - protein, 7 aa, Artificial Sequence
  Description of Artificial Sequence: Synthetic peptide
SPGTSQG

SEQ ID NO: 3298 - protein, 7 aa, Artificial Sequence
  Description of Artificial Sequence: Synthetic peptide
SGNSSLS

SEQ ID NO: 3299 - protein, 7 aa, Artificial Sequence
  Description of Artificial Sequence: Synthetic peptide
SRTTDTT

SEQ ID NO: 3300 - protein, 7 aa, Artificial Sequence
  Description of Artificial Sequence: Synthetic peptide
EGKSAAL

SEQ ID NO: 3301 - protein, 7 aa, Artificial Sequence
  Description of Artificial Sequence: Synthetic peptide
GGAANSG

SEQ ID NO: 3302 - protein, 7 aa, Artificial Sequence
  Description of Artificial Sequence: Synthetic peptide
SREGSNV

SEQ ID NO: 3303 - protein, 7 aa, Artificial Sequence
  Description of Artificial Sequence: Synthetic peptide
GSTSQPA

SEQ ID NO: 3304 - protein, 7 aa, Artificial Sequence
  Description of Artificial Sequence: Synthetic peptide
NSETKAS

SEQ ID NO: 3305 - protein, 7 aa, Artificial Sequence
  Description of Artificial Sequence: Synthetic peptide
SKTQTSI

SEQ ID NO: 3306 - protein, 7 aa, Artificial Sequence
  Description of Artificial Sequence: Synthetic peptide
LNGKTNS

SEQ ID NO: 3307 - protein, 7 aa, Artificial Sequence
  Description of Artificial Sequence: Synthetic peptide
NVGKDRA

SEQ ID NO: 3308 - protein, 7 aa, Artificial Sequence
  Description of Artificial Sequence: Synthetic peptide
NTVGQNT

SEQ ID NO: 3309 - protein, 7 aa, Artificial Sequence
  Description of Artificial Sequence: Synthetic peptide
QASQSAK

SEQ ID NO: 3310 - protein, 7 aa, Artificial Sequence
  Description of Artificial Sequence: Synthetic peptide
EHNSESK

SEQ ID NO: 3311 - protein, 7 aa, Artificial Sequence
  Description of Artificial Sequence: Synthetic peptide
NTNSPSA

SEQ ID NO: 3312 - protein, 7 aa, Artificial Sequence
  Description of Artificial Sequence: Synthetic peptide
NSGPPTG

SEQ ID NO: 3313 - protein, 7 aa, Artificial Sequence
  Description of Artificial Sequence: Synthetic peptide
NGKASPG

SEQ ID NO: 3314 - protein, 7 aa, Artificial Sequence
  Description of Artificial Sequence: Synthetic peptide
NGSAKPS

SEQ ID NO: 3315 - protein, 7 aa, Artificial Sequence
  Description of Artificial Sequence: Synthetic peptide
TGHGSVA

SEQ ID NO: 3316 - protein, 7 aa, Artificial Sequence
  Description of Artificial Sequence: Synthetic peptide
TRDSSTT

SEQ ID NO: 3317 - protein, 7 aa, Artificial Sequence
  Description of Artificial Sequence: Synthetic peptide
SRDAGHH

SEQ ID NO: 3318 - protein, 7 aa, Artificial Sequence
  Description of Artificial Sequence: Synthetic peptide
SGKNEAG

SEQ ID NO: 3319 - protein, 7 aa, Artificial Sequence
  Description of Artificial Sequence: Synthetic peptide
ISDKAPG

SEQ ID NO: 3320 - protein, 7 aa, Artificial Sequence
  Description of Artificial Sequence: Synthetic peptide
QTGGSGS

SEQ ID NO: 3321 - protein, 7 aa, Artificial Sequence
  Description of Artificial Sequence: Synthetic peptide
QGGSSSQ

SEQ ID NO: 3322 - protein, 7 aa, Artificial Sequence
  Description of Artificial Sequence: Synthetic peptide
ESSNKGG

SEQ ID NO: 3323 - protein, 7 aa, Artificial Sequence
  Description of Artificial Sequence: Synthetic peptide
EASERPG

SEQ ID NO: 3324 - protein, 7 aa, Artificial Sequence
  Description of Artificial Sequence: Synthetic peptide
DSKVSTQ

SEQ ID NO: 3325 - protein, 7 aa, Artificial Sequence
  Description of Artificial Sequence: Synthetic peptide
GTGNTPL

SEQ ID NO: 3326 - protein, 7 aa, Artificial Sequence
  Description of Artificial Sequence: Synthetic peptide
GSPATTG

SEQ ID NO: 3327 - protein, 7 aa, Artificial Sequence
  Description of Artificial Sequence: Synthetic peptide
GITPPGQ

SEQ ID NO: 3328 - protein, 7 aa, Artificial Sequence
  Description of Artificial Sequence: Synthetic peptide
VHGDKTG

SEQ ID NO: 3329 - protein, 7 aa, Artificial Sequence
  Description of Artificial Sequence: Synthetic peptide
VGTPTSV

SEQ ID NO: 3330 - protein, 7 aa, Artificial Sequence
  Description of Artificial Sequence: Synthetic peptide
SSTTTSS

SEQ ID NO: 3331 - protein, 7 aa, Artificial Sequence
  Description of Artificial Sequence: Synthetic peptide
QGTGNDR

SEQ ID NO: 3332 - protein, 7 aa, Artificial Sequence
  Description of Artificial Sequence: Synthetic peptide
GIKESKQ

SEQ ID NO: 3333 - protein, 7 aa, Artificial Sequence
  Description of Artificial Sequence: Synthetic peptide
SPTTKNV

SEQ ID NO: 3334 - protein, 7 aa, Artificial Sequence
  Description of Artificial Sequence: Synthetic peptide
TGSNAPA

SEQ ID NO: 3335 - protein, 7 aa, Artificial Sequence
  Description of Artificial Sequence: Synthetic peptide
NSSGTPT

SEQ ID NO: 3336 - protein, 7 aa, Artificial Sequence
  Description of Artificial Sequence: Synthetic peptide
VNNSGSH

SEQ ID NO: 3337 - protein, 7 aa, Artificial Sequence
  Description of Artificial Sequence: Synthetic peptide
SVHATPT

SEQ ID NO: 3338 - protein, 7 aa, Artificial Sequence
  Description of Artificial Sequence: Synthetic peptide
GGANPGT

SEQ ID NO: 3339 - protein, 7 aa, Artificial Sequence
  Description of Artificial Sequence: Synthetic peptide
QRADHSS

SEQ ID NO: 3340 - protein, 7 aa, Artificial Sequence
  Description of Artificial Sequence: Synthetic peptide
ENQSPNK

SEQ ID NO: 3341 - protein, 7 aa, Artificial Sequence
  Description of Artificial Sequence: Synthetic peptide
STGNSNA

SEQ ID NO: 3342 - protein, 7 aa, Artificial Sequence
  Description of Artificial Sequence: Synthetic peptide
NAGANSI

SEQ ID NO: 3343 - protein, 7 aa, Artificial Sequence
  Description of Artificial Sequence: Synthetic peptide
GALTDQK

SEQ ID NO: 3344 - protein, 7 aa, Artificial Sequence
  Description of Artificial Sequence: Synthetic peptide
SSASQPS

SEQ ID NO: 3345 - protein, 7 aa, Artificial Sequence
  Description of Artificial Sequence: Synthetic peptide
NGSTPSQ

SEQ ID NO: 3346 - protein, 7 aa, Artificial Sequence
  Description of Artificial Sequence: Synthetic peptide
STISAGK

SEQ ID NO: 3347 - protein, 7 aa, Artificial Sequence
  Description of Artificial Sequence: Synthetic peptide
LPNPGSG

SEQ ID NO: 3348 - protein, 7 aa, Artificial Sequence
  Description of Artificial Sequence: Synthetic peptide
HTGTSNS

SEQ ID NO: 3349 - protein, 7 aa, Artificial Sequence
  Description of Artificial Sequence: Synthetic peptide
GSGSKVV

SEQ ID NO: 3350 - protein, 7 aa, Artificial Sequence
  Description of Artificial Sequence: Synthetic peptide
TKDSSPQ

SEQ ID NO: 3351 - protein, 7 aa, Artificial Sequence
  Description of Artificial Sequence: Synthetic peptide
GNSDRSS

SEQ ID NO: 3352 - protein, 7 aa, Artificial Sequence
  Description of Artificial Sequence: Synthetic peptide
QSGDSIK

SEQ ID NO: 3353 - protein, 7 aa, Artificial Sequence
  Description of Artificial Sequence: Synthetic peptide
TSANAAT

SEQ ID NO: 3354 - protein, 7 aa, Artificial Sequence
  Description of Artificial Sequence: Synthetic peptide
QGDKTLV

SEQ ID NO: 3355 - protein, 7 aa, Artificial Sequence
  Description of Artificial Sequence: Synthetic peptide
GMSDKPI

SEQ ID NO: 3356 - protein, 7 aa, Artificial Sequence
  Description of Artificial Sequence: Synthetic peptide
GPNTDVK

SEQ ID NO: 3357 - protein, 7 aa, Artificial Sequence
  Description of Artificial Sequence: Synthetic peptide
TSDSSKG

SEQ ID NO: 3358 - protein, 7 aa, Artificial Sequence
  Description of Artificial Sequence: Synthetic peptide
LSGNKDA

SEQ ID NO: 3359 - protein, 7 aa, Artificial Sequence
  Description of Artificial Sequence: Synthetic peptide
LGAGQAL

SEQ ID NO: 3360 - protein, 7 aa, Artificial Sequence
  Description of Artificial Sequence: Synthetic peptide
SQLERSA

SEQ ID NO: 3361 - protein, 7 aa, Artificial Sequence
  Description of Artificial Sequence: Synthetic peptide
HNDTKAT

SEQ ID NO: 3362 - protein, 7 aa, Artificial Sequence
  Description of Artificial Sequence: Synthetic peptide
TGETHKA

SEQ ID NO: 3363 - protein, 7 aa, Artificial Sequence
  Description of Artificial Sequence: Synthetic peptide
GAEKNNG

SEQ ID NO: 3364 - protein, 7 aa, Artificial Sequence
  Description of Artificial Sequence: Synthetic peptide
GTGKDSL

SEQ ID NO: 3365 - protein, 7 aa, Artificial Sequence
  Description of Artificial Sequence: Synthetic peptide
KTGTGTE

SEQ ID NO: 3366 - protein, 7 aa, Artificial Sequence
  Description of Artificial Sequence: Synthetic peptide
GGANSPS

SEQ ID NO: 3367 - protein, 7 aa, Artificial Sequence
  Description of Artificial Sequence: Synthetic peptide
DSTDKRT

SEQ ID NO: 3368 - protein, 7 aa, Artificial Sequence
  Description of Artificial Sequence: Synthetic peptide
ISDKQSV

SEQ ID NO: 3369 - protein, 7 aa, Artificial Sequence
  Description of Artificial Sequence: Synthetic peptide
ELTGTKA

SEQ ID NO: 3370 - protein, 7 aa, Artificial Sequence
  Description of Artificial Sequence: Synthetic peptide
GAQDKRE

SEQ ID NO: 3371 - protein, 7 aa, Artificial Sequence
  Description of Artificial Sequence: Synthetic peptide
ETHKASN

SEQ ID NO: 3372 - protein, 7 aa, Artificial Sequence
  Description of Artificial Sequence: Synthetic peptide
QGTDQHA

SEQ ID NO: 3373 - protein, 7 aa, Artificial Sequence
  Description of Artificial Sequence: Synthetic peptide
SGTNNNV

SEQ ID NO: 3374 - protein, 7 aa, Artificial Sequence
  Description of Artificial Sequence: Synthetic peptide
NLGAQHS

SEQ ID NO: 3375 - protein, 7 aa, Artificial Sequence
  Description of Artificial Sequence: Synthetic peptide
DGKAPSL

SEQ ID NO: 3376 - protein, 7 aa, Artificial Sequence
  Description of Artificial Sequence: Synthetic peptide
VAGTKSE

SEQ ID NO: 3377 - protein, 7 aa, Artificial Sequence
  Description of Artificial Sequence: Synthetic peptide
SPSNVSK

SEQ ID NO: 3378 - protein, 7 aa, Artificial Sequence
  Description of Artificial Sequence: Synthetic peptide
SATGNGG

SEQ ID NO: 3379 - protein, 7 aa, Artificial Sequence
  Description of Artificial Sequence: Synthetic peptide
SGGAGPA

SEQ ID NO: 3380 - protein, 7 aa, Artificial Sequence
  Description of Artificial Sequence: Synthetic peptide
NGGQSKT

SEQ ID NO: 3381 - protein, 7 aa, Artificial Sequence
  Description of Artificial Sequence: Synthetic peptide
VQGSNPN

SEQ ID NO: 3382 - protein, 7 aa, Artificial Sequence
  Description of Artificial Sequence: Synthetic peptide
QGSQAQV

SEQ ID NO: 3383 - protein, 7 aa, Artificial Sequence
  Description of Artificial Sequence: Synthetic peptide
SGNSQMN

SEQ ID NO: 3384 - protein, 7 aa, Artificial Sequence
  Description of Artificial Sequence: Synthetic peptide
DQSSKAV

SEQ ID NO: 3385 - protein, 7 aa, Artificial Sequence
  Description of Artificial Sequence: Synthetic peptide
RTGNTSV

SEQ ID NO: 3386 - protein, 7 aa, Artificial Sequence
  Description of Artificial Sequence: Synthetic peptide
ARSESTG

SEQ ID NO: 3387 - protein, 7 aa, Artificial Sequence
  Description of Artificial Sequence: Synthetic peptide
ASSKENR

SEQ ID NO: 3388 - protein, 7 aa, Artificial Sequence
  Description of Artificial Sequence: Synthetic peptide
SNQNAKA

SEQ ID NO: 3389 - protein, 7 aa, Artificial Sequence
  Description of Artificial Sequence: Synthetic peptide
LSGSTSN

SEQ ID NO: 3390 - protein, 7 aa, Artificial Sequence
  Description of Artificial Sequence: Synthetic peptide
GTNTNSG

SEQ ID NO: 3391 - protein, 7 aa, Artificial Sequence
  Description of Artificial Sequence: Synthetic peptide
GTGGSSS

SEQ ID NO: 3392 - protein, 7 aa, Artificial Sequence
  Description of Artificial Sequence: Synthetic peptide
ESGGKPG

SEQ ID NO: 3393 - protein, 7 aa, Artificial Sequence
  Description of Artificial Sequence: Synthetic peptide
ATGASNN

SEQ ID NO: 3394 - protein, 7 aa, Artificial Sequence
  Description of Artificial Sequence: Synthetic peptide
SGVSGTN

SEQ ID NO: 3395 - protein, 7 aa, Artificial Sequence
  Description of Artificial Sequence: Synthetic peptide
GSNTPLA

SEQ ID NO: 3396 - protein, 7 aa, Artificial Sequence
  Description of Artificial Sequence: Synthetic peptide
SGSKSLL

SEQ ID NO: 3397 - protein, 7 aa, Artificial Sequence
  Description of Artificial Sequence: Synthetic peptide
QGSSSAV

SEQ ID NO: 3398 - protein, 7 aa, Artificial Sequence
  Description of Artificial Sequence: Synthetic peptide
NSKANNV

SEQ ID NO: 3399 - protein, 7 aa, Artificial Sequence
  Description of Artificial Sequence: Synthetic peptide
LSAKSNG

SEQ ID NO: 3400 - protein, 7 aa, Artificial Sequence
  Description of Artificial Sequence: Synthetic peptide
SGKDTSG

SEQ ID NO: 3401 - protein, 7 aa, Artificial Sequence
  Description of Artificial Sequence: Synthetic peptide
MTGSNHA

SEQ ID NO: 3402 - protein, 7 aa, Artificial Sequence
  Description of Artificial Sequence: Synthetic peptide
SNSQVNS

SEQ ID NO: 3403 - protein, 7 aa, Artificial Sequence
  Description of Artificial Sequence: Synthetic peptide
SGLASTG

SEQ ID NO: 3404 - protein, 7 aa, Artificial Sequence
  Description of Artificial Sequence: Synthetic peptide
TNSSNNV

SEQ ID NO: 3405 - protein, 7 aa, Artificial Sequence
  Description of Artificial Sequence: Synthetic peptide
GTTQDRS

SEQ ID NO: 3406 - protein, 7 aa, Artificial Sequence
  Description of Artificial Sequence: Synthetic peptide
GVSGNKD

SEQ ID NO: 3407 - protein, 7 aa, Artificial Sequence
  Description of Artificial Sequence: Synthetic peptide
TQASTPT

SEQ ID NO: 3408 - protein, 7 aa, Artificial Sequence
  Description of Artificial Sequence: Synthetic peptide
SGSGSTR

SEQ ID NO: 3409 - protein, 7 aa, Artificial Sequence
  Description of Artificial Sequence: Synthetic peptide
DAGQAPK

SEQ ID NO: 3410 - protein, 7 aa, Artificial Sequence
  Description of Artificial Sequence: Synthetic peptide
SDQQPTK

SEQ ID NO: 3411 - protein, 7 aa, Artificial Sequence
  Description of Artificial Sequence: Synthetic peptide
SSTTHPS

SEQ ID NO: 3412 - protein, 7 aa, Artificial Sequence
  Description of Artificial Sequence: Synthetic peptide
SGSGTSN

SEQ ID NO: 3413 - protein, 7 aa, Artificial Sequence
  Description of Artificial Sequence: Synthetic peptide
ATKTTNG

SEQ ID NO: 3414 - protein, 7 aa, Artificial Sequence
  Description of Artificial Sequence: Synthetic peptide
NGSAQGR

SEQ ID NO: 3415 - protein, 7 aa, Artificial Sequence
  Description of Artificial Sequence: Synthetic peptide
LTTSKAE

SEQ ID NO: 3416 - protein, 7 aa, Artificial Sequence
  Description of Artificial Sequence: Synthetic peptide
DGVTPNH

SEQ ID NO: 3417 - protein, 7 aa, Artificial Sequence
  Description of Artificial Sequence: Synthetic peptide
NGAKADS

SEQ ID NO: 3418 - protein, 7 aa, Artificial Sequence
  Description of Artificial Sequence: Synthetic peptide
TRTDSTG

SEQ ID NO: 3419 - protein, 7 aa, Artificial Sequence
  Description of Artificial Sequence: Synthetic peptide
STQQSPG

SEQ ID NO: 3420 - protein, 7 aa, Artificial Sequence
  Description of Artificial Sequence: Synthetic peptide
QGTATQS

SEQ ID NO: 3421 - protein, 7 aa, Artificial Sequence
  Description of Artificial Sequence: Synthetic peptide
SSQTSGK

SEQ ID NO: 3422 - protein, 7 aa, Artificial Sequence
  Description of Artificial Sequence: Synthetic peptide
TGVGKGL

SEQ ID NO: 3423 - protein, 7 aa, Artificial Sequence
  Description of Artificial Sequence: Synthetic peptide
NGGNAST

SEQ ID NO: 3424 - protein, 7 aa, Artificial Sequence
  Description of Artificial Sequence: Synthetic peptide
TDQSKVS

SEQ ID NO: 3425 - protein, 7 aa, Artificial Sequence
  Description of Artificial Sequence: Synthetic peptide
ASSKAVV

SEQ ID NO: 3426 - protein, 7 aa, Artificial Sequence
  Description of Artificial Sequence: Synthetic peptide
SSSSTPN

SEQ ID NO: 3427 - protein, 7 aa, Artificial Sequence
  Description of Artificial Sequence: Synthetic peptide
ANTKDTA

SEQ ID NO: 3428 - protein, 7 aa, Artificial Sequence
  Description of Artificial Sequence: Synthetic peptide
GNTGGTS

SEQ ID NO: 3429 - protein, 7 aa, Artificial Sequence
  Description of Artificial Sequence: Synthetic peptide
SGSGEAK

SEQ ID NO: 3430 - protein, 7 aa, Artificial Sequence
  Description of Artificial Sequence: Synthetic peptide
VSTKSAV

SEQ ID NO: 3431 - protein, 7 aa, Artificial Sequence
  Description of Artificial Sequence: Synthetic peptide
QPGNQTS

SEQ ID NO: 3432 - protein, 7 aa, Artificial Sequence
  Description of Artificial Sequence: Synthetic peptide
STTTSSG

SEQ ID NO: 3433 - protein, 7 aa, Artificial Sequence
  Description of Artificial Sequence: Synthetic peptide
STVTGGS

SEQ ID NO: 3434 - protein, 7 aa, Artificial Sequence
  Description of Artificial Sequence: Synthetic peptide
MPSNNST

SEQ ID NO: 3435 - protein, 7 aa, Artificial Sequence
  Description of Artificial Sequence: Synthetic peptide
TSGAPSA

SEQ ID NO: 3436 - protein, 7 aa, Artificial Sequence
  Description of Artificial Sequence: Synthetic peptide
GNQTSPI

SEQ ID NO: 3437 - protein, 7 aa, Artificial Sequence
  Description of Artificial Sequence: Synthetic peptide
ETKSTPN

SEQ ID NO: 3438 - protein, 7 aa, Artificial Sequence
  Description of Artificial Sequence: Synthetic peptide
NPGRNTG

SEQ ID NO: 3439 - protein, 7 aa, Artificial Sequence
  Description of Artificial Sequence: Synthetic peptide
QQTAQTG

SEQ ID NO: 3440 - protein, 7 aa, Artificial Sequence
  Description of Artificial Sequence: Synthetic peptide
AREINPG

SEQ ID NO: 3441 - protein, 7 aa, Artificial Sequence
  Description of Artificial Sequence: Synthetic peptide
AGQKDST

SEQ ID NO: 3442 - protein, 7 aa, Artificial Sequence
  Description of Artificial Sequence: Synthetic peptide
SSNKGSP

SEQ ID NO: 3443 - protein, 7 aa, Artificial Sequence
  Description of Artificial Sequence: Synthetic peptide
TSTNQPV

SEQ ID NO: 3444 - protein, 7 aa, Artificial Sequence
  Description of Artificial Sequence: Synthetic peptide
SVAGDRS

SEQ ID NO: 3445 - protein, 7 aa, Artificial Sequence
  Description of Artificial Sequence: Synthetic peptide
TDSTRST

SEQ ID NO: 3446 - protein, 7 aa, Artificial Sequence
  Description of Artificial Sequence: Synthetic peptide
SGSTSPN

SEQ ID NO: 3447 - protein, 7 aa, Artificial Sequence
  Description of Artificial Sequence: Synthetic peptide
GSGSSNT

SEQ ID NO: 3448 - protein, 7 aa, Artificial Sequence
  Description of Artificial Sequence: Synthetic peptide
GSTQSSA

SEQ ID NO: 3449 - protein, 7 aa, Artificial Sequence
  Description of Artificial Sequence: Synthetic peptide
NDQSKPL

SEQ ID NO: 3450 - protein, 7 aa, Artificial Sequence
  Description of Artificial Sequence: Synthetic peptide
ESRSRNE

SEQ ID NO: 3451 - protein, 7 aa, Artificial Sequence
  Description of Artificial Sequence: Synthetic peptide
DATTRPP

SEQ ID NO: 3452 - protein, 7 aa, Artificial Sequence
  Description of Artificial Sequence: Synthetic peptide
SSTNKTV

SEQ ID NO: 3453 - protein, 7 aa, Artificial Sequence
  Description of Artificial Sequence: Synthetic peptide
AGSAKDK

SEQ ID NO: 3454 - protein, 7 aa, Artificial Sequence
  Description of Artificial Sequence: Synthetic peptide
DIGKTHA

SEQ ID NO: 3455 - protein, 7 aa, Artificial Sequence
  Description of Artificial Sequence: Synthetic peptide
QVNSTPV

SEQ ID NO: 3456 - protein, 7 aa, Artificial Sequence
  Description of Artificial Sequence: Synthetic peptide
SGASSVT

SEQ ID NO: 3457 - protein, 7 aa, Artificial Sequence
  Description of Artificial Sequence: Synthetic peptide
DSGRSPN

SEQ ID NO: 3458 - protein, 7 aa, Artificial Sequence
  Description of Artificial Sequence: Synthetic peptide
SNDSKST

SEQ ID NO: 3459 - protein, 7 aa, Artificial Sequence
  Description of Artificial Sequence: Synthetic peptide
SNVKQMP

SEQ ID NO: 3460 - protein, 7 aa, Artificial Sequence
  Description of Artificial Sequence: Synthetic peptide
DGGTHVK

SEQ ID NO: 3461 - protein, 7 aa, Artificial Sequence
  Description of Artificial Sequence: Synthetic peptide
LSDGKPN

SEQ ID NO: 3462 - protein, 7 aa, Artificial Sequence
  Description of Artificial Sequence: Synthetic peptide
DAHKVNL

SEQ ID NO: 3463 - protein, 7 aa, Artificial Sequence
  Description of Artificial Sequence: Synthetic peptide
DSAAKAA

SEQ ID NO: 3464 - protein, 7 aa, Artificial Sequence
  Description of Artificial Sequence: Synthetic peptide
TGTQTNS

SEQ ID NO: 3465 - protein, 7 aa, Artificial Sequence
  Description of Artificial Sequence: Synthetic peptide
NGGGAQA

SEQ ID NO: 3466 - protein, 7 aa, Artificial Sequence
  Description of Artificial Sequence: Synthetic peptide
GATSKSV

SEQ ID NO: 3467 - protein, 7 aa, Artificial Sequence
  Description of Artificial Sequence: Synthetic peptide
QASDPKL

SEQ ID NO: 3468 - protein, 7 aa, Artificial Sequence
  Description of Artificial Sequence: Synthetic peptide
NGKSQVS

SEQ ID NO: 3469 - protein, 7 aa, Artificial Sequence
  Description of Artificial Sequence: Synthetic peptide
SASGTGQ

SEQ ID NO: 3470 - protein, 7 aa, Artificial Sequence
  Description of Artificial Sequence: Synthetic peptide
GASKSNG

SEQ ID NO: 3471 - protein, 7 aa, Artificial Sequence
  Description of Artificial Sequence: Synthetic peptide
VGEAKKA

SEQ ID NO: 3472 - protein, 7 aa, Artificial Sequence
  Description of Artificial Sequence: Synthetic peptide
ITGSTAA

SEQ ID NO: 3473 - protein, 7 aa, Artificial Sequence
  Description of Artificial Sequence: Synthetic peptide
TSSDRPT

SEQ ID NO: 3474 - protein, 7 aa, Artificial Sequence
  Description of Artificial Sequence: Synthetic peptide
AAGQGRS

SEQ ID NO: 3475 - protein, 7 aa, Artificial Sequence
  Description of Artificial Sequence: Synthetic peptide
HTQASPT

SEQ ID NO: 3476 - protein, 7 aa, Artificial Sequence
  Description of Artificial Sequence: Synthetic peptide
GSSTERV

SEQ ID NO: 3477 - protein, 7 aa, Artificial Sequence
  Description of Artificial Sequence: Synthetic peptide
TGDKAIA

SEQ ID NO: 3478 - protein, 7 aa, Artificial Sequence
  Description of Artificial Sequence: Synthetic peptide
GKTTGQY

SEQ ID NO: 3479 - protein, 7 aa, Artificial Sequence
  Description of Artificial Sequence: Synthetic peptide
SSTKTSL

SEQ ID NO: 3480 - protein, 7 aa, Artificial Sequence
  Description of Artificial Sequence: Synthetic peptide
EGASAGK

SEQ ID NO: 3481 - protein, 7 aa, Artificial Sequence
  Description of Artificial Sequence: Synthetic peptide
QTNTPHS

SEQ ID NO: 3482 - protein, 7 aa, Artificial Sequence
  Description of Artificial Sequence: Synthetic peptide
DSGSRSV

SEQ ID NO: 3483 - protein, 7 aa, Artificial Sequence
  Description of Artificial Sequence: Synthetic peptide
TPMDKKE

SEQ ID NO: 3484 - protein, 7 aa, Artificial Sequence
  Description of Artificial Sequence: Synthetic peptide
SRNNSSE

SEQ ID NO: 3485 - protein, 7 aa, Artificial Sequence
  Description of Artificial Sequence: Synthetic peptide
SGTNHTT

SEQ ID NO: 3486 - protein, 7 aa, Artificial Sequence
  Description of Artificial Sequence: Synthetic peptide
HGSNSSQ

SEQ ID NO: 3487 - protein, 7 aa, Artificial Sequence
  Description of Artificial Sequence: Synthetic peptide
GGEKVHS

SEQ ID NO: 3488 - protein, 7 aa, Artificial Sequence
  Description of Artificial Sequence: Synthetic peptide
LVNKSSL

SEQ ID NO: 3489 - protein, 7 aa, Artificial Sequence
  Description of Artificial Sequence: Synthetic peptide
DSPNSTK

SEQ ID NO: 3490 - protein, 7 aa, Artificial Sequence
  Description of Artificial Sequence: Synthetic peptide
TNSSSVQ

SEQ ID NO: 3491 - protein, 7 aa, Artificial Sequence
  Description of Artificial Sequence: Synthetic peptide
GADRGGS

SEQ ID NO: 3492 - protein, 7 aa, Artificial Sequence
  Description of Artificial Sequence: Synthetic peptide
RGNGSTY

SEQ ID NO: 3493 - protein, 7 aa, Artificial Sequence
  Description of Artificial Sequence: Synthetic peptide
NTGSQAQ

SEQ ID NO: 3494 - protein, 7 aa, Artificial Sequence
  Description of Artificial Sequence: Synthetic peptide
TIGGSPS

SEQ ID NO: 3495 - protein, 7 aa, Artificial Sequence
  Description of Artificial Sequence: Synthetic peptide
VQNKQMG

SEQ ID NO: 3496 - protein, 7 aa, Artificial Sequence
  Description of Artificial Sequence: Synthetic peptide
RGTSERS

SEQ ID NO: 3497 - protein, 7 aa, Artificial Sequence
  Description of Artificial Sequence: Synthetic peptide
QGAPSIQ

SEQ ID NO: 3498 - protein, 7 aa, Artificial Sequence
  Description of Artificial Sequence: Synthetic peptide
LGGSQSN

SEQ ID NO: 3499 - protein, 7 aa, Artificial Sequence
  Description of Artificial Sequence: Synthetic peptide
SGTPAAT

SEQ ID NO: 3500 - protein, 7 aa, Artificial Sequence
  Description of Artificial Sequence: Synthetic peptide
ATGSESR

SEQ ID NO: 3501 - protein, 7 aa, Artificial Sequence
  Description of Artificial Sequence: Synthetic peptide
LGSQNNS

SEQ ID NO: 3502 - protein, 7 aa, Artificial Sequence
  Description of Artificial Sequence: Synthetic peptide
NVGSTHT

SEQ ID NO: 3503 - protein, 7 aa, Artificial Sequence
  Description of Artificial Sequence: Synthetic peptide
GTAPGSV

SEQ ID NO: 3504 - protein, 7 aa, Artificial Sequence
  Description of Artificial Sequence: Synthetic peptide
SSHESKG

SEQ ID NO: 3505 - protein, 7 aa, Artificial Sequence
  Description of Artificial Sequence: Synthetic peptide
NTTKPND

SEQ ID NO: 3506 - protein, 7 aa, Artificial Sequence
  Description of Artificial Sequence: Synthetic peptide
SQASNKS

SEQ ID NO: 3507 - protein, 7 aa, Artificial Sequence
  Description of Artificial Sequence: Synthetic peptide
GSSSNRT

SEQ ID NO: 3508 - protein, 7 aa, Artificial Sequence
  Description of Artificial Sequence: Synthetic peptide
SSSDRSS

SEQ ID NO: 3509 - protein, 7 aa, Artificial Sequence
  Description of Artificial Sequence: Synthetic peptide
QGSTSGH

SEQ ID NO: 3510 - protein, 7 aa, Artificial Sequence
  Description of Artificial Sequence: Synthetic peptide
TPESKSQ

SEQ ID NO: 3511 - protein, 7 aa, Artificial Sequence
  Description of Artificial Sequence: Synthetic peptide
STNDKSS

SEQ ID NO: 3512 - protein, 7 aa, Artificial Sequence
  Description of Artificial Sequence: Synthetic peptide
SLSERKD

SEQ ID NO: 3513 - protein, 7 aa, Artificial Sequence
  Description of Artificial Sequence: Synthetic peptide
NVSNLKD

SEQ ID NO: 3514 - protein, 7 aa, Artificial Sequence
  Description of Artificial Sequence: Synthetic peptide
TGTGSQP

SEQ ID NO: 3515 - protein, 7 aa, Artificial Sequence
  Description of Artificial Sequence: Synthetic peptide
QGNNTAH

SEQ ID NO: 3516 - protein, 7 aa, Artificial Sequence
  Description of Artificial Sequence: Synthetic peptide
GEHKTTS

SEQ ID NO: 3517 - protein, 7 aa, Artificial Sequence
  Description of Artificial Sequence: Synthetic peptide
KSDAGST

SEQ ID NO: 3518 - protein, 7 aa, Artificial Sequence
  Description of Artificial Sequence: Synthetic peptide
NTSNPSN

SEQ ID NO: 3519 - protein, 7 aa, Artificial Sequence
  Description of Artificial Sequence: Synthetic peptide
SSTAPHN

SEQ ID NO: 3520 - protein, 7 aa, Artificial Sequence
  Description of Artificial Sequence: Synthetic peptide
RQGDKSA

SEQ ID NO: 3521 - protein, 7 aa, Artificial Sequence
  Description of Artificial Sequence: Synthetic peptide
AGEGSTS

SEQ ID NO: 3522 - protein, 7 aa, Artificial Sequence
  Description of Artificial Sequence: Synthetic peptide
SSNSTPS

SEQ ID NO: 3523 - protein, 7 aa, Artificial Sequence
  Description of Artificial Sequence: Synthetic peptide
EAGSPTR

SEQ ID NO: 3524 - protein, 7 aa, Artificial Sequence
  Description of Artificial Sequence: Synthetic peptide
YPNEKTH

SEQ ID NO: 3525 - protein, 7 aa, Artificial Sequence
  Description of Artificial Sequence: Synthetic peptide
GTPGTGT

SEQ ID NO: 3526 - protein, 7 aa, Artificial Sequence
  Description of Artificial Sequence: Synthetic peptide
NVGGDKR

SEQ ID NO: 3527 - protein, 7 aa, Artificial Sequence
  Description of Artificial Sequence: Synthetic peptide
SGNSANS

SEQ ID NO: 3528 - protein, 7 aa, Artificial Sequence
  Description of Artificial Sequence: Synthetic peptide
GELSQNK

SEQ ID NO: 3529 - protein, 7 aa, Artificial Sequence
  Description of Artificial Sequence: Synthetic peptide
AGDKSSS

SEQ ID NO: 3530 - protein, 7 aa, Artificial Sequence
  Description of Artificial Sequence: Synthetic peptide
AGNGASQ

SEQ ID NO: 3531 - protein, 7 aa, Artificial Sequence
  Description of Artificial Sequence: Synthetic peptide
TTSSTGG

SEQ ID NO: 3532 - protein, 7 aa, Artificial Sequence
  Description of Artificial Sequence: Synthetic peptide
EGVQGGR

SEQ ID NO: 3533 - protein, 7 aa, Artificial Sequence
  Description of Artificial Sequence: Synthetic peptide
KTGGNGS

SEQ ID NO: 3534 - protein, 7 aa, Artificial Sequence
  Description of Artificial Sequence: Synthetic peptide
GSGQSTA

SEQ ID NO: 3535 - protein, 7 aa, Artificial Sequence
  Description of Artificial Sequence: Synthetic peptide
AGSTSPR

SEQ ID NO: 3536 - protein, 7 aa, Artificial Sequence
  Description of Artificial Sequence: Synthetic peptide
QNAKSTS

SEQ ID NO: 3537 - protein, 7 aa, Artificial Sequence
  Description of Artificial Sequence: Synthetic peptide
DNTPTNR

SEQ ID NO: 3538 - protein, 7 aa, Artificial Sequence
  Description of Artificial Sequence: Synthetic peptide
TQGGSTA

SEQ ID NO: 3539 - protein, 7 aa, Artificial Sequence
  Description of Artificial Sequence: Synthetic peptide
GSGQTTS

SEQ ID NO: 3540 - protein, 7 aa, Artificial Sequence
  Description of Artificial Sequence: Synthetic peptide
ADGSSGR

SEQ ID NO: 3541 - protein, 7 aa, Artificial Sequence
  Description of Artificial Sequence: Synthetic peptide
NNGSASN

SEQ ID NO: 3542 - protein, 7 aa, Artificial Sequence
  Description of Artificial Sequence: Synthetic peptide
SGESTRH

SEQ ID NO: 3543 - protein, 7 aa, Artificial Sequence
  Description of Artificial Sequence: Synthetic peptide
DSISKAT

SEQ ID NO: 3544 - protein, 7 aa, Artificial Sequence
  Description of Artificial Sequence: Synthetic peptide
TGGSPLS

SEQ ID NO: 3545 - protein, 7 aa, Artificial Sequence
  Description of Artificial Sequence: Synthetic peptide
STSNTSH

SEQ ID NO: 3546 - protein, 7 aa, Artificial Sequence
  Description of Artificial Sequence: Synthetic peptide
LAGNPGH

SEQ ID NO: 3547 - protein, 7 aa, Artificial Sequence
  Description of Artificial Sequence: Synthetic peptide
GEAKHQP

SEQ ID NO: 3548 - protein, 7 aa, Artificial Sequence
  Description of Artificial Sequence: Synthetic peptide
ATNGKPI

SEQ ID NO: 3549 - protein, 7 aa, Artificial Sequence
  Description of Artificial Sequence: Synthetic peptide
GADSKNS

SEQ ID NO: 3550 - protein, 7 aa, Artificial Sequence
  Description of Artificial Sequence: Synthetic peptide
DSAGKMG

SEQ ID NO: 3551 - protein, 7 aa, Artificial Sequence
  Description of Artificial Sequence: Synthetic peptide
SQGASTA

SEQ ID NO: 3552 - protein, 7 aa, Artificial Sequence
  Description of Artificial Sequence: Synthetic peptide
GGGEHRA

SEQ ID NO: 3553 - protein, 7 aa, Artificial Sequence
  Description of Artificial Sequence: Synthetic peptide
STGHERV

SEQ ID NO: 3554 - protein, 7 aa, Artificial Sequence
  Description of Artificial Sequence: Synthetic peptide
AEGKTSS

SEQ ID NO: 3555 - protein, 7 aa, Artificial Sequence
  Description of Artificial Sequence: Synthetic peptide
DSGSSPK

SEQ ID NO: 3556 - protein, 7 aa, Artificial Sequence
  Description of Artificial Sequence: Synthetic peptide
EGHQTKS

SEQ ID NO: 3557 - protein, 7 aa, Artificial Sequence
  Description of Artificial Sequence: Synthetic peptide
DGNGGTR

SEQ ID NO: 3558 - protein, 7 aa, Artificial Sequence
  Description of Artificial Sequence: Synthetic peptide
QQSATSQ

SEQ ID NO: 3559 - protein, 7 aa, Artificial Sequence
  Description of Artificial Sequence: Synthetic peptide
QASSQNQ

SEQ ID NO: 3560 - protein, 7 aa, Artificial Sequence
  Description of Artificial Sequence: Synthetic peptide
HSTGGQG

SEQ ID NO: 3561 - protein, 7 aa, Artificial Sequence
  Description of Artificial Sequence: Synthetic peptide
DRTDKNT

SEQ ID NO: 3562 - protein, 7 aa, Artificial Sequence
  Description of Artificial Sequence: Synthetic peptide
GKTGQSA

SEQ ID NO: 3563 - protein, 7 aa, Artificial Sequence
  Description of Artificial Sequence: Synthetic peptide
AATTSTT

SEQ ID NO: 3564 - protein, 7 aa, Artificial Sequence
  Description of Artificial Sequence: Synthetic peptide
DIGSKRD

SEQ ID NO: 3565 - protein, 7 aa, Artificial Sequence
  Description of Artificial Sequence: Synthetic peptide
EQRANPT

SEQ ID NO: 3566 - protein, 7 aa, Artificial Sequence
  Description of Artificial Sequence: Synthetic peptide
HQTSGSN

SEQ ID NO: 3567 - protein, 7 aa, Artificial Sequence
  Description of Artificial Sequence: Synthetic peptide
DNASRAA

SEQ ID NO: 3568 - protein, 7 aa, Artificial Sequence
  Description of Artificial Sequence: Synthetic peptide
SSSQKSN

SEQ ID NO: 3569 - protein, 7 aa, Artificial Sequence
  Description of Artificial Sequence: Synthetic peptide
SKGDKTI

SEQ ID NO: 3570 - protein, 7 aa, Artificial Sequence
  Description of Artificial Sequence: Synthetic peptide
SSSTTPV

SEQ ID NO: 3571 - protein, 7 aa, Artificial Sequence
  Description of Artificial Sequence: Synthetic peptide
DARSGQA

SEQ ID NO: 3572 - protein, 7 aa, Artificial Sequence
  Description of Artificial Sequence: Synthetic peptide
SGNGTVQ

SEQ ID NO: 3573 - protein, 7 aa, Artificial Sequence
  Description of Artificial Sequence: Synthetic peptide
SGATSNS

SEQ ID NO: 3574 - protein, 7 aa, Artificial Sequence
  Description of Artificial Sequence: Synthetic peptide
VANGTAK

SEQ ID NO: 3575 - protein, 7 aa, Artificial Sequence
  Description of Artificial Sequence: Synthetic peptide
GSSGSNL

SEQ ID NO: 3576 - protein, 7 aa, Artificial Sequence
  Description of Artificial Sequence: Synthetic peptide
GREGSSS

SEQ ID NO: 3577 - protein, 7 aa, Artificial Sequence
  Description of Artificial Sequence: Synthetic peptide
GIGSSPS

SEQ ID NO: 3578 - protein, 7 aa, Artificial Sequence
  Description of Artificial Sequence: Synthetic peptide
GGGRDVA

SEQ ID NO: 3579 - protein, 7 aa, Artificial Sequence
  Description of Artificial Sequence: Synthetic peptide
TASTATV

SEQ ID NO: 3580 - protein, 7 aa, Artificial Sequence
  Description of Artificial Sequence: Synthetic peptide
NGSQKVQ

SEQ ID NO: 3581 - protein, 7 aa, Artificial Sequence
  Description of Artificial Sequence: Synthetic peptide
NGNTNGQ

SEQ ID NO: 3582 - protein, 7 aa, Artificial Sequence
  Description of Artificial Sequence: Synthetic peptide
LGSGSTT

SEQ ID NO: 3583 - protein, 7 aa, Artificial Sequence
  Description of Artificial Sequence: Synthetic peptide
NSGGSSS

SEQ ID NO: 3584 - protein, 7 aa, Artificial Sequence
  Description of Artificial Sequence: Synthetic peptide
NGNPTPS

SEQ ID NO: 3585 - protein, 7 aa, Artificial Sequence
  Description of Artificial Sequence: Synthetic peptide
SGTNHTG

SEQ ID NO: 3586 - protein, 7 aa, Artificial Sequence
  Description of Artificial Sequence: Synthetic peptide
GTGSDRT

SEQ ID NO: 3587 - protein, 7 aa, Artificial Sequence
  Description of Artificial Sequence: Synthetic peptide
VPSSNPN

SEQ ID NO: 3588 - protein, 7 aa, Artificial Sequence
  Description of Artificial Sequence: Synthetic peptide
QTPSKMS

SEQ ID NO: 3589 - protein, 7 aa, Artificial Sequence
  Description of Artificial Sequence: Synthetic peptide
EGKSSLA

SEQ ID NO: 3590 - protein, 7 aa, Artificial Sequence
  Description of Artificial Sequence: Synthetic peptide
ANGAGSH

SEQ ID NO: 3591 - protein, 7 aa, Artificial Sequence
  Description of Artificial Sequence: Synthetic peptide
RLDNTGG

SEQ ID NO: 3592 - protein, 7 aa, Artificial Sequence
  Description of Artificial Sequence: Synthetic peptide
NKVQSHE

SEQ ID NO: 3593 - protein, 7 aa, Artificial Sequence
  Description of Artificial Sequence: Synthetic peptide
STGATSS

SEQ ID NO: 3594 - protein, 7 aa, Artificial Sequence
  Description of Artificial Sequence: Synthetic peptide
HTDKSGA

SEQ ID NO: 3595 - protein, 7 aa, Artificial Sequence
  Description of Artificial Sequence: Synthetic peptide
TGSSTIT

SEQ ID NO: 3596 - protein, 7 aa, Artificial Sequence
  Description of Artificial Sequence: Synthetic peptide
LSSQKGN

SEQ ID NO: 3597 - protein, 7 aa, Artificial Sequence
  Description of Artificial Sequence: Synthetic peptide
MPSNSST

SEQ ID NO: 3598 - protein, 7 aa, Artificial Sequence
  Description of Artificial Sequence: Synthetic peptide
TRNTPTE

SEQ ID NO: 3599 - protein, 7 aa, Artificial Sequence
  Description of Artificial Sequence: Synthetic peptide
AVDNKSH

SEQ ID NO: 3600 - protein, 7 aa, Artificial Sequence
  Description of Artificial Sequence: Synthetic peptide
NSVSSTG

SEQ ID NO: 3601 - protein, 7 aa, Artificial Sequence
  Description of Artificial Sequence: Synthetic peptide
AASSTPQ

SEQ ID NO: 3602 - protein, 7 aa, Artificial Sequence
  Description of Artificial Sequence: Synthetic peptide
GSRDSTG

SEQ ID NO: 3603 - protein, 7 aa, Artificial Sequence
  Description of Artificial Sequence: Synthetic peptide
GELKNAG

SEQ ID NO: 3604 - protein, 7 aa, Artificial Sequence
  Description of Artificial Sequence: Synthetic peptide
SGRDGHN

SEQ ID NO: 3605 - protein, 7 aa, Artificial Sequence
  Description of Artificial Sequence: Synthetic peptide
SAGNGKS

SEQ ID NO: 3606 - protein, 7 aa, Artificial Sequence
  Description of Artificial Sequence: Synthetic peptide
DNKTASN

SEQ ID NO: 3607 - protein, 7 aa, Artificial Sequence
  Description of Artificial Sequence: Synthetic peptide
TATESRG

SEQ ID NO: 3608 - protein, 7 aa, Artificial Sequence
  Description of Artificial Sequence: Synthetic peptide
ATTPPTS

SEQ ID NO: 3609 - protein, 7 aa, Artificial Sequence
  Description of Artificial Sequence: Synthetic peptide
QSSNQMT

SEQ ID NO: 3610 - protein, 7 aa, Artificial Sequence
  Description of Artificial Sequence: Synthetic peptide
GNHQPSS

SEQ ID NO: 3611 - protein, 7 aa, Artificial Sequence
  Description of Artificial Sequence: Synthetic peptide
TSKPNPS

SEQ ID NO: 3612 - protein, 7 aa, Artificial Sequence
  Description of Artificial Sequence: Synthetic peptide
TGGTNSV

SEQ ID NO: 3613 - protein, 7 aa, Artificial Sequence
  Description of Artificial Sequence: Synthetic peptide
DTGVNRG

SEQ ID NO: 3614 - protein, 7 aa, Artificial Sequence
  Description of Artificial Sequence: Synthetic peptide
SGAGTPS

SEQ ID NO: 3615 - protein, 7 aa, Artificial Sequence
  Description of Artificial Sequence: Synthetic peptide
DNTVKTN

SEQ ID NO: 3616 - protein, 7 aa, Artificial Sequence
  Description of Artificial Sequence: Synthetic peptide
DQGSVSK

SEQ ID NO: 3617 - protein, 7 aa, Artificial Sequence
  Description of Artificial Sequence: Synthetic peptide
AMGDSKG

SEQ ID NO: 3618 - protein, 7 aa, Artificial Sequence
  Description of Artificial Sequence: Synthetic peptide
GNSAGGA

SEQ ID NO: 3619 - protein, 7 aa, Artificial Sequence
  Description of Artificial Sequence: Synthetic peptide
GTAKDVA

SEQ ID NO: 3620 - protein, 7 aa, Artificial Sequence
  Description of Artificial Sequence: Synthetic peptide
DRADKMG

SEQ ID NO: 3621 - protein, 7 aa, Artificial Sequence
  Description of Artificial Sequence: Synthetic peptide
DRGTPPT

SEQ ID NO: 3622 - protein, 7 aa, Artificial Sequence
  Description of Artificial Sequence: Synthetic peptide
GDGGSLK

SEQ ID NO: 3623 - protein, 7 aa, Artificial Sequence
  Description of Artificial Sequence: Synthetic peptide
TMSDKGM

SEQ ID NO: 3624 - protein, 7 aa, Artificial Sequence
  Description of Artificial Sequence: Synthetic peptide
NTIGDNK

SEQ ID NO: 3625 - protein, 7 aa, Artificial Sequence
  Description of Artificial Sequence: Synthetic peptide
TTSDGAK

SEQ ID NO: 3626 - protein, 7 aa, Artificial Sequence
  Description of Artificial Sequence: Synthetic peptide
SNSNGHS

SEQ ID NO: 3627 - protein, 7 aa, Artificial Sequence
  Description of Artificial Sequence: Synthetic peptide
SGSPPAA

SEQ ID NO: 3628 - protein, 7 aa, Artificial Sequence
  Description of Artificial Sequence: Synthetic peptide
SGSNQPR

SEQ ID NO: 3629 - protein, 7 aa, Artificial Sequence
  Description of Artificial Sequence: Synthetic peptide
RDGSGKV

SEQ ID NO: 3630 - protein, 7 aa, Artificial Sequence
  Description of Artificial Sequence: Synthetic peptide
NQAASPV

SEQ ID NO: 3631 - protein, 7 aa, Artificial Sequence
  Description of Artificial Sequence: Synthetic peptide
SGSASNV

SEQ ID NO: 3632 - protein, 7 aa, Artificial Sequence
  Description of Artificial Sequence: Synthetic peptide
SIAKDRA

SEQ ID NO: 3633 - protein, 7 aa, Artificial Sequence
  Description of Artificial Sequence: Synthetic peptide
DRTVKEV

SEQ ID NO: 3634 - protein, 7 aa, Artificial Sequence
  Description of Artificial Sequence: Synthetic peptide
TKNSQVV

SEQ ID NO: 3635 - protein, 7 aa, Artificial Sequence
  Description of Artificial Sequence: Synthetic peptide
ESANRNA

SEQ ID NO: 3636 - protein, 7 aa, Artificial Sequence
  Description of Artificial Sequence: Synthetic peptide
SHSESAK

SEQ ID NO: 3637 - protein, 7 aa, Artificial Sequence
  Description of Artificial Sequence: Synthetic peptide
SGVGGKE

SEQ ID NO: 3638 - protein, 7 aa, Artificial Sequence
  Description of Artificial Sequence: Synthetic peptide
APPEGAK

SEQ ID NO: 3639 - protein, 7 aa, Artificial Sequence
  Description of Artificial Sequence: Synthetic peptide
NAQGANA

SEQ ID NO: 3640 - protein, 7 aa, Artificial Sequence
  Description of Artificial Sequence: Synthetic peptide
QVGAQNS

SEQ ID NO: 3641 - protein, 7 aa, Artificial Sequence
  Description of Artificial Sequence: Synthetic peptide
HSNGHAQ

SEQ ID NO: 3642 - protein, 7 aa, Artificial Sequence
  Description of Artificial Sequence: Synthetic peptide
GNASPSV

SEQ ID NO: 3643 - protein, 7 aa, Artificial Sequence
  Description of Artificial Sequence: Synthetic peptide
GDSKSTL

SEQ ID NO: 3644 - protein, 7 aa, Artificial Sequence
  Description of Artificial Sequence: Synthetic peptide
TRASGST

SEQ ID NO: 3645 - protein, 7 aa, Artificial Sequence
  Description of Artificial Sequence: Synthetic peptide
SVTPSGG

SEQ ID NO: 3646 - protein, 7 aa, Artificial Sequence
  Description of Artificial Sequence: Synthetic peptide
TSQTSTT

SEQ ID NO: 3647 - protein, 7 aa, Artificial Sequence
  Description of Artificial Sequence: Synthetic peptide
EAKSDHR

SEQ ID NO: 3648 - protein, 7 aa, Artificial Sequence
  Description of Artificial Sequence: Synthetic peptide
AESHNVK

SEQ ID NO: 3649 - protein, 7 aa, Artificial Sequence
  Description of Artificial Sequence: Synthetic peptide
GIGSPTA

SEQ ID NO: 3650 - protein, 7 aa, Artificial Sequence
  Description of Artificial Sequence: Synthetic peptide
GQGAGAS

SEQ ID NO: 3651 - protein, 7 aa, Artificial Sequence
  Description of Artificial Sequence: Synthetic peptide
QQGSGSH

SEQ ID NO: 3652 - protein, 7 aa, Artificial Sequence
  Description of Artificial Sequence: Synthetic peptide
DNPTKTQ

SEQ ID NO: 3653 - protein, 7 aa, Artificial Sequence
  Description of Artificial Sequence: Synthetic peptide
TGTTAAT

SEQ ID NO: 3654 - protein, 7 aa, Artificial Sequence
  Description of Artificial Sequence: Synthetic peptide
TSGSAPT

SEQ ID NO: 3655 - protein, 7 aa, Artificial Sequence
  Description of Artificial Sequence: Synthetic peptide
GTGSTSN

SEQ ID NO: 3656 - protein, 7 aa, Artificial Sequence
  Description of Artificial Sequence: Synthetic peptide
NSGSNSM

SEQ ID NO: 3657 - protein, 7 aa, Artificial Sequence
  Description of Artificial Sequence: Synthetic peptide
QTGQHST

SEQ ID NO: 3658 - protein, 7 aa, Artificial Sequence
  Description of Artificial Sequence: Synthetic peptide
GDPKNSG

SEQ ID NO: 3659 - protein, 7 aa, Artificial Sequence
  Description of Artificial Sequence: Synthetic peptide
SSPPPSH

SEQ ID NO: 3660 - protein, 7 aa, Artificial Sequence
  Description of Artificial Sequence: Synthetic peptide
GQDRVAS

SEQ ID NO: 3661 - protein, 7 aa, Artificial Sequence
  Description of Artificial Sequence: Synthetic peptide
EVAQPSN

SEQ ID NO: 3662 - protein, 7 aa, Artificial Sequence
  Description of Artificial Sequence: Synthetic peptide
LNEHKVS

SEQ ID NO: 3663 - protein, 7 aa, Artificial Sequence
  Description of Artificial Sequence: Synthetic peptide
GETGQHK

SEQ ID NO: 3664 - protein, 7 aa, Artificial Sequence
  Description of Artificial Sequence: Synthetic peptide
STQEAKH

SEQ ID NO: 3665 - protein, 7 aa, Artificial Sequence
  Description of Artificial Sequence: Synthetic peptide
QSHDKTN

SEQ ID NO: 3666 - protein, 7 aa, Artificial Sequence
  Description of Artificial Sequence: Synthetic peptide
HSDTSKS

SEQ ID NO: 3667 - protein, 7 aa, Artificial Sequence
  Description of Artificial Sequence: Synthetic peptide
SGIGTST

SEQ ID NO: 3668 - protein, 7 aa, Artificial Sequence
  Description of Artificial Sequence: Synthetic peptide
NTGETPR

SEQ ID NO: 3669 - protein, 7 aa, Artificial Sequence
  Description of Artificial Sequence: Synthetic peptide
QGGDSTR

SEQ ID NO: 3670 - protein, 7 aa, Artificial Sequence
  Description of Artificial Sequence: Synthetic peptide
TTTEKSG

SEQ ID NO: 3671 - protein, 7 aa, Artificial Sequence
  Description of Artificial Sequence: Synthetic peptide
TTTATSQ

SEQ ID NO: 3672 - protein, 7 aa, Artificial Sequence
  Description of Artificial Sequence: Synthetic peptide
SGAKSDA

SEQ ID NO: 3673 - protein, 7 aa, Artificial Sequence
  Description of Artificial Sequence: Synthetic peptide
NSADKSI

SEQ ID NO: 3674 - protein, 7 aa, Artificial Sequence
  Description of Artificial Sequence: Synthetic peptide
ASSPSSM

SEQ ID NO: 3675 - protein, 7 aa, Artificial Sequence
  Description of Artificial Sequence: Synthetic peptide
APSSNPV

SEQ ID NO: 3676 - protein, 7 aa, Artificial Sequence
  Description of Artificial Sequence: Synthetic peptide
GIDAKMS

SEQ ID NO: 3677 - protein, 7 aa, Artificial Sequence
  Description of Artificial Sequence: Synthetic peptide
DTVSKTA

SEQ ID NO: 3678 - protein, 7 aa, Artificial Sequence
  Description of Artificial Sequence: Synthetic peptide
NSGSQAN

SEQ ID NO: 3679 - protein, 7 aa, Artificial Sequence
  Description of Artificial Sequence: Synthetic peptide
TSQAQTG

SEQ ID NO: 3680 - protein, 7 aa, Artificial Sequence
  Description of Artificial Sequence: Synthetic peptide
TGQPSSV

SEQ ID NO: 3681 - protein, 7 aa, Artificial Sequence
  Description of Artificial Sequence: Synthetic peptide
STGQAPS

SEQ ID NO: 3682 - protein, 7 aa, Artificial Sequence
  Description of Artificial Sequence: Synthetic peptide
SPGHKLM

SEQ ID NO: 3683 - protein, 7 aa, Artificial Sequence
  Description of Artificial Sequence: Synthetic peptide
GTETKTG

SEQ ID NO: 3684 - protein, 7 aa, Artificial Sequence
  Description of Artificial Sequence: Synthetic peptide
GGDQGVK

SEQ ID NO: 3685 - protein, 7 aa, Artificial Sequence
  Description of Artificial Sequence: Synthetic peptide
VVGRTPG

SEQ ID NO: 3686 - protein, 7 aa, Artificial Sequence
  Description of Artificial Sequence: Synthetic peptide
EGSKTPV

SEQ ID NO: 3687 - protein, 7 aa, Artificial Sequence
  Description of Artificial Sequence: Synthetic peptide
TSDRTST

SEQ ID NO: 3688 - protein, 7 aa, Artificial Sequence
  Description of Artificial Sequence: Synthetic peptide
MKQTSAV

SEQ ID NO: 3689 - protein, 7 aa, Artificial Sequence
  Description of Artificial Sequence: Synthetic peptide
DVPTSKA

SEQ ID NO: 3690 - protein, 7 aa, Artificial Sequence
  Description of Artificial Sequence: Synthetic peptide
TAATVAK

SEQ ID NO: 3691 - protein, 7 aa, Artificial Sequence
  Description of Artificial Sequence: Synthetic peptide
RQSDKVS

SEQ ID NO: 3692 - protein, 7 aa, Artificial Sequence
  Description of Artificial Sequence: Synthetic peptide
GLQTNGT

SEQ ID NO: 3693 - protein, 7 aa, Artificial Sequence
  Description of Artificial Sequence: Synthetic peptide
SGVQATN

SEQ ID NO: 3694 - protein, 7 aa, Artificial Sequence
  Description of Artificial Sequence: Synthetic peptide
ATNEKTF

SEQ ID NO: 3695 - protein, 7 aa, Artificial Sequence
  Description of Artificial Sequence: Synthetic peptide
SGEAKVA

SEQ ID NO: 3696 - protein, 7 aa, Artificial Sequence
  Description of Artificial Sequence: Synthetic peptide
DSAKPNS

SEQ ID NO: 3697 - protein, 7 aa, Artificial Sequence
  Description of Artificial Sequence: Synthetic peptide
TTGASPI

SEQ ID NO: 3698 - protein, 7 aa, Artificial Sequence
  Description of Artificial Sequence: Synthetic peptide
VTGNAGT

SEQ ID NO: 3699 - protein, 7 aa, Artificial Sequence
  Description of Artificial Sequence: Synthetic peptide
NTTSGNN

SEQ ID NO: 3700 - protein, 7 aa, Artificial Sequence
  Description of Artificial Sequence: Synthetic peptide
NDSQKVA

SEQ ID NO: 3701 - protein, 7 aa, Artificial Sequence
  Description of Artificial Sequence: Synthetic peptide
ASTGSSK

SEQ ID NO: 3702 - protein, 7 aa, Artificial Sequence
  Description of Artificial Sequence: Synthetic peptide
SSGGAST

SEQ ID NO: 3703 - protein, 7 aa, Artificial Sequence
  Description of Artificial Sequence: Synthetic peptide
DGRQTTS

SEQ ID NO: 3704 - protein, 7 aa, Artificial Sequence
  Description of Artificial Sequence: Synthetic peptide
AGETART

SEQ ID NO: 3705 - protein, 7 aa, Artificial Sequence
  Description of Artificial Sequence: Synthetic peptide
ASNSPVS

SEQ ID NO: 3706 - protein, 7 aa, Artificial Sequence
  Description of Artificial Sequence: Synthetic peptide
SGKGSSV

SEQ ID NO: 3707 - protein, 7 aa, Artificial Sequence
  Description of Artificial Sequence: Synthetic peptide
SGSESPK

SEQ ID NO: 3708 - protein, 7 aa, Artificial Sequence
  Description of Artificial Sequence: Synthetic peptide
TASGTPQ

SEQ ID NO: 3709 - protein, 7 aa, Artificial Sequence
  Description of Artificial Sequence: Synthetic peptide
NTGSASI

SEQ ID NO: 3710 - protein, 7 aa, Artificial Sequence
  Description of Artificial Sequence: Synthetic peptide
EATVKTG

SEQ ID NO: 3711 - protein, 7 aa, Artificial Sequence
  Description of Artificial Sequence: Synthetic peptide
IQKGNNE

SEQ ID NO: 3712 - protein, 7 aa, Artificial Sequence
  Description of Artificial Sequence: Synthetic peptide
DSNKQNL

SEQ ID NO: 3713 - protein, 7 aa, Artificial Sequence
  Description of Artificial Sequence: Synthetic peptide
TGGNPVT

SEQ ID NO: 3714 - protein, 7 aa, Artificial Sequence
  Description of Artificial Sequence: Synthetic peptide
QGSNNSR

SEQ ID NO: 3715 - protein, 7 aa, Artificial Sequence
  Description of Artificial Sequence: Synthetic peptide
KVATSSS

SEQ ID NO: 3716 - protein, 7 aa, Artificial Sequence
  Description of Artificial Sequence: Synthetic peptide
DSSREAR

SEQ ID NO: 3717 - protein, 7 aa, Artificial Sequence
  Description of Artificial Sequence: Synthetic peptide
EGSSSSM

SEQ ID NO: 3718 - protein, 7 aa, Artificial Sequence
  Description of Artificial Sequence: Synthetic peptide
NNGSSVA

SEQ ID NO: 3719 - protein, 7 aa, Artificial Sequence
  Description of Artificial Sequence: Synthetic peptide
ETSERNQ

SEQ ID NO: 3720 - protein, 7 aa, Artificial Sequence
  Description of Artificial Sequence: Synthetic peptide
DSGTGPT

SEQ ID NO: 3721 - protein, 7 aa, Artificial Sequence
  Description of Artificial Sequence: Synthetic peptide
DSAKSSV

SEQ ID NO: 3722 - protein, 7 aa, Artificial Sequence
  Description of Artificial Sequence: Synthetic peptide
SDTKTST

SEQ ID NO: 3723 - protein, 7 aa, Artificial Sequence
  Description of Artificial Sequence: Synthetic peptide
QGQGQAS

SEQ ID NO: 3724 - protein, 7 aa, Artificial Sequence
  Description of Artificial Sequence: Synthetic peptide
NNGVSST

SEQ ID NO: 3725 - protein, 7 aa, Artificial Sequence
  Description of Artificial Sequence: Synthetic peptide
RQASSTT

SEQ ID NO: 3726 - protein, 7 aa, Artificial Sequence
  Description of Artificial Sequence: Synthetic peptide
SNNASPS

SEQ ID NO: 3727 - protein, 7 aa, Artificial Sequence
  Description of Artificial Sequence: Synthetic peptide
SDGKSHP

SEQ ID NO: 3728 - protein, 7 aa, Artificial Sequence
  Description of Artificial Sequence: Synthetic peptide
SPSNSHS

SEQ ID NO: 3729 - protein, 7 aa, Artificial Sequence
  Description of Artificial Sequence: Synthetic peptide
AQSEKTL

SEQ ID NO: 3730 - protein, 7 aa, Artificial Sequence
  Description of Artificial Sequence: Synthetic peptide
STSKDYS

SEQ ID NO: 3731 - protein, 7 aa, Artificial Sequence
  Description of Artificial Sequence: Synthetic peptide
STGATSN

SEQ ID NO: 3732 - protein, 7 aa, Artificial Sequence
  Description of Artificial Sequence: Synthetic peptide
TGSGSSS

SEQ ID NO: 3733 - protein, 7 aa, Artificial Sequence
  Description of Artificial Sequence: Synthetic peptide
TGSNHPG

SEQ ID NO: 3734 - protein, 7 aa, Artificial Sequence
  Description of Artificial Sequence: Synthetic peptide
TRAPTTG

SEQ ID NO: 3735 - protein, 7 aa, Artificial Sequence
  Description of Artificial Sequence: Synthetic peptide
SGVNTPA

SEQ ID NO: 3736 - protein, 7 aa, Artificial Sequence
  Description of Artificial Sequence: Synthetic peptide
HGAGQSS

SEQ ID NO: 3737 - protein, 7 aa, Artificial Sequence
  Description of Artificial Sequence: Synthetic peptide
GGGNTAM

SEQ ID NO: 3738 - protein, 7 aa, Artificial Sequence
  Description of Artificial Sequence: Synthetic peptide
GSSAPAL

SEQ ID NO: 3739 - protein, 7 aa, Artificial Sequence
  Description of Artificial Sequence: Synthetic peptide
QNATTSS

SEQ ID NO: 3740 - protein, 7 aa, Artificial Sequence
  Description of Artificial Sequence: Synthetic peptide
GSQNGLS

SEQ ID NO: 3741 - protein, 7 aa, Artificial Sequence
  Description of Artificial Sequence: Synthetic peptide
QSTPGTQ

SEQ ID NO: 3742 - protein, 7 aa, Artificial Sequence
  Description of Artificial Sequence: Synthetic peptide
RKEQSSQ

SEQ ID NO: 3743 - protein, 7 aa, Artificial Sequence
  Description of Artificial Sequence: Synthetic peptide
GVGGASS

SEQ ID NO: 3744 - protein, 7 aa, Artificial Sequence
  Description of Artificial Sequence: Synthetic peptide
RQSGSKD

SEQ ID NO: 3745 - protein, 7 aa, Artificial Sequence
  Description of Artificial Sequence: Synthetic peptide
ATQSASS

SEQ ID NO: 3746 - protein, 7 aa, Artificial Sequence
  Description of Artificial Sequence: Synthetic peptide
RNGGSSM

SEQ ID NO: 3747 - protein, 7 aa, Artificial Sequence
  Description of Artificial Sequence: Synthetic peptide
SGGASSL

SEQ ID NO: 3748 - protein, 7 aa, Artificial Sequence
  Description of Artificial Sequence: Synthetic peptide
QTTAPHG

SEQ ID NO: 3749 - protein, 7 aa, Artificial Sequence
  Description of Artificial Sequence: Synthetic peptide
SNSTAPH

SEQ ID NO: 3750 - protein, 7 aa, Artificial Sequence
  Description of Artificial Sequence: Synthetic peptide
SGSNTPH

SEQ ID NO: 3751 - protein, 7 aa, Artificial Sequence
  Description of Artificial Sequence: Synthetic peptide
GSSAGGN

SEQ ID NO: 3752 - protein, 7 aa, Artificial Sequence
  Description of Artificial Sequence: Synthetic peptide
TGTNTVL

SEQ ID NO: 3753 - protein, 7 aa, Artificial Sequence
  Description of Artificial Sequence: Synthetic peptide
KDGGSQV

SEQ ID NO: 3754 - protein, 7 aa, Artificial Sequence
  Description of Artificial Sequence: Synthetic peptide
TTGGTNV

SEQ ID NO: 3755 - protein, 7 aa, Artificial Sequence
  Description of Artificial Sequence: Synthetic peptide
QNQDKPT

SEQ ID NO: 3756 - protein, 7 aa, Artificial Sequence
  Description of Artificial Sequence: Synthetic peptide
EQRSSGL

SEQ ID NO: 3757 - protein, 7 aa, Artificial Sequence
  Description of Artificial Sequence: Synthetic peptide
STTNSGG

SEQ ID NO: 3758 - protein, 7 aa, Artificial Sequence
  Description of Artificial Sequence: Synthetic peptide
TLVAKPE

SEQ ID NO: 3759 - protein, 7 aa, Artificial Sequence
  Description of Artificial Sequence: Synthetic peptide
ESPQKSG

SEQ ID NO: 3760 - protein, 7 aa, Artificial Sequence
  Description of Artificial Sequence: Synthetic peptide
DPSKSSG

SEQ ID NO: 3761 - protein, 7 aa, Artificial Sequence
  Description of Artificial Sequence: Synthetic peptide
NVGSGTL

SEQ ID NO: 3762 - protein, 7 aa, Artificial Sequence
  Description of Artificial Sequence: Synthetic peptide
SHGNKET

SEQ ID NO: 3763 - protein, 7 aa, Artificial Sequence
  Description of Artificial Sequence: Synthetic peptide
NSGHAPV

SEQ ID NO: 3764 - protein, 7 aa, Artificial Sequence
  Description of Artificial Sequence: Synthetic peptide
NEHNGVK

SEQ ID NO: 3765 - protein, 7 aa, Artificial Sequence
  Description of Artificial Sequence: Synthetic peptide
TGQPSSR

SEQ ID NO: 3766 - protein, 7 aa, Artificial Sequence
  Description of Artificial Sequence: Synthetic peptide
QGPSQPG

SEQ ID NO: 3767 - protein, 7 aa, Artificial Sequence
  Description of Artificial Sequence: Synthetic peptide
ATTSSNS

SEQ ID NO: 3768 - protein, 7 aa, Artificial Sequence
  Description of Artificial Sequence: Synthetic peptide
VTSNDKG

SEQ ID NO: 3769 - protein, 7 aa, Artificial Sequence
  Description of Artificial Sequence: Synthetic peptide
IGTGKPE

SEQ ID NO: 3770 - protein, 7 aa, Artificial Sequence
  Description of Artificial Sequence: Synthetic peptide
ATGASSN

SEQ ID NO: 3771 - protein, 7 aa, Artificial Sequence
  Description of Artificial Sequence: Synthetic peptide
LPSNAKG

SEQ ID NO: 3772 - protein, 7 aa, Artificial Sequence
  Description of Artificial Sequence: Synthetic peptide
SVGSAGG

SEQ ID NO: 3773 - protein, 7 aa, Artificial Sequence
  Description of Artificial Sequence: Synthetic peptide
NTGSGGT

SEQ ID NO: 3774 - protein, 7 aa, Artificial Sequence
  Description of Artificial Sequence: Synthetic peptide
GAGGNSS

SEQ ID NO: 3775 - protein, 7 aa, Artificial Sequence
  Description of Artificial Sequence: Synthetic peptide
SNNKPSL

SEQ ID NO: 3776 - protein, 7 aa, Artificial Sequence
  Description of Artificial Sequence: Synthetic peptide
EQGKNSH

SEQ ID NO: 3777 - protein, 7 aa, Artificial Sequence
  Description of Artificial Sequence: Synthetic peptide
DSSSIVK

SEQ ID NO: 3778 - protein, 7 aa, Artificial Sequence
  Description of Artificial Sequence: Synthetic peptide
ATGTSGR

SEQ ID NO: 3779 - protein, 7 aa, Artificial Sequence
  Description of Artificial Sequence: Synthetic peptide
TTNEPRI

SEQ ID NO: 3780 - protein, 7 aa, Artificial Sequence
  Description of Artificial Sequence: Synthetic peptide
HNTSGIA

SEQ ID NO: 3781 - protein, 7 aa, Artificial Sequence
  Description of Artificial Sequence: Synthetic peptide
SGTNSSS

SEQ ID NO: 3782 - protein, 7 aa, Artificial Sequence
  Description of Artificial Sequence: Synthetic peptide
MGGNTAG

SEQ ID NO: 3783 - protein, 7 aa, Artificial Sequence
  Description of Artificial Sequence: Synthetic peptide
GASPQKG

SEQ ID NO: 3784 - protein, 7 aa, Artificial Sequence
  Description of Artificial Sequence: Synthetic peptide
GIGKSDA

SEQ ID NO: 3785 - protein, 7 aa, Artificial Sequence
  Description of Artificial Sequence: Synthetic peptide
VSSGSST

SEQ ID NO: 3786 - protein, 7 aa, Artificial Sequence
  Description of Artificial Sequence: Synthetic peptide
SATNTSN

SEQ ID NO: 3787 - protein, 7 aa, Artificial Sequence
  Description of Artificial Sequence: Synthetic peptide
NSGVTHA

SEQ ID NO: 3788 - protein, 7 aa, Artificial Sequence
  Description of Artificial Sequence: Synthetic peptide
GSSSPAK

SEQ ID NO: 3789 - protein, 7 aa, Artificial Sequence
  Description of Artificial Sequence: Synthetic peptide
AGSSSSK

SEQ ID NO: 3790 - protein, 7 aa, Artificial Sequence
  Description of Artificial Sequence: Synthetic peptide
GGISDNK

SEQ ID NO: 3791 - protein, 7 aa, Artificial Sequence
  Description of Artificial Sequence: Synthetic peptide
NSKTNSQ

SEQ ID NO: 3792 - protein, 7 aa, Artificial Sequence
  Description of Artificial Sequence: Synthetic peptide
MNGSAAS

SEQ ID NO: 3793 - protein, 7 aa, Artificial Sequence
  Description of Artificial Sequence: Synthetic peptide
QGKDSGS

SEQ ID NO: 3794 - protein, 7 aa, Artificial Sequence
  Description of Artificial Sequence: Synthetic peptide
RTVGDRS

SEQ ID NO: 3795 - protein, 7 aa, Artificial Sequence
  Description of Artificial Sequence: Synthetic peptide
EAANKNI

SEQ ID NO: 3796 - protein, 7 aa, Artificial Sequence
  Description of Artificial Sequence: Synthetic peptide
STTTKAG

SEQ ID NO: 3797 - protein, 7 aa, Artificial Sequence
  Description of Artificial Sequence: Synthetic peptide
HKTENGG

SEQ ID NO: 3798 - protein, 7 aa, Artificial Sequence
  Description of Artificial Sequence: Synthetic peptide
DNNGRNT

SEQ ID NO: 3799 - protein, 7 aa, Artificial Sequence
  Description of Artificial Sequence: Synthetic peptide
TQSSSAN

SEQ ID NO: 3800 - protein, 7 aa, Artificial Sequence
  Description of Artificial Sequence: Synthetic peptide
SGNANTL

SEQ ID NO: 3801 - protein, 7 aa, Artificial Sequence
  Description of Artificial Sequence: Synthetic peptide
STSNGAK

SEQ ID NO: 3802 - protein, 7 aa, Artificial Sequence
  Description of Artificial Sequence: Synthetic peptide
ANGAHSS

SEQ ID NO: 3803 - protein, 7 aa, Artificial Sequence
  Description of Artificial Sequence: Synthetic peptide
GSGNAHS

SEQ ID NO: 3804 - protein, 7 aa, Artificial Sequence
  Description of Artificial Sequence: Synthetic peptide
TVNSKAQ

SEQ ID NO: 3805 - protein, 7 aa, Artificial Sequence
  Description of Artificial Sequence: Synthetic peptide
LGGSSPK

SEQ ID NO: 3806 - protein, 7 aa, Artificial Sequence
  Description of Artificial Sequence: Synthetic peptide
EKPNPGH

SEQ ID NO: 3807 - protein, 7 aa, Artificial Sequence
  Description of Artificial Sequence: Synthetic peptide
ERTPSSQ

SEQ ID NO: 3808 - protein, 7 aa, Artificial Sequence
  Description of Artificial Sequence: Synthetic peptide
AVNSSTG

SEQ ID NO: 3809 - protein, 7 aa, Artificial Sequence
  Description of Artificial Sequence: Synthetic peptide
SHSNDRA

SEQ ID NO: 3810 - protein, 7 aa, Artificial Sequence
  Description of Artificial Sequence: Synthetic peptide
STATASA

SEQ ID NO: 3811 - protein, 7 aa, Artificial Sequence
  Description of Artificial Sequence: Synthetic peptide
QSTTNGS

SEQ ID NO: 3812 - protein, 7 aa, Artificial Sequence
  Description of Artificial Sequence: Synthetic peptide
SGGNPIN

SEQ ID NO: 3813 - protein, 7 aa, Artificial Sequence
  Description of Artificial Sequence: Synthetic peptide
DSVNPKQ

SEQ ID NO: 3814 - protein, 7 aa, Artificial Sequence
  Description of Artificial Sequence: Synthetic peptide
NGTTSAR

SEQ ID NO: 3815 - protein, 7 aa, Artificial Sequence
  Description of Artificial Sequence: Synthetic peptide
NNDRASL

SEQ ID NO: 3816 - protein, 7 aa, Artificial Sequence
  Description of Artificial Sequence: Synthetic peptide
TNGSSPV

SEQ ID NO: 3817 - protein, 7 aa, Artificial Sequence
  Description of Artificial Sequence: Synthetic peptide
VSGSGNQ

SEQ ID NO: 3818 - protein, 7 aa, Artificial Sequence
  Description of Artificial Sequence: Synthetic peptide
GQISSPK

SEQ ID NO: 3819 - protein, 7 aa, Artificial Sequence
  Description of Artificial Sequence: Synthetic peptide
SVSPSNT

SEQ ID NO: 3820 - protein, 7 aa, Artificial Sequence
  Description of Artificial Sequence: Synthetic peptide
EVVSKTG

SEQ ID NO: 3821 - protein, 7 aa, Artificial Sequence
  Description of Artificial Sequence: Synthetic peptide
QGESRSA

SEQ ID NO: 3822 - protein, 7 aa, Artificial Sequence
  Description of Artificial Sequence: Synthetic peptide
HTTSSSG

SEQ ID NO: 3823 - protein, 7 aa, Artificial Sequence
  Description of Artificial Sequence: Synthetic peptide
VGKGSSV

SEQ ID NO: 3824 - protein, 7 aa, Artificial Sequence
  Description of Artificial Sequence: Synthetic peptide
DTRDGKS

SEQ ID NO: 3825 - protein, 7 aa, Artificial Sequence
  Description of Artificial Sequence: Synthetic peptide
SGNVTSG

SEQ ID NO: 3826 - protein, 7 aa, Artificial Sequence
  Description of Artificial Sequence: Synthetic peptide
TQGNTSG

SEQ ID NO: 3827 - protein, 7 aa, Artificial Sequence
  Description of Artificial Sequence: Synthetic peptide
QADKNMG

SEQ ID NO: 3828 - protein, 7 aa, Artificial Sequence
  Description of Artificial Sequence: Synthetic peptide
SQGSSAI

SEQ ID NO: 3829 - protein, 7 aa, Artificial Sequence
  Description of Artificial Sequence: Synthetic peptide
IRDSTSN

SEQ ID NO: 3830 - protein, 7 aa, Artificial Sequence
  Description of Artificial Sequence: Synthetic peptide
GGREVNS

SEQ ID NO: 3831 - protein, 7 aa, Artificial Sequence
  Description of Artificial Sequence: Synthetic peptide
EGGATMS

SEQ ID NO: 3832 - protein, 7 aa, Artificial Sequence
  Description of Artificial Sequence: Synthetic peptide
RNQGQSI

SEQ ID NO: 3833 - protein, 7 aa, Artificial Sequence
  Description of Artificial Sequence: Synthetic peptide
SVGAASS

SEQ ID NO: 3834 - protein, 7 aa, Artificial Sequence
  Description of Artificial Sequence: Synthetic peptide
MKQNNQE

SEQ ID NO: 3835 - protein, 7 aa, Artificial Sequence
  Description of Artificial Sequence: Synthetic peptide
IRSKDSV

SEQ ID NO: 3836 - protein, 7 aa, Artificial Sequence
  Description of Artificial Sequence: Synthetic peptide
STTERSG

SEQ ID NO: 3837 - protein, 7 aa, Artificial Sequence
  Description of Artificial Sequence: Synthetic peptide
SNGPSSG

SEQ ID NO: 3838 - protein, 7 aa, Artificial Sequence
  Description of Artificial Sequence: Synthetic peptide
TTNPSNS

SEQ ID NO: 3839 - protein, 7 aa, Artificial Sequence
  Description of Artificial Sequence: Synthetic peptide
ERQQQPV

SEQ ID NO: 3840 - protein, 7 aa, Artificial Sequence
  Description of Artificial Sequence: Synthetic peptide
GNGSPIT

SEQ ID NO: 3841 - protein, 7 aa, Artificial Sequence
  Description of Artificial Sequence: Synthetic peptide
NRGESVS

SEQ ID NO: 3842 - protein, 7 aa, Artificial Sequence
  Description of Artificial Sequence: Synthetic peptide
SSSAQHT

SEQ ID NO: 3843 - protein, 7 aa, Artificial Sequence
  Description of Artificial Sequence: Synthetic peptide
SATQAPS

SEQ ID NO: 3844 - protein, 7 aa, Artificial Sequence
  Description of Artificial Sequence: Synthetic peptide
NANAHAT

SEQ ID NO: 3845 - protein, 7 aa, Artificial Sequence
  Description of Artificial Sequence: Synthetic peptide
SSGSAPS

SEQ ID NO: 3846 - protein, 7 aa, Artificial Sequence
  Description of Artificial Sequence: Synthetic peptide
QPEGTNK

SEQ ID NO: 3847 - protein, 7 aa, Artificial Sequence
  Description of Artificial Sequence: Synthetic peptide
TLSDKPL

SEQ ID NO: 3848 - protein, 7 aa, Artificial Sequence
  Description of Artificial Sequence: Synthetic peptide
IGEKSNT

SEQ ID NO: 3849 - protein, 7 aa, Artificial Sequence
  Description of Artificial Sequence: Synthetic peptide
DPSKTNG

SEQ ID NO: 3850 - protein, 7 aa, Artificial Sequence
  Description of Artificial Sequence: Synthetic peptide
NGSSSGA

SEQ ID NO: 3851 - protein, 7 aa, Artificial Sequence
  Description of Artificial Sequence: Synthetic peptide
QAGNATA

SEQ ID NO: 3852 - protein, 7 aa, Artificial Sequence
  Description of Artificial Sequence: Synthetic peptide
DSSHTNK

SEQ ID NO: 3853 - protein, 7 aa, Artificial Sequence
  Description of Artificial Sequence: Synthetic peptide
AGGPTAT

SEQ ID NO: 3854 - protein, 7 aa, Artificial Sequence
  Description of Artificial Sequence: Synthetic peptide
QHGEMKG

SEQ ID NO: 3855 - protein, 7 aa, Artificial Sequence
  Description of Artificial Sequence: Synthetic peptide
QVDAGNR

SEQ ID NO: 3856 - protein, 7 aa, Artificial Sequence
  Description of Artificial Sequence: Synthetic peptide
VNNSATM

SEQ ID NO: 3857 - protein, 7 aa, Artificial Sequence
  Description of Artificial Sequence: Synthetic peptide
SNGAGTK

SEQ ID NO: 3858 - protein, 7 aa, Artificial Sequence
  Description of Artificial Sequence: Synthetic peptide
STSTKDS

SEQ ID NO: 3859 - protein, 7 aa, Artificial Sequence
  Description of Artificial Sequence: Synthetic peptide
GASDTNR

SEQ ID NO: 3860 - protein, 7 aa, Artificial Sequence
  Description of Artificial Sequence: Synthetic peptide
DGMGTTQ

SEQ ID NO: 3861 - protein, 7 aa, Artificial Sequence
  Description of Artificial Sequence: Synthetic peptide
SSANSPS

SEQ ID NO: 3862 - protein, 7 aa, Artificial Sequence
  Description of Artificial Sequence: Synthetic peptide
SAHKGES

SEQ ID NO: 3863 - protein, 7 aa, Artificial Sequence
  Description of Artificial Sequence: Synthetic peptide
HGSEKLS

SEQ ID NO: 3864 - protein, 7 aa, Artificial Sequence
  Description of Artificial Sequence: Synthetic peptide
TGGGSRE

SEQ ID NO: 3865 - protein, 7 aa, Artificial Sequence
  Description of Artificial Sequence: Synthetic peptide
SGIDKSL

SEQ ID NO: 3866 - protein, 7 aa, Artificial Sequence
  Description of Artificial Sequence: Synthetic peptide
DATKTTN

SEQ ID NO: 3867 - protein, 7 aa, Artificial Sequence
  Description of Artificial Sequence: Synthetic peptide
GTTGSPG

SEQ ID NO: 3868 - protein, 7 aa, Artificial Sequence
  Description of Artificial Sequence: Synthetic peptide
DVPGTKG

SEQ ID NO: 3869 - protein, 7 aa, Artificial Sequence
  Description of Artificial Sequence: Synthetic peptide
EVVKAGS

SEQ ID NO: 3870 - protein, 7 aa, Artificial Sequence
  Description of Artificial Sequence: Synthetic peptide
GQGSAAS

SEQ ID NO: 3871 - protein, 7 aa, Artificial Sequence
  Description of Artificial Sequence: Synthetic peptide
GDMKTSS

SEQ ID NO: 3872 - protein, 7 aa, Artificial Sequence
  Description of Artificial Sequence: Synthetic peptide
TSDSPGR

SEQ ID NO: 3873 - protein, 7 aa, Artificial Sequence
  Description of Artificial Sequence: Synthetic peptide
HASSSPT

SEQ ID NO: 3874 - protein, 7 aa, Artificial Sequence
  Description of Artificial Sequence: Synthetic peptide
ERATQSV

SEQ ID NO: 3875 - protein, 7 aa, Artificial Sequence
  Description of Artificial Sequence: Synthetic peptide
DPPEKTG

SEQ ID NO: 3876 - protein, 7 aa, Artificial Sequence
  Description of Artificial Sequence: Synthetic peptide
ETTGNKS

SEQ ID NO: 3877 - protein, 7 aa, Artificial Sequence
  Description of Artificial Sequence: Synthetic peptide
EGGSSRG

SEQ ID NO: 3878 - protein, 7 aa, Artificial Sequence
  Description of Artificial Sequence: Synthetic peptide
AMHATAG

SEQ ID NO: 3879 - protein, 7 aa, Artificial Sequence
  Description of Artificial Sequence: Synthetic peptide
GHTTKDA

SEQ ID NO: 3880 - protein, 7 aa, Artificial Sequence
  Description of Artificial Sequence: Synthetic peptide
SDVKGSN

SEQ ID NO: 3881 - protein, 7 aa, Artificial Sequence
  Description of Artificial Sequence: Synthetic peptide
GLATDTK

SEQ ID NO: 3882 - protein, 7 aa, Artificial Sequence
  Description of Artificial Sequence: Synthetic peptide
ETLSGAK

SEQ ID NO: 3883 - protein, 7 aa, Artificial Sequence
  Description of Artificial Sequence: Synthetic peptide
ISNGKLA

SEQ ID NO: 3884 - protein, 7 aa, Artificial Sequence
  Description of Artificial Sequence: Synthetic peptide
QTGQSAA

SEQ ID NO: 3885 - protein, 7 aa, Artificial Sequence
  Description of Artificial Sequence: Synthetic peptide
GSGKGNV

SEQ ID NO: 3886 - protein, 7 aa, Artificial Sequence
  Description of Artificial Sequence: Synthetic peptide
GNAGAST

SEQ ID NO: 3887 - protein, 7 aa, Artificial Sequence
  Description of Artificial Sequence: Synthetic peptide
STNTHGK

SEQ ID NO: 3888 - protein, 7 aa, Artificial Sequence
  Description of Artificial Sequence: Synthetic peptide
ETRKDAQ

SEQ ID NO: 3889 - protein, 7 aa, Artificial Sequence
  Description of Artificial Sequence: Synthetic peptide
GNKSESQ

SEQ ID NO: 3890 - protein, 7 aa, Artificial Sequence
  Description of Artificial Sequence: Synthetic peptide
LGDSSSK

SEQ ID NO: 3891 - protein, 7 aa, Artificial Sequence
  Description of Artificial Sequence: Synthetic peptide
GGNKADS

SEQ ID NO: 3892 - protein, 7 aa, Artificial Sequence
  Description of Artificial Sequence: Synthetic peptide
SSSGTTS

SEQ ID NO: 3893 - protein, 7 aa, Artificial Sequence
  Description of Artificial Sequence: Synthetic peptide
STGASAV

SEQ ID NO: 3894 - protein, 7 aa, Artificial Sequence
  Description of Artificial Sequence: Synthetic peptide
TGGTATS

SEQ ID NO: 3895 - protein, 7 aa, Artificial Sequence
  Description of Artificial Sequence: Synthetic peptide
LTGNSSP

SEQ ID NO: 3896 - protein, 7 aa, Artificial Sequence
  Description of Artificial Sequence: Synthetic peptide
FSENSVK

SEQ ID NO: 3897 - protein, 7 aa, Artificial Sequence
  Description of Artificial Sequence: Synthetic peptide
NAGATSN

SEQ ID NO: 3898 - protein, 7 aa, Artificial Sequence
  Description of Artificial Sequence: Synthetic peptide
MTNSNVK

SEQ ID NO: 3899 - protein, 7 aa, Artificial Sequence
  Description of Artificial Sequence: Synthetic peptide
SSDAHSK

SEQ ID NO: 3900 - protein, 7 aa, Artificial Sequence
  Description of Artificial Sequence: Synthetic peptide
GKGAGST

SEQ ID NO: 3901 - protein, 7 aa, Artificial Sequence
  Description of Artificial Sequence: Synthetic peptide
NTGSSDK

SEQ ID NO: 3902 - protein, 7 aa, Artificial Sequence
  Description of Artificial Sequence: Synthetic peptide
RNGGTSS

SEQ ID NO: 3903 - protein, 7 aa, Artificial Sequence
  Description of Artificial Sequence: Synthetic peptide
VSTGNNG

SEQ ID NO: 3904 - protein, 7 aa, Artificial Sequence
  Description of Artificial Sequence: Synthetic peptide
TDGPQRS

SEQ ID NO: 3905 - protein, 7 aa, Artificial Sequence
  Description of Artificial Sequence: Synthetic peptide
ANGTHTA

SEQ ID NO: 3906 - protein, 7 aa, Artificial Sequence
  Description of Artificial Sequence: Synthetic peptide
DRSRESV

SEQ ID NO: 3907 - protein, 7 aa, Artificial Sequence
  Description of Artificial Sequence: Synthetic peptide
NSVDKAS

SEQ ID NO: 3908 - protein, 7 aa, Artificial Sequence
  Description of Artificial Sequence: Synthetic peptide
VSGANSI

SEQ ID NO: 3909 - protein, 7 aa, Artificial Sequence
  Description of Artificial Sequence: Synthetic peptide
RSSPTSV

SEQ ID NO: 3910 - protein, 7 aa, Artificial Sequence
  Description of Artificial Sequence: Synthetic peptide
TRDTSSL

SEQ ID NO: 3911 - protein, 7 aa, Artificial Sequence
  Description of Artificial Sequence: Synthetic peptide
SLSSTNS

SEQ ID NO: 3912 - protein, 7 aa, Artificial Sequence
  Description of Artificial Sequence: Synthetic peptide
NADSSKL

SEQ ID NO: 3913 - protein, 7 aa, Artificial Sequence
  Description of Artificial Sequence: Synthetic peptide
RTGAQPG

SEQ ID NO: 3914 - protein, 7 aa, Artificial Sequence
  Description of Artificial Sequence: Synthetic peptide
SPGGDLK

SEQ ID NO: 3915 - protein, 7 aa, Artificial Sequence
  Description of Artificial Sequence: Synthetic peptide
HGATTPG

SEQ ID NO: 3916 - protein, 7 aa, Artificial Sequence
  Description of Artificial Sequence: Synthetic peptide
GPTMNDK

SEQ ID NO: 3917 - protein, 7 aa, Artificial Sequence
  Description of Artificial Sequence: Synthetic peptide
GSSQSGT

SEQ ID NO: 3918 - protein, 7 aa, Artificial Sequence
  Description of Artificial Sequence: Synthetic peptide
GDKKEMA

SEQ ID NO: 3919 - protein, 7 aa, Artificial Sequence
  Description of Artificial Sequence: Synthetic peptide
LQSKTGS

SEQ ID NO: 3920 - protein, 7 aa, Artificial Sequence
  Description of Artificial Sequence: Synthetic peptide
SPISKEG

SEQ ID NO: 3921 - protein, 7 aa, Artificial Sequence
  Description of Artificial Sequence: Synthetic peptide
RGTGSTT

SEQ ID NO: 3922 - protein, 7 aa, Artificial Sequence
  Description of Artificial Sequence: Synthetic peptide
ANSGTST

SEQ ID NO: 3923 - protein, 7 aa, Artificial Sequence
  Description of Artificial Sequence: Synthetic peptide
STGATAL

SEQ ID NO: 3924 - protein, 7 aa, Artificial Sequence
  Description of Artificial Sequence: Synthetic peptide
SGAPSVN

SEQ ID NO: 3925 - protein, 7 aa, Artificial Sequence
  Description of Artificial Sequence: Synthetic peptide
SVASQSQ

SEQ ID NO: 3926 - protein, 7 aa, Artificial Sequence
  Description of Artificial Sequence: Synthetic peptide
GHQGSSS

SEQ ID NO: 3927 - protein, 7 aa, Artificial Sequence
  Description of Artificial Sequence: Synthetic peptide
NSVDKAK

SEQ ID NO: 3928 - protein, 7 aa, Artificial Sequence
  Description of Artificial Sequence: Synthetic peptide
NTHANST

SEQ ID NO: 3929 - protein, 7 aa, Artificial Sequence
  Description of Artificial Sequence: Synthetic peptide
GQHQPLA

SEQ ID NO: 3930 - protein, 7 aa, Artificial Sequence
  Description of Artificial Sequence: Synthetic peptide
STKSSPS

SEQ ID NO: 3931 - protein, 7 aa, Artificial Sequence
  Description of Artificial Sequence: Synthetic peptide
DTSSTGK

SEQ ID NO: 3932 - protein, 7 aa, Artificial Sequence
  Description of Artificial Sequence: Synthetic peptide
VPSSNPK

SEQ ID NO: 3933 - protein, 7 aa, Artificial Sequence
  Description of Artificial Sequence: Synthetic peptide
TKNGHNS

SEQ ID NO: 3934 - protein, 7 aa, Artificial Sequence
  Description of Artificial Sequence: Synthetic peptide
ETGQKEG

SEQ ID NO: 3935 - protein, 7 aa, Artificial Sequence
  Description of Artificial Sequence: Synthetic peptide
GPNKDVH

SEQ ID NO: 3936 - protein, 7 aa, Artificial Sequence
  Description of Artificial Sequence: Synthetic peptide
GPGNGNG

SEQ ID NO: 3937 - protein, 7 aa, Artificial Sequence
  Description of Artificial Sequence: Synthetic peptide
SSQKTGS

SEQ ID NO: 3938 - protein, 7 aa, Artificial Sequence
  Description of Artificial Sequence: Synthetic peptide
NTDSSRS

SEQ ID NO: 3939 - protein, 7 aa, Artificial Sequence
  Description of Artificial Sequence: Synthetic peptide
HGESKNN

SEQ ID NO: 3940 - protein, 7 aa, Artificial Sequence
  Description of Artificial Sequence: Synthetic peptide
DGQSQNR

SEQ ID NO: 3941 - protein, 7 aa, Artificial Sequence
  Description of Artificial Sequence: Synthetic peptide
GEHKDSR

SEQ ID NO: 3942 - protein, 7 aa, Artificial Sequence
  Description of Artificial Sequence: Synthetic peptide
GEVTGRT

SEQ ID NO: 3943 - protein, 7 aa, Artificial Sequence
  Description of Artificial Sequence: Synthetic peptide
DGAATKN

SEQ ID NO: 3944 - protein, 7 aa, Artificial Sequence
  Description of Artificial Sequence: Synthetic peptide
HRDTESK

SEQ ID NO: 3945 - protein, 7 aa, Artificial Sequence
  Description of Artificial Sequence: Synthetic peptide
TSGDRTG

SEQ ID NO: 3946 - protein, 7 aa, Artificial Sequence
  Description of Artificial Sequence: Synthetic peptide
SVGEARS

SEQ ID NO: 3947 - protein, 7 aa, Artificial Sequence
  Description of Artificial Sequence: Synthetic peptide
QSNTSTG

SEQ ID NO: 3948 - protein, 7 aa, Artificial Sequence
  Description of Artificial Sequence: Synthetic peptide
EKQSTSV

SEQ ID NO: 3949 - protein, 7 aa, Artificial Sequence
  Description of Artificial Sequence: Synthetic peptide
EPTKSAS

SEQ ID NO: 3950 - protein, 7 aa, Artificial Sequence
  Description of Artificial Sequence: Synthetic peptide
SPIPNKG

SEQ ID NO: 3951 - protein, 7 aa, Artificial Sequence
  Description of Artificial Sequence: Synthetic peptide
ATTRNNS

SEQ ID NO: 3952 - protein, 7 aa, Artificial Sequence
  Description of Artificial Sequence: Synthetic peptide
ASSQSAK

SEQ ID NO: 3953 - protein, 7 aa, Artificial Sequence
  Description of Artificial Sequence: Synthetic peptide
QGVSSST

SEQ ID NO: 3954 - protein, 7 aa, Artificial Sequence
  Description of Artificial Sequence: Synthetic peptide
GNNKVNS

SEQ ID NO: 3955 - protein, 7 aa, Artificial Sequence
  Description of Artificial Sequence: Synthetic peptide
EGNSPIR

SEQ ID NO: 3956 - protein, 7 aa, Artificial Sequence
  Description of Artificial Sequence: Synthetic peptide
SGGKQGI

SEQ ID NO: 3957 - protein, 7 aa, Artificial Sequence
  Description of Artificial Sequence: Synthetic peptide
DKTKGGQ

SEQ ID NO: 3958 - protein, 7 aa, Artificial Sequence
  Description of Artificial Sequence: Synthetic peptide
TAATSTS

SEQ ID NO: 3959 - protein, 7 aa, Artificial Sequence
  Description of Artificial Sequence: Synthetic peptide
HQANSTH

SEQ ID NO: 3960 - protein, 7 aa, Artificial Sequence
  Description of Artificial Sequence: Synthetic peptide
TGSGNPV

SEQ ID NO: 3961 - protein, 7 aa, Artificial Sequence
  Description of Artificial Sequence: Synthetic peptide
VESKGTQ

SEQ ID NO: 3962 - protein, 7 aa, Artificial Sequence
  Description of Artificial Sequence: Synthetic peptide
GKQGSNA

SEQ ID NO: 3963 - protein, 7 aa, Artificial Sequence
  Description of Artificial Sequence: Synthetic peptide
QRNEKAS

SEQ ID NO: 3964 - protein, 7 aa, Artificial Sequence
  Description of Artificial Sequence: Synthetic peptide
QSKDSQQ

SEQ ID NO: 3965 - protein, 7 aa, Artificial Sequence
  Description of Artificial Sequence: Synthetic peptide
TTGSSPG

SEQ ID NO: 3966 - protein, 7 aa, Artificial Sequence
  Description of Artificial Sequence: Synthetic peptide
SGAGGTT

SEQ ID NO: 3967 - protein, 7 aa, Artificial Sequence
  Description of Artificial Sequence: Synthetic peptide
LTSGKES

SEQ ID NO: 3968 - protein, 7 aa, Artificial Sequence
  Description of Artificial Sequence: Synthetic peptide
ERSVSTQ

SEQ ID NO: 3969 - protein, 7 aa, Artificial Sequence
  Description of Artificial Sequence: Synthetic peptide
GGTTNGN

SEQ ID NO: 3970 - protein, 7 aa, Artificial Sequence
  Description of Artificial Sequence: Synthetic peptide
STSSTNS

SEQ ID NO: 3971 - protein, 7 aa, Artificial Sequence
  Description of Artificial Sequence: Synthetic peptide
DSQTPLR

SEQ ID NO: 3972 - protein, 7 aa, Artificial Sequence
  Description of Artificial Sequence: Synthetic peptide
VGGSSNK

SEQ ID NO: 3973 - protein, 7 aa, Artificial Sequence
  Description of Artificial Sequence: Synthetic peptide
SSKPSSV

SEQ ID NO: 3974 - protein, 7 aa, Artificial Sequence
  Description of Artificial Sequence: Synthetic peptide
QGVTSSS

SEQ ID NO: 3975 - protein, 7 aa, Artificial Sequence
  Description of Artificial Sequence: Synthetic peptide
DSSKSGV

SEQ ID NO: 3976 - protein, 7 aa, Artificial Sequence
  Description of Artificial Sequence: Synthetic peptide
MGSSGNK

SEQ ID NO: 3977 - protein, 7 aa, Artificial Sequence
  Description of Artificial Sequence: Synthetic peptide
NSKTGVA

SEQ ID NO: 3978 - protein, 7 aa, Artificial Sequence
  Description of Artificial Sequence: Synthetic peptide
AGSSTST

SEQ ID NO: 3979 - protein, 7 aa, Artificial Sequence
  Description of Artificial Sequence: Synthetic peptide
GSGSSAH

SEQ ID NO: 3980 - protein, 7 aa, Artificial Sequence
  Description of Artificial Sequence: Synthetic peptide
STSQSSS

SEQ ID NO: 3981 - protein, 7 aa, Artificial Sequence
  Description of Artificial Sequence: Synthetic peptide
DNAKSSA

SEQ ID NO: 3982 - protein, 7 aa, Artificial Sequence
  Description of Artificial Sequence: Synthetic peptide
GKQGQSS

SEQ ID NO: 3983 - protein, 7 aa, Artificial Sequence
  Description of Artificial Sequence: Synthetic peptide
ASTKANT

SEQ ID NO: 3984 - protein, 7 aa, Artificial Sequence
  Description of Artificial Sequence: Synthetic peptide
SRNGEAA

SEQ ID NO: 3985 - protein, 7 aa, Artificial Sequence
  Description of Artificial Sequence: Synthetic peptide
NVSSSPT

SEQ ID NO: 3986 - protein, 7 aa, Artificial Sequence
  Description of Artificial Sequence: Synthetic peptide
SSTSQPG

SEQ ID NO: 3987 - protein, 7 aa, Artificial Sequence
  Description of Artificial Sequence: Synthetic peptide
GFGVKPE

SEQ ID NO: 3988 - protein, 7 aa, Artificial Sequence
  Description of Artificial Sequence: Synthetic peptide
QSASTQV

SEQ ID NO: 3989 - protein, 7 aa, Artificial Sequence
  Description of Artificial Sequence: Synthetic peptide
AGSSPIV

SEQ ID NO: 3990 - protein, 7 aa, Artificial Sequence
  Description of Artificial Sequence: Synthetic peptide
GTGGKAA

SEQ ID NO: 3991 - protein, 7 aa, Artificial Sequence
  Description of Artificial Sequence: Synthetic peptide
TGQGGGS

SEQ ID NO: 3992 - protein, 7 aa, Artificial Sequence
  Description of Artificial Sequence: Synthetic peptide
LGSTEKH

SEQ ID NO: 3993 - protein, 7 aa, Artificial Sequence
  Description of Artificial Sequence: Synthetic peptide
GGNQASS

SEQ ID NO: 3994 - protein, 7 aa, Artificial Sequence
  Description of Artificial Sequence: Synthetic peptide
GSKQTSV

SEQ ID NO: 3995 - protein, 7 aa, Artificial Sequence
  Description of Artificial Sequence: Synthetic peptide
VNDGHPK

SEQ ID NO: 3996 - protein, 7 aa, Artificial Sequence
  Description of Artificial Sequence: Synthetic peptide
SNGTSTN

SEQ ID NO: 3997 - protein, 7 aa, Artificial Sequence
  Description of Artificial Sequence: Synthetic peptide
SPQGNGG

SEQ ID NO: 3998 - protein, 7 aa, Artificial Sequence
  Description of Artificial Sequence: Synthetic peptide
LSHKSSE

SEQ ID NO: 3999 - protein, 7 aa, Artificial Sequence
  Description of Artificial Sequence: Synthetic peptide
SPSTKSN

SEQ ID NO: 4000 - protein, 7 aa, Artificial Sequence
  Description of Artificial Sequence: Synthetic peptide
ERNSGTT

SEQ ID NO: 4001 - protein, 7 aa, Artificial Sequence
  Description of Artificial Sequence: Synthetic peptide
GNGQSQT

SEQ ID NO: 4002 - protein, 7 aa, Artificial Sequence
  Description of Artificial Sequence: Synthetic peptide
SSGSKME

SEQ ID NO: 4003 - protein, 7 aa, Artificial Sequence
  Description of Artificial Sequence: Synthetic peptide
TQGSDKV

SEQ ID NO: 4004 - protein, 7 aa, Artificial Sequence
  Description of Artificial Sequence: Synthetic peptide
DSIKAAS

SEQ ID NO: 4005 - protein, 7 aa, Artificial Sequence
  Description of Artificial Sequence: Synthetic peptide
ENKASTQ

SEQ ID NO: 4006 - protein, 7 aa, Artificial Sequence
  Description of Artificial Sequence: Synthetic peptide
EAVTPVR

SEQ ID NO: 4007 - protein, 7 aa, Artificial Sequence
  Description of Artificial Sequence: Synthetic peptide
SASSKGS

SEQ ID NO: 4008 - protein, 7 aa, Artificial Sequence
  Description of Artificial Sequence: Synthetic peptide
NQTASPT

SEQ ID NO: 4009 - protein, 7 aa, Artificial Sequence
  Description of Artificial Sequence: Synthetic peptide
EGKGQSN

SEQ ID NO: 4010 - protein, 7 aa, Artificial Sequence
  Description of Artificial Sequence: Synthetic peptide
GTNAGSG

SEQ ID NO: 4011 - protein, 7 aa, Artificial Sequence
  Description of Artificial Sequence: Synthetic peptide
TTTKSTE

SEQ ID NO: 4012 - protein, 7 aa, Artificial Sequence
  Description of Artificial Sequence: Synthetic peptide
ESKPSNL

SEQ ID NO: 4013 - protein, 7 aa, Artificial Sequence
  Description of Artificial Sequence: Synthetic peptide
STGGSSS

SEQ ID NO: 4014 - protein, 7 aa, Artificial Sequence
  Description of Artificial Sequence: Synthetic peptide
DQSQAVK

SEQ ID NO: 4015 - protein, 7 aa, Artificial Sequence
  Description of Artificial Sequence: Synthetic peptide
GSNPSSG

SEQ ID NO: 4016 - protein, 7 aa, Artificial Sequence
  Description of Artificial Sequence: Synthetic peptide
GVTDSSK

SEQ ID NO: 4017 - protein, 7 aa, Artificial Sequence
  Description of Artificial Sequence: Synthetic peptide
STTGDAK

SEQ ID NO: 4018 - protein, 7 aa, Artificial Sequence
  Description of Artificial Sequence: Synthetic peptide
DPSSKKE

SEQ ID NO: 4019 - protein, 7 aa, Artificial Sequence
  Description of Artificial Sequence: Synthetic peptide
GSTGEQR

SEQ ID NO: 4020 - protein, 7 aa, Artificial Sequence
  Description of Artificial Sequence: Synthetic peptide
VNSERSA

SEQ ID NO: 4021 - protein, 7 aa, Artificial Sequence
  Description of Artificial Sequence: Synthetic peptide
GNGSSMS

SEQ ID NO: 4022 - protein, 7 aa, Artificial Sequence
  Description of Artificial Sequence: Synthetic peptide
TGTNNAN

SEQ ID NO: 4023 - protein, 7 aa, Artificial Sequence
  Description of Artificial Sequence: Synthetic peptide
ISGQQPT

SEQ ID NO: 4024 - protein, 7 aa, Artificial Sequence
  Description of Artificial Sequence: Synthetic peptide
QGDSSLK

SEQ ID NO: 4025 - protein, 7 aa, Artificial Sequence
  Description of Artificial Sequence: Synthetic peptide
TQTATAN

SEQ ID NO: 4026 - protein, 7 aa, Artificial Sequence
  Description of Artificial Sequence: Synthetic peptide
SPHGDKS

SEQ ID NO: 4027 - protein, 7 aa, Artificial Sequence
  Description of Artificial Sequence: Synthetic peptide
SGATPAL

SEQ ID NO: 4028 - protein, 7 aa, Artificial Sequence
  Description of Artificial Sequence: Synthetic peptide
DSLSSSK

SEQ ID NO: 4029 - protein, 7 aa, Artificial Sequence
  Description of Artificial Sequence: Synthetic peptide
GTASDKQ

SEQ ID NO: 4030 - protein, 7 aa, Artificial Sequence
  Description of Artificial Sequence: Synthetic peptide
SVNKTGG

SEQ ID NO: 4031 - protein, 7 aa, Artificial Sequence
  Description of Artificial Sequence: Synthetic peptide
SRDAKVS

SEQ ID NO: 4032 - protein, 7 aa, Artificial Sequence
  Description of Artificial Sequence: Synthetic peptide
TGSTTTL

SEQ ID NO: 4033 - protein, 7 aa, Artificial Sequence
  Description of Artificial Sequence: Synthetic peptide
TSETKFG

SEQ ID NO: 4034 - protein, 7 aa, Artificial Sequence
  Description of Artificial Sequence: Synthetic peptide
QGGSSVS

SEQ ID NO: 4035 - protein, 7 aa, Artificial Sequence
  Description of Artificial Sequence: Synthetic peptide
TKEQTAQ

SEQ ID NO: 4036 - protein, 7 aa, Artificial Sequence
  Description of Artificial Sequence: Synthetic peptide
STGKSVT

SEQ ID NO: 4037 - protein, 7 aa, Artificial Sequence
  Description of Artificial Sequence: Synthetic peptide
LSSSTVP

SEQ ID NO: 4038 - protein, 7 aa, Artificial Sequence
  Description of Artificial Sequence: Synthetic peptide
VGTTAGK

SEQ ID NO: 4039 - protein, 7 aa, Artificial Sequence
  Description of Artificial Sequence: Synthetic peptide
GLSSSKE

SEQ ID NO: 4040 - protein, 7 aa, Artificial Sequence
  Description of Artificial Sequence: Synthetic peptide
TGVKEIV

SEQ ID NO: 4041 - protein, 7 aa, Artificial Sequence
  Description of Artificial Sequence: Synthetic peptide
QGATTGT

SEQ ID NO: 4042 - protein, 7 aa, Artificial Sequence
  Description of Artificial Sequence: Synthetic peptide
GSSATDR

SEQ ID NO: 4043 - protein, 7 aa, Artificial Sequence
  Description of Artificial Sequence: Synthetic peptide
NTGTPKN

SEQ ID NO: 4044 - protein, 7 aa, Artificial Sequence
  Description of Artificial Sequence: Synthetic peptide
HTSSNGG

SEQ ID NO: 4045 - protein, 7 aa, Artificial Sequence
  Description of Artificial Sequence: Synthetic peptide
STSTGST

SEQ ID NO: 4046 - protein, 7 aa, Artificial Sequence
  Description of Artificial Sequence: Synthetic peptide
FGEGSVK

SEQ ID NO: 4047 - protein, 7 aa, Artificial Sequence
  Description of Artificial Sequence: Synthetic peptide
DNSVKNQ

SEQ ID NO: 4048 - protein, 7 aa, Artificial Sequence
  Description of Artificial Sequence: Synthetic peptide
SSAKASL

SEQ ID NO: 4049 - protein, 7 aa, Artificial Sequence
  Description of Artificial Sequence: Synthetic peptide
AATSSNT

SEQ ID NO: 4050 - protein, 7 aa, Artificial Sequence
  Description of Artificial Sequence: Synthetic peptide
GTSTRSE

SEQ ID NO: 4051 - protein, 7 aa, Artificial Sequence
  Description of Artificial Sequence: Synthetic peptide
TTDAKTV

SEQ ID NO: 4052 - protein, 7 aa, Artificial Sequence
  Description of Artificial Sequence: Synthetic peptide
STTAPSR

SEQ ID NO: 4053 - protein, 7 aa, Artificial Sequence
  Description of Artificial Sequence: Synthetic peptide
ASDGAGR

SEQ ID NO: 4054 - protein, 7 aa, Artificial Sequence
  Description of Artificial Sequence: Synthetic peptide
DSNKTGP

SEQ ID NO: 4055 - protein, 7 aa, Artificial Sequence
  Description of Artificial Sequence: Synthetic peptide
GSLDNKG

SEQ ID NO: 4056 - protein, 7 aa, Artificial Sequence
  Description of Artificial Sequence: Synthetic peptide
SQASANT

SEQ ID NO: 4057 - protein, 7 aa, Artificial Sequence
  Description of Artificial Sequence: Synthetic peptide
DGKGSGN

SEQ ID NO: 4058 - protein, 7 aa, Artificial Sequence
  Description of Artificial Sequence: Synthetic peptide
SGTSSSG

SEQ ID NO: 4059 - protein, 7 aa, Artificial Sequence
  Description of Artificial Sequence: Synthetic peptide
VTGSNGG

SEQ ID NO: 4060 - protein, 7 aa, Artificial Sequence
  Description of Artificial Sequence: Synthetic peptide
SNSTSGS

SEQ ID NO: 4061 - protein, 7 aa, Artificial Sequence
  Description of Artificial Sequence: Synthetic peptide
SGSKTSS

SEQ ID NO: 4062 - protein, 7 aa, Artificial Sequence
  Description of Artificial Sequence: Synthetic peptide
SDAGKQV

SEQ ID NO: 4063 - protein, 7 aa, Artificial Sequence
  Description of Artificial Sequence: Synthetic peptide
SSNTPSS

SEQ ID NO: 4064 - protein, 7 aa, Artificial Sequence
  Description of Artificial Sequence: Synthetic peptide
LAESKTM

SEQ ID NO: 4065 - protein, 7 aa, Artificial Sequence
  Description of Artificial Sequence: Synthetic peptide
GTTGDIK

SEQ ID NO: 4066 - protein, 7 aa, Artificial Sequence
  Description of Artificial Sequence: Synthetic peptide
AGTERSM

SEQ ID NO: 4067 - protein, 7 aa, Artificial Sequence
  Description of Artificial Sequence: Synthetic peptide
VSGSTPT

SEQ ID NO: 4068 - protein, 7 aa, Artificial Sequence
  Description of Artificial Sequence: Synthetic peptide
MNNGKVS

SEQ ID NO: 4069 - protein, 7 aa, Artificial Sequence
  Description of Artificial Sequence: Synthetic peptide
TGKDTMV

SEQ ID NO: 4070 - protein, 7 aa, Artificial Sequence
  Description of Artificial Sequence: Synthetic peptide
MVAGNKG

SEQ ID NO: 4071 - protein, 7 aa, Artificial Sequence
  Description of Artificial Sequence: Synthetic peptide
GADSVTK

SEQ ID NO: 4072 - protein, 7 aa, Artificial Sequence
  Description of Artificial Sequence: Synthetic peptide
TQSASTA

SEQ ID NO: 4073 - protein, 7 aa, Artificial Sequence
  Description of Artificial Sequence: Synthetic peptide
DRTNAPS

SEQ ID NO: 4074 - protein, 7 aa, Artificial Sequence
  Description of Artificial Sequence: Synthetic peptide
TSSTTSG

SEQ ID NO: 4075 - protein, 7 aa, Artificial Sequence
  Description of Artificial Sequence: Synthetic peptide
VRGKEPM

SEQ ID NO: 4076 - protein, 7 aa, Artificial Sequence
  Description of Artificial Sequence: Synthetic peptide
DAARTNV

SEQ ID NO: 4077 - protein, 7 aa, Artificial Sequence
  Description of Artificial Sequence: Synthetic peptide
EKVTSSG

SEQ ID NO: 4078 - protein, 7 aa, Artificial Sequence
  Description of Artificial Sequence: Synthetic peptide
DGISSNH

SEQ ID NO: 4079 - protein, 7 aa, Artificial Sequence
  Description of Artificial Sequence: Synthetic peptide
SGNQQSN

SEQ ID NO: 4080 - protein, 7 aa, Artificial Sequence
  Description of Artificial Sequence: Synthetic peptide
GGVSNSI

SEQ ID NO: 4081 - protein, 7 aa, Artificial Sequence
  Description of Artificial Sequence: Synthetic peptide
GINGKDG

SEQ ID NO: 4082 - protein, 7 aa, Artificial Sequence
  Description of Artificial Sequence: Synthetic peptide
SSADPKS

SEQ ID NO: 4083 - protein, 7 aa, Artificial Sequence
  Description of Artificial Sequence: Synthetic peptide
NGQSVNS

SEQ ID NO: 4084 - protein, 7 aa, Artificial Sequence
  Description of Artificial Sequence: Synthetic peptide
AVSEKSG

SEQ ID NO: 4085 - protein, 7 aa, Artificial Sequence
  Description of Artificial Sequence: Synthetic peptide
SSQTSNV

SEQ ID NO: 4086 - protein, 7 aa, Artificial Sequence
  Description of Artificial Sequence: Synthetic peptide
LQSTKGS

SEQ ID NO: 4087 - protein, 7 aa, Artificial Sequence
  Description of Artificial Sequence: Synthetic peptide
SNDDKPR

SEQ ID NO: 4088 - protein, 7 aa, Artificial Sequence
  Description of Artificial Sequence: Synthetic peptide
QGNSAMT

SEQ ID NO: 4089 - protein, 7 aa, Artificial Sequence
  Description of Artificial Sequence: Synthetic peptide
HSDSTQK

SEQ ID NO: 4090 - protein, 7 aa, Artificial Sequence
  Description of Artificial Sequence: Synthetic peptide
SQKPSPQ

SEQ ID NO: 4091 - protein, 7 aa, Artificial Sequence
  Description of Artificial Sequence: Synthetic peptide
DGLQTTR

SEQ ID NO: 4092 - protein, 7 aa, Artificial Sequence
  Description of Artificial Sequence: Synthetic peptide
SAHDKTN

SEQ ID NO: 4093 - protein, 7 aa, Artificial Sequence
  Description of Artificial Sequence: Synthetic peptide
MGGSTQQ

SEQ ID NO: 4094 - protein, 7 aa, Artificial Sequence
  Description of Artificial Sequence: Synthetic peptide
GVTGSKA

SEQ ID NO: 4095 - protein, 7 aa, Artificial Sequence
  Description of Artificial Sequence: Synthetic peptide
REGQTSM

SEQ ID NO: 4096 - protein, 7 aa, Artificial Sequence
  Description of Artificial Sequence: Synthetic peptide
SKSTNLA

SEQ ID NO: 4097 - protein, 7 aa, Artificial Sequence
  Description of Artificial Sequence: Synthetic peptide
SSGSSVK

SEQ ID NO: 4098 - protein, 7 aa, Artificial Sequence
  Description of Artificial Sequence: Synthetic peptide
NAANPPG

SEQ ID NO: 4099 - protein, 7 aa, Artificial Sequence
  Description of Artificial Sequence: Synthetic peptide
NSTPGSG

SEQ ID NO: 4100 - protein, 7 aa, Artificial Sequence
  Description of Artificial Sequence: Synthetic peptide
TVAPKTG

SEQ ID NO: 4101 - protein, 7 aa, Artificial Sequence
  Description of Artificial Sequence: Synthetic peptide
TQNQSLG

SEQ ID NO: 4102 - protein, 7 aa, Artificial Sequence
  Description of Artificial Sequence: Synthetic peptide
SKEEKNS

SEQ ID NO: 4103 - protein, 7 aa, Artificial Sequence
  Description of Artificial Sequence: Synthetic peptide
SSESKSA

SEQ ID NO: 4104 - protein, 7 aa, Artificial Sequence
  Description of Artificial Sequence: Synthetic peptide
SVEPKVQ

SEQ ID NO: 4105 - protein, 7 aa, Artificial Sequence
  Description of Artificial Sequence: Synthetic peptide
SMEARNA

SEQ ID NO: 4106 - protein, 7 aa, Artificial Sequence
  Description of Artificial Sequence: Synthetic peptide
QGGNHSG

SEQ ID NO: 4107 - protein, 7 aa, Artificial Sequence
  Description of Artificial Sequence: Synthetic peptide
LASKDAG

SEQ ID NO: 4108 - protein, 7 aa, Artificial Sequence
  Description of Artificial Sequence: Synthetic peptide
DSTSGKR

SEQ ID NO: 4109 - protein, 7 aa, Artificial Sequence
  Description of Artificial Sequence: Synthetic peptide
AHTSSPG

SEQ ID NO: 4110 - protein, 7 aa, Artificial Sequence
  Description of Artificial Sequence: Synthetic peptide
ADHKTSG

SEQ ID NO: 4111 - protein, 7 aa, Artificial Sequence
  Description of Artificial Sequence: Synthetic peptide
GTGEPRS

SEQ ID NO: 4112 - protein, 7 aa, Artificial Sequence
  Description of Artificial Sequence: Synthetic peptide
GKGGVNP

SEQ ID NO: 4113 - protein, 7 aa, Artificial Sequence
  Description of Artificial Sequence: Synthetic peptide
GMDSKRL

SEQ ID NO: 4114 - protein, 7 aa, Artificial Sequence
  Description of Artificial Sequence: Synthetic peptide
GPAGNTV

SEQ ID NO: 4115 - protein, 7 aa, Artificial Sequence
  Description of Artificial Sequence: Synthetic peptide
TVGTPVS

SEQ ID NO: 4116 - protein, 7 aa, Artificial Sequence
  Description of Artificial Sequence: Synthetic peptide
LSEKSSS

SEQ ID NO: 4117 - protein, 7 aa, Artificial Sequence
  Description of Artificial Sequence: Synthetic peptide
DTNGKAT

SEQ ID NO: 4118 - protein, 7 aa, Artificial Sequence
  Description of Artificial Sequence: Synthetic peptide
GLTKSTG

SEQ ID NO: 4119 - protein, 7 aa, Artificial Sequence
  Description of Artificial Sequence: Synthetic peptide
TNSTHAA

SEQ ID NO: 4120 - protein, 7 aa, Artificial Sequence
  Description of Artificial Sequence: Synthetic peptide
TSERAPG

SEQ ID NO: 4121 - protein, 7 aa, Artificial Sequence
  Description of Artificial Sequence: Synthetic peptide
TSSNTPM

SEQ ID NO: 4122 - protein, 7 aa, Artificial Sequence
  Description of Artificial Sequence: Synthetic peptide
SKGSGAG

SEQ ID NO: 4123 - protein, 7 aa, Artificial Sequence
  Description of Artificial Sequence: Synthetic peptide
STTGATG

SEQ ID NO: 4124 - protein, 7 aa, Artificial Sequence
  Description of Artificial Sequence: Synthetic peptide
SPAAGHN

SEQ ID NO: 4125 - protein, 7 aa, Artificial Sequence
  Description of Artificial Sequence: Synthetic peptide
GASKPGH

SEQ ID NO: 4126 - protein, 7 aa, Artificial Sequence
  Description of Artificial Sequence: Synthetic peptide
SANKPAG

SEQ ID NO: 4127 - protein, 7 aa, Artificial Sequence
  Description of Artificial Sequence: Synthetic peptide
GPVGSAT

SEQ ID NO: 4128 - protein, 7 aa, Artificial Sequence
  Description of Artificial Sequence: Synthetic peptide
EGSSTVR

SEQ ID NO: 4129 - protein, 7 aa, Artificial Sequence
  Description of Artificial Sequence: Synthetic peptide
ANSSSAT

SEQ ID NO: 4130 - protein, 7 aa, Artificial Sequence
  Description of Artificial Sequence: Synthetic peptide
VSGASTA

SEQ ID NO: 4131 - protein, 7 aa, Artificial Sequence
  Description of Artificial Sequence: Synthetic peptide
GSSSPAH

SEQ ID NO: 4132 - protein, 7 aa, Artificial Sequence
  Description of Artificial Sequence: Synthetic peptide
MSGTGSS

SEQ ID NO: 4133 - protein, 7 aa, Artificial Sequence
  Description of Artificial Sequence: Synthetic peptide
HTGGSPS

SEQ ID NO: 4134 - protein, 7 aa, Artificial Sequence
  Description of Artificial Sequence: Synthetic peptide
SKQNGVT

SEQ ID NO: 4135 - protein, 7 aa, Artificial Sequence
  Description of Artificial Sequence: Synthetic peptide
ESMDKAR

SEQ ID NO: 4136 - protein, 7 aa, Artificial Sequence
  Description of Artificial Sequence: Synthetic peptide
LRETSSH

SEQ ID NO: 4137 - protein, 7 aa, Artificial Sequence
  Description of Artificial Sequence: Synthetic peptide
ERADRSI

SEQ ID NO: 4138 - protein, 7 aa, Artificial Sequence
  Description of Artificial Sequence: Synthetic peptide
RSESKGG

SEQ ID NO: 4139 - protein, 7 aa, Artificial Sequence
  Description of Artificial Sequence: Synthetic peptide
EHSSASG

SEQ ID NO: 4140 - protein, 7 aa, Artificial Sequence
  Description of Artificial Sequence: Synthetic peptide
AHSKENM

SEQ ID NO: 4141 - protein, 7 aa, Artificial Sequence
  Description of Artificial Sequence: Synthetic peptide
GINNKAG

SEQ ID NO: 4142 - protein, 7 aa, Artificial Sequence
  Description of Artificial Sequence: Synthetic peptide
GTASGAQ

SEQ ID NO: 4143 - protein, 7 aa, Artificial Sequence
  Description of Artificial Sequence: Synthetic peptide
STNSSSH

SEQ ID NO: 4144 - protein, 7 aa, Artificial Sequence
  Description of Artificial Sequence: Synthetic peptide
TQTNSSS

SEQ ID NO: 4145 - protein, 7 aa, Artificial Sequence
  Description of Artificial Sequence: Synthetic peptide
ESSQPPR

SEQ ID NO: 4146 - protein, 7 aa, Artificial Sequence
  Description of Artificial Sequence: Synthetic peptide
ERNSSPT

SEQ ID NO: 4147 - protein, 7 aa, Artificial Sequence
  Description of Artificial Sequence: Synthetic peptide
SLDNKSG

SEQ ID NO: 4148 - protein, 7 aa, Artificial Sequence
  Description of Artificial Sequence: Synthetic peptide
DNGHKML

SEQ ID NO: 4149 - protein, 7 aa, Artificial Sequence
  Description of Artificial Sequence: Synthetic peptide
EGKSNDG

SEQ ID NO: 4150 - protein, 7 aa, Artificial Sequence
  Description of Artificial Sequence: Synthetic peptide
QTSSGSG

SEQ ID NO: 4151 - protein, 7 aa, Artificial Sequence
  Description of Artificial Sequence: Synthetic peptide
GSGQTSS

SEQ ID NO: 4152 - protein, 7 aa, Artificial Sequence
  Description of Artificial Sequence: Synthetic peptide
SIPTGSG

SEQ ID NO: 4153 - protein, 7 aa, Artificial Sequence
  Description of Artificial Sequence: Synthetic peptide
SQGSKDS

SEQ ID NO: 4154 - protein, 7 aa, Artificial Sequence
  Description of Artificial Sequence: Synthetic peptide
ASDSPSR

SEQ ID NO: 4155 - protein, 7 aa, Artificial Sequence
  Description of Artificial Sequence: Synthetic peptide
EKVSSVG

SEQ ID NO: 4156 - protein, 7 aa, Artificial Sequence
  Description of Artificial Sequence: Synthetic peptide
GEGARLS

SEQ ID NO: 4157 - protein, 7 aa, Artificial Sequence
  Description of Artificial Sequence: Synthetic peptide
GAGTRTE

SEQ ID NO: 4158 - protein, 7 aa, Artificial Sequence
  Description of Artificial Sequence: Synthetic peptide
GKENGAQ

SEQ ID NO: 4159 - protein, 7 aa, Artificial Sequence
  Description of Artificial Sequence: Synthetic peptide
NRQPKQE

SEQ ID NO: 4160 - protein, 7 aa, Artificial Sequence
  Description of Artificial Sequence: Synthetic peptide
NTAASNT

SEQ ID NO: 4161 - protein, 7 aa, Artificial Sequence
  Description of Artificial Sequence: Synthetic peptide
TRQTKVE

SEQ ID NO: 4162 - protein, 7 aa, Artificial Sequence
  Description of Artificial Sequence: Synthetic peptide
SLSTAPT

SEQ ID NO: 4163 - protein, 7 aa, Artificial Sequence
  Description of Artificial Sequence: Synthetic peptide
DQSSKTN

SEQ ID NO: 4164 - protein, 7 aa, Artificial Sequence
  Description of Artificial Sequence: Synthetic peptide
TAASSTS

SEQ ID NO: 4165 - protein, 7 aa, Artificial Sequence
  Description of Artificial Sequence: Synthetic peptide
MGSPSAS

SEQ ID NO: 4166 - protein, 7 aa, Artificial Sequence
  Description of Artificial Sequence: Synthetic peptide
LQSTAPS

SEQ ID NO: 4167 - protein, 7 aa, Artificial Sequence
  Description of Artificial Sequence: Synthetic peptide
NHGSPGV

SEQ ID NO: 4168 - protein, 7 aa, Artificial Sequence
  Description of Artificial Sequence: Synthetic peptide
GSGTSMN

SEQ ID NO: 4169 - protein, 7 aa, Artificial Sequence
  Description of Artificial Sequence: Synthetic peptide
TGTSSVA

SEQ ID NO: 4170 - protein, 7 aa, Artificial Sequence
  Description of Artificial Sequence: Synthetic peptide
DAKGGAG

SEQ ID NO: 4171 - protein, 7 aa, Artificial Sequence
  Description of Artificial Sequence: Synthetic peptide
TGSSTAH

SEQ ID NO: 4172 - protein, 7 aa, Artificial Sequence
  Description of Artificial Sequence: Synthetic peptide
TTGSGNL

SEQ ID NO: 4173 - protein, 7 aa, Artificial Sequence
  Description of Artificial Sequence: Synthetic peptide
STAQTSV

SEQ ID NO: 4174 - protein, 7 aa, Artificial Sequence
  Description of Artificial Sequence: Synthetic peptide
SGNDNRN

SEQ ID NO: 4175 - protein, 7 aa, Artificial Sequence
  Description of Artificial Sequence: Synthetic peptide
TLNGKAV

SEQ ID NO: 4176 - protein, 7 aa, Artificial Sequence
  Description of Artificial Sequence: Synthetic peptide
AEPGNKM

SEQ ID NO: 4177 - protein, 7 aa, Artificial Sequence
  Description of Artificial Sequence: Synthetic peptide
NTSNGSQ

SEQ ID NO: 4178 - protein, 7 aa, Artificial Sequence
  Description of Artificial Sequence: Synthetic peptide
QSNTAHS

SEQ ID NO: 4179 - protein, 7 aa, Artificial Sequence
  Description of Artificial Sequence: Synthetic peptide
KTATSST

SEQ ID NO: 4180 - protein, 7 aa, Artificial Sequence
  Description of Artificial Sequence: Synthetic peptide
VSGTSNV

SEQ ID NO: 4181 - protein, 7 aa, Artificial Sequence
  Description of Artificial Sequence: Synthetic peptide
SGSKEAT

SEQ ID NO: 4182 - protein, 7 aa, Artificial Sequence
  Description of Artificial Sequence: Synthetic peptide
TGGSSSL

SEQ ID NO: 4183 - protein, 7 aa, Artificial Sequence
  Description of Artificial Sequence: Synthetic peptide
DVTKSSA

SEQ ID NO: 4184 - protein, 7 aa, Artificial Sequence
  Description of Artificial Sequence: Synthetic peptide
NTTGHSS

SEQ ID NO: 4185 - protein, 7 aa, Artificial Sequence
  Description of Artificial Sequence: Synthetic peptide
DNVQKVS

SEQ ID NO: 4186 - protein, 7 aa, Artificial Sequence
  Description of Artificial Sequence: Synthetic peptide
GNGVPNG

SEQ ID NO: 4187 - protein, 7 aa, Artificial Sequence
  Description of Artificial Sequence: Synthetic peptide
QQAAPSV

SEQ ID NO: 4188 - protein, 7 aa, Artificial Sequence
  Description of Artificial Sequence: Synthetic peptide
SQDNNRS

SEQ ID NO: 4189 - protein, 7 aa, Artificial Sequence
  Description of Artificial Sequence: Synthetic peptide
VEKGKNE

SEQ ID NO: 4190 - protein, 7 aa, Artificial Sequence
  Description of Artificial Sequence: Synthetic peptide
STQGTSS

SEQ ID NO: 4191 - protein, 7 aa, Artificial Sequence
  Description of Artificial Sequence: Synthetic peptide
RSGDNPS

SEQ ID NO: 4192 - protein, 7 aa, Artificial Sequence
  Description of Artificial Sequence: Synthetic peptide
TTASHNV

SEQ ID NO: 4193 - protein, 7 aa, Artificial Sequence
  Description of Artificial Sequence: Synthetic peptide
QSVDPKL

SEQ ID NO: 4194 - protein, 7 aa, Artificial Sequence
  Description of Artificial Sequence: Synthetic peptide
GVTNAKS

SEQ ID NO: 4195 - protein, 7 aa, Artificial Sequence
  Description of Artificial Sequence: Synthetic peptide
NESRGSS

SEQ ID NO: 4196 - protein, 7 aa, Artificial Sequence
  Description of Artificial Sequence: Synthetic peptide
QDSKQGA

SEQ ID NO: 4197 - protein, 7 aa, Artificial Sequence
  Description of Artificial Sequence: Synthetic peptide
SMSSEPK

SEQ ID NO: 4198 - protein, 7 aa, Artificial Sequence
  Description of Artificial Sequence: Synthetic peptide
SGAGASL

SEQ ID NO: 4199 - protein, 7 aa, Artificial Sequence
  Description of Artificial Sequence: Synthetic peptide
QTSGSHG

SEQ ID NO: 4200 - protein, 7 aa, Artificial Sequence
  Description of Artificial Sequence: Synthetic peptide
VGNSNTT

SEQ ID NO: 4201 - protein, 7 aa, Artificial Sequence
  Description of Artificial Sequence: Synthetic peptide
SKSAAPT

SEQ ID NO: 4202 - protein, 7 aa, Artificial Sequence
  Description of Artificial Sequence: Synthetic peptide
GTGQSPV

SEQ ID NO: 4203 - protein, 7 aa, Artificial Sequence
  Description of Artificial Sequence: Synthetic peptide
SSTSSHS

SEQ ID NO: 4204 - protein, 7 aa, Artificial Sequence
  Description of Artificial Sequence: Synthetic peptide
IKNSQTS

SEQ ID NO: 4205 - protein, 7 aa, Artificial Sequence
  Description of Artificial Sequence: Synthetic peptide
SHGDKTL

SEQ ID NO: 4206 - protein, 7 aa, Artificial Sequence
  Description of Artificial Sequence: Synthetic peptide
NASQQGQ

SEQ ID NO: 4207 - protein, 7 aa, Artificial Sequence
  Description of Artificial Sequence: Synthetic peptide
DGVGTGS

SEQ ID NO: 4208 - protein, 7 aa, Artificial Sequence
  Description of Artificial Sequence: Synthetic peptide
GSTGSSV

SEQ ID NO: 4209 - protein, 7 aa, Artificial Sequence
  Description of Artificial Sequence: Synthetic peptide
AVSNPSQ

SEQ ID NO: 4210 - protein, 7 aa, Artificial Sequence
  Description of Artificial Sequence: Synthetic peptide
TSGQTGS

SEQ ID NO: 4211 - protein, 7 aa, Artificial Sequence
  Description of Artificial Sequence: Synthetic peptide
SGTSTTS

SEQ ID NO: 4212 - protein, 7 aa, Artificial Sequence
  Description of Artificial Sequence: Synthetic peptide
RQDAKSE

SEQ ID NO: 4213 - protein, 7 aa, Artificial Sequence
  Description of Artificial Sequence: Synthetic peptide
MSTVKPQ

SEQ ID NO: 4214 - protein, 7 aa, Artificial Sequence
  Description of Artificial Sequence: Synthetic peptide
AFDPKGG

SEQ ID NO: 4215 - protein, 7 aa, Artificial Sequence
  Description of Artificial Sequence: Synthetic peptide
VAGASTG

SEQ ID NO: 4216 - protein, 7 aa, Artificial Sequence
  Description of Artificial Sequence: Synthetic peptide
SGAGTIS

SEQ ID NO: 4217 - protein, 7 aa, Artificial Sequence
  Description of Artificial Sequence: Synthetic peptide
SLSDKAR

SEQ ID NO: 4218 - protein, 7 aa, Artificial Sequence
  Description of Artificial Sequence: Synthetic peptide
STQSAPT

SEQ ID NO: 4219 - protein, 7 aa, Artificial Sequence
  Description of Artificial Sequence: Synthetic peptide
VTGKTDS

SEQ ID NO: 4220 - protein, 7 aa, Artificial Sequence
  Description of Artificial Sequence: Synthetic peptide
QDTKSTS

SEQ ID NO: 4221 - protein, 7 aa, Artificial Sequence
  Description of Artificial Sequence: Synthetic peptide
QVGSSSV

SEQ ID NO: 4222 - protein, 7 aa, Artificial Sequence
  Description of Artificial Sequence: Synthetic peptide
NSQAPPN

SEQ ID NO: 4223 - protein, 7 aa, Artificial Sequence
  Description of Artificial Sequence: Synthetic peptide
MTSKDMV

SEQ ID NO: 4224 - protein, 7 aa, Artificial Sequence
  Description of Artificial Sequence: Synthetic peptide
QSSSQPG

SEQ ID NO: 4225 - protein, 7 aa, Artificial Sequence
  Description of Artificial Sequence: Synthetic peptide
GTGSAPV

SEQ ID NO: 4226 - protein, 7 aa, Artificial Sequence
  Description of Artificial Sequence: Synthetic peptide
SGSSTAT

SEQ ID NO: 4227 - protein, 7 aa, Artificial Sequence
  Description of Artificial Sequence: Synthetic peptide
LNTQSPS

SEQ ID NO: 4228 - protein, 7 aa, Artificial Sequence
  Description of Artificial Sequence: Synthetic peptide
GDTNVKG

SEQ ID NO: 4229 - protein, 7 aa, Artificial Sequence
  Description of Artificial Sequence: Synthetic peptide
ASTGKDG

SEQ ID NO: 4230 - protein, 7 aa, Artificial Sequence
  Description of Artificial Sequence: Synthetic peptide
RTGSSNG

SEQ ID NO: 4231 - protein, 7 aa, Artificial Sequence
  Description of Artificial Sequence: Synthetic peptide
YNNGVSK

SEQ ID NO: 4232 - protein, 7 aa, Artificial Sequence
  Description of Artificial Sequence: Synthetic peptide
NVGSTNS

SEQ ID NO: 4233 - protein, 7 aa, Artificial Sequence
  Description of Artificial Sequence: Synthetic peptide
GMADRNK

SEQ ID NO: 4234 - protein, 7 aa, Artificial Sequence
  Description of Artificial Sequence: Synthetic peptide
GRQDGAK

SEQ ID NO: 4235 - protein, 7 aa, Artificial Sequence
  Description of Artificial Sequence: Synthetic peptide
TKSNPNS

SEQ ID NO: 4236 - protein, 7 aa, Artificial Sequence
  Description of Artificial Sequence: Synthetic peptide
GSNNSSG

SEQ ID NO: 4237 - protein, 7 aa, Artificial Sequence
  Description of Artificial Sequence: Synthetic peptide
VGTTSAS

SEQ ID NO: 4238 - protein, 7 aa, Artificial Sequence
  Description of Artificial Sequence: Synthetic peptide
VEGASVR

SEQ ID NO: 4239 - protein, 7 aa, Artificial Sequence
  Description of Artificial Sequence: Synthetic peptide
GSATKST

SEQ ID NO: 4240 - protein, 7 aa, Artificial Sequence
  Description of Artificial Sequence: Synthetic peptide
SAKAPSL

SEQ ID NO: 4241 - protein, 7 aa, Artificial Sequence
  Description of Artificial Sequence: Synthetic peptide
GTNTNKA

SEQ ID NO: 4242 - protein, 7 aa, Artificial Sequence
  Description of Artificial Sequence: Synthetic peptide
EGSSGVK

SEQ ID NO: 4243 - protein, 7 aa, Artificial Sequence
  Description of Artificial Sequence: Synthetic peptide
DSRSASS

SEQ ID NO: 4244 - protein, 7 aa, Artificial Sequence
  Description of Artificial Sequence: Synthetic peptide
EKGAGSK

SEQ ID NO: 4245 - protein, 7 aa, Artificial Sequence
  Description of Artificial Sequence: Synthetic peptide
NNAGNLG

SEQ ID NO: 4246 - protein, 7 aa, Artificial Sequence
  Description of Artificial Sequence: Synthetic peptide
RDASTTG

SEQ ID NO: 4247 - protein, 7 aa, Artificial Sequence
  Description of Artificial Sequence: Synthetic peptide
SSKPQSM

SEQ ID NO: 4248 - protein, 7 aa, Artificial Sequence
  Description of Artificial Sequence: Synthetic peptide
ATDKTAL

SEQ ID NO: 4249 - protein, 7 aa, Artificial Sequence
  Description of Artificial Sequence: Synthetic peptide
ESSSPAM

SEQ ID NO: 4250 - protein, 7 aa, Artificial Sequence
  Description of Artificial Sequence: Synthetic peptide
MLNDAGK

SEQ ID NO: 4251 - protein, 7 aa, Artificial Sequence
  Description of Artificial Sequence: Synthetic peptide
QAGNSPA

SEQ ID NO: 4252 - protein, 7 aa, Artificial Sequence
  Description of Artificial Sequence: Synthetic peptide
AGPSGGG

SEQ ID NO: 4253 - protein, 7 aa, Artificial Sequence
  Description of Artificial Sequence: Synthetic peptide
GNSKSSQ

SEQ ID NO: 4254 - protein, 7 aa, Artificial Sequence
  Description of Artificial Sequence: Synthetic peptide
GDKTSLT

SEQ ID NO: 4255 - protein, 7 aa, Artificial Sequence
  Description of Artificial Sequence: Synthetic peptide
TAGQGSS

SEQ ID NO: 4256 - protein, 7 aa, Artificial Sequence
  Description of Artificial Sequence: Synthetic peptide
NTTSASA

SEQ ID NO: 4257 - protein, 7 aa, Artificial Sequence
  Description of Artificial Sequence: Synthetic peptide
GVAAQNS

SEQ ID NO: 4258 - protein, 7 aa, Artificial Sequence
  Description of Artificial Sequence: Synthetic peptide
GQGQKSM

SEQ ID NO: 4259 - protein, 7 aa, Artificial Sequence
  Description of Artificial Sequence: Synthetic peptide
GQPSGKT

SEQ ID NO: 4260 - protein, 7 aa, Artificial Sequence
  Description of Artificial Sequence: Synthetic peptide
EPSTKGL

SEQ ID NO: 4261 - protein, 7 aa, Artificial Sequence
  Description of Artificial Sequence: Synthetic peptide
TATDSRT

SEQ ID NO: 4262 - protein, 7 aa, Artificial Sequence
  Description of Artificial Sequence: Synthetic peptide
QSDNVNR

SEQ ID NO: 4263 - protein, 7 aa, Artificial Sequence
  Description of Artificial Sequence: Synthetic peptide
AQVKSNG

SEQ ID NO: 4264 - protein, 7 aa, Artificial Sequence
  Description of Artificial Sequence: Synthetic peptide
QSSPTSS

SEQ ID NO: 4265 - protein, 7 aa, Artificial Sequence
  Description of Artificial Sequence: Synthetic peptide
DAARNSA

SEQ ID NO: 4266 - protein, 7 aa, Artificial Sequence
  Description of Artificial Sequence: Synthetic peptide
VDGGKTN

SEQ ID NO: 4267 - protein, 7 aa, Artificial Sequence
  Description of Artificial Sequence: Synthetic peptide
HGSGQNQ

SEQ ID NO: 4268 - protein, 7 aa, Artificial Sequence
  Description of Artificial Sequence: Synthetic peptide
LSGGSTG

SEQ ID NO: 4269 - protein, 7 aa, Artificial Sequence
  Description of Artificial Sequence: Synthetic peptide
QTKPQAA

SEQ ID NO: 4270 - protein, 7 aa, Artificial Sequence
  Description of Artificial Sequence: Synthetic peptide
DTTAKNI

SEQ ID NO: 4271 - protein, 7 aa, Artificial Sequence
  Description of Artificial Sequence: Synthetic peptide
SGAQTAL

SEQ ID NO: 4272 - protein, 7 aa, Artificial Sequence
  Description of Artificial Sequence: Synthetic peptide
GRNGEVK

SEQ ID NO: 4273 - protein, 7 aa, Artificial Sequence
  Description of Artificial Sequence: Synthetic peptide
QHKDGAG

SEQ ID NO: 4274 - protein, 7 aa, Artificial Sequence
  Description of Artificial Sequence: Synthetic peptide
TLDSVGK

SEQ ID NO: 4275 - protein, 7 aa, Artificial Sequence
  Description of Artificial Sequence: Synthetic peptide
KHNSEQS

SEQ ID NO: 4276 - protein, 7 aa, Artificial Sequence
  Description of Artificial Sequence: Synthetic peptide
QQASSTG

SEQ ID NO: 4277 - protein, 7 aa, Artificial Sequence
  Description of Artificial Sequence: Synthetic peptide
ATSPPSG

SEQ ID NO: 4278 - protein, 7 aa, Artificial Sequence
  Description of Artificial Sequence: Synthetic peptide
HTKAQAG

SEQ ID NO: 4279 - protein, 7 aa, Artificial Sequence
  Description of Artificial Sequence: Synthetic peptide
RSNGAAS

SEQ ID NO: 4280 - protein, 7 aa, Artificial Sequence
  Description of Artificial Sequence: Synthetic peptide
VATKSTS

SEQ ID NO: 4281 - protein, 7 aa, Artificial Sequence
  Description of Artificial Sequence: Synthetic peptide
TSGAGVN

SEQ ID NO: 4282 - protein, 7 aa, Artificial Sequence
  Description of Artificial Sequence: Synthetic peptide
THNSSSS

SEQ ID NO: 4283 - protein, 7 aa, Artificial Sequence
  Description of Artificial Sequence: Synthetic peptide
GEGNARN

SEQ ID NO: 4284 - protein, 7 aa, Artificial Sequence
  Description of Artificial Sequence: Synthetic peptide
GSVKTSS

SEQ ID NO: 4285 - protein, 7 aa, Artificial Sequence
  Description of Artificial Sequence: Synthetic peptide
AGEKGLH

SEQ ID NO: 4286 - protein, 7 aa, Artificial Sequence
  Description of Artificial Sequence: Synthetic peptide
GQTGSKT

SEQ ID NO: 4287 - protein, 7 aa, Artificial Sequence
  Description of Artificial Sequence: Synthetic peptide
GGSKGSQ

SEQ ID NO: 4288 - protein, 7 aa, Artificial Sequence
  Description of Artificial Sequence: Synthetic peptide
SQSAPNK

SEQ ID NO: 4289 - protein, 7 aa, Artificial Sequence
  Description of Artificial Sequence: Synthetic peptide
SVEGTRV

SEQ ID NO: 4290 - protein, 7 aa, Artificial Sequence
  Description of Artificial Sequence: Synthetic peptide
QSGSQGN

SEQ ID NO: 4291 - protein, 7 aa, Artificial Sequence
  Description of Artificial Sequence: Synthetic peptide
GTDRPSV

SEQ ID NO: 4292 - protein, 7 aa, Artificial Sequence
  Description of Artificial Sequence: Synthetic peptide
NASAGSG

SEQ ID NO: 4293 - protein, 7 aa, Artificial Sequence
  Description of Artificial Sequence: Synthetic peptide
GGSKALE

SEQ ID NO: 4294 - protein, 7 aa, Artificial Sequence
  Description of Artificial Sequence: Synthetic peptide
DGKQPGV

SEQ ID NO: 4295 - protein, 7 aa, Artificial Sequence
  Description of Artificial Sequence: Synthetic peptide
SGTTSNL

SEQ ID NO: 4296 - protein, 7 aa, Artificial Sequence
  Description of Artificial Sequence: Synthetic peptide
ESRATST

SEQ ID NO: 4297 - protein, 7 aa, Artificial Sequence
  Description of Artificial Sequence: Synthetic peptide
SAGATQA

SEQ ID NO: 4298 - protein, 7 aa, Artificial Sequence
  Description of Artificial Sequence: Synthetic peptide
HSAAATT

SEQ ID NO: 4299 - protein, 7 aa, Artificial Sequence
  Description of Artificial Sequence: Synthetic peptide
ATSQGAT

SEQ ID NO: 4300 - protein, 7 aa, Artificial Sequence
  Description of Artificial Sequence: Synthetic peptide
SHKSSNE

SEQ ID NO: 4301 - protein, 7 aa, Artificial Sequence
  Description of Artificial Sequence: Synthetic peptide
MQSASSG

SEQ ID NO: 4302 - protein, 7 aa, Artificial Sequence
  Description of Artificial Sequence: Synthetic peptide
LGGGNST

SEQ ID NO: 4303 - protein, 7 aa, Artificial Sequence
  Description of Artificial Sequence: Synthetic peptide
SGKDSLA

SEQ ID NO: 4304 - protein, 7 aa, Artificial Sequence
  Description of Artificial Sequence: Synthetic peptide
TQSTSSA

SEQ ID NO: 4305 - protein, 7 aa, Artificial Sequence
  Description of Artificial Sequence: Synthetic peptide
HTGSQSG

SEQ ID NO: 4306 - protein, 7 aa, Artificial Sequence
  Description of Artificial Sequence: Synthetic peptide
VTTNSNA

SEQ ID NO: 4307 - protein, 7 aa, Artificial Sequence
  Description of Artificial Sequence: Synthetic peptide
SHEASPH

SEQ ID NO: 4308 - protein, 7 aa, Artificial Sequence
  Description of Artificial Sequence: Synthetic peptide
NQKQSPS

SEQ ID NO: 4309 - protein, 7 aa, Artificial Sequence
  Description of Artificial Sequence: Synthetic peptide
TSGTSSR

SEQ ID NO: 4310 - protein, 7 aa, Artificial Sequence
  Description of Artificial Sequence: Synthetic peptide
QHTNQNS

SEQ ID NO: 4311 - protein, 7 aa, Artificial Sequence
  Description of Artificial Sequence: Synthetic peptide
GTASSAS

SEQ ID NO: 4312 - protein, 7 aa, Artificial Sequence
  Description of Artificial Sequence: Synthetic peptide
GTEPQPK

SEQ ID NO: 4313 - protein, 7 aa, Artificial Sequence
  Description of Artificial Sequence: Synthetic peptide
NGERSSG

SEQ ID NO: 4314 - protein, 7 aa, Artificial Sequence
  Description of Artificial Sequence: Synthetic peptide
MTTNSKE

SEQ ID NO: 4315 - protein, 7 aa, Artificial Sequence
  Description of Artificial Sequence: Synthetic peptide
QTGGHSR

SEQ ID NO: 4316 - protein, 7 aa, Artificial Sequence
  Description of Artificial Sequence: Synthetic peptide
ELSSKAG

SEQ ID NO: 4317 - protein, 7 aa, Artificial Sequence
  Description of Artificial Sequence: Synthetic peptide
ADSKSSH

SEQ ID NO: 4318 - protein, 7 aa, Artificial Sequence
  Description of Artificial Sequence: Synthetic peptide
GLSRNTG

SEQ ID NO: 4319 - protein, 7 aa, Artificial Sequence
  Description of Artificial Sequence: Synthetic peptide
LNNGSNT

SEQ ID NO: 4320 - protein, 7 aa, Artificial Sequence
  Description of Artificial Sequence: Synthetic peptide
VSGNSSH

SEQ ID NO: 4321 - protein, 7 aa, Artificial Sequence
  Description of Artificial Sequence: Synthetic peptide
SGVATST

SEQ ID NO: 4322 - protein, 7 aa, Artificial Sequence
  Description of Artificial Sequence: Synthetic peptide
SSSKEAS

SEQ ID NO: 4323 - protein, 7 aa, Artificial Sequence
  Description of Artificial Sequence: Synthetic peptide
SPQSDTK

SEQ ID NO: 4324 - protein, 7 aa, Artificial Sequence
  Description of Artificial Sequence: Synthetic peptide
SGGSERA

SEQ ID NO: 4325 - protein, 7 aa, Artificial Sequence
  Description of Artificial Sequence: Synthetic peptide
MGSDHVR

SEQ ID NO: 4326 - protein, 7 aa, Artificial Sequence
  Description of Artificial Sequence: Synthetic peptide
APSAERG

SEQ ID NO: 4327 - protein, 7 aa, Artificial Sequence
  Description of Artificial Sequence: Synthetic peptide
RNGGANM

SEQ ID NO: 4328 - protein, 7 aa, Artificial Sequence
  Description of Artificial Sequence: Synthetic peptide
RADGDAK

SEQ ID NO: 4329 - protein, 7 aa, Artificial Sequence
  Description of Artificial Sequence: Synthetic peptide
TNDSKMA

SEQ ID NO: 4330 - protein, 7 aa, Artificial Sequence
  Description of Artificial Sequence: Synthetic peptide
DRIEKSS

SEQ ID NO: 4331 - protein, 7 aa, Artificial Sequence
  Description of Artificial Sequence: Synthetic peptide
GVDSPNR

SEQ ID NO: 4332 - protein, 7 aa, Artificial Sequence
  Description of Artificial Sequence: Synthetic peptide
SVTSSPH

SEQ ID NO: 4333 - protein, 7 aa, Artificial Sequence
  Description of Artificial Sequence: Synthetic peptide
RQDSPAQ

SEQ ID NO: 4334 - protein, 7 aa, Artificial Sequence
  Description of Artificial Sequence: Synthetic peptide
SSNGKSA

SEQ ID NO: 4335 - protein, 7 aa, Artificial Sequence
  Description of Artificial Sequence: Synthetic peptide
NSAGQSH

SEQ ID NO: 4336 - protein, 7 aa, Artificial Sequence
  Description of Artificial Sequence: Synthetic peptide
GSHDKST

SEQ ID NO: 4337 - protein, 7 aa, Artificial Sequence
  Description of Artificial Sequence: Synthetic peptide
GEVGQSR

SEQ ID NO: 4338 - protein, 7 aa, Artificial Sequence
  Description of Artificial Sequence: Synthetic peptide
MGSKESG

SEQ ID NO: 4339 - protein, 7 aa, Artificial Sequence
  Description of Artificial Sequence: Synthetic peptide
SALKNQG

SEQ ID NO: 4340 - protein, 7 aa, Artificial Sequence
  Description of Artificial Sequence: Synthetic peptide
TTQSTSI

SEQ ID NO: 4341 - protein, 7 aa, Artificial Sequence
  Description of Artificial Sequence: Synthetic peptide
SSGGATT

SEQ ID NO: 4342 - protein, 7 aa, Artificial Sequence
  Description of Artificial Sequence: Synthetic peptide
SDDKSRM

SEQ ID NO: 4343 - protein, 7 aa, Artificial Sequence
  Description of Artificial Sequence: Synthetic peptide
GSTLGSG

SEQ ID NO: 4344 - protein, 7 aa, Artificial Sequence
  Description of Artificial Sequence: Synthetic peptide
TGGPGNG

SEQ ID NO: 4345 - protein, 7 aa, Artificial Sequence
  Description of Artificial Sequence: Synthetic peptide
NTNHKEG

SEQ ID NO: 4346 - protein, 7 aa, Artificial Sequence
  Description of Artificial Sequence: Synthetic peptide
SQNSGKV

SEQ ID NO: 4347 - protein, 7 aa, Artificial Sequence
  Description of Artificial Sequence: Synthetic peptide
EGRGTPG

SEQ ID NO: 4348 - protein, 7 aa, Artificial Sequence
  Description of Artificial Sequence: Synthetic peptide
STHKPLE

SEQ ID NO: 4349 - protein, 7 aa, Artificial Sequence
  Description of Artificial Sequence: Synthetic peptide
GPGSNLT

SEQ ID NO: 4350 - protein, 7 aa, Artificial Sequence
  Description of Artificial Sequence: Synthetic peptide
DLDSRKS

SEQ ID NO: 4351 - protein, 7 aa, Artificial Sequence
  Description of Artificial Sequence: Synthetic peptide
VTTTGSS

SEQ ID NO: 4352 - protein, 7 aa, Artificial Sequence
  Description of Artificial Sequence: Synthetic peptide
LGTTSGG

SEQ ID NO: 4353 - protein, 7 aa, Artificial Sequence
  Description of Artificial Sequence: Synthetic peptide
SNSSKSG

SEQ ID NO: 4354 - protein, 7 aa, Artificial Sequence
  Description of Artificial Sequence: Synthetic peptide
TGSGSHG

SEQ ID NO: 4355 - protein, 7 aa, Artificial Sequence
  Description of Artificial Sequence: Synthetic peptide
QLSKESS

SEQ ID NO: 4356 - protein, 7 aa, Artificial Sequence
  Description of Artificial Sequence: Synthetic peptide
SGGTPSS

SEQ ID NO: 4357 - protein, 7 aa, Artificial Sequence
  Description of Artificial Sequence: Synthetic peptide
DTGTPKH

SEQ ID NO: 4358 - protein, 7 aa, Artificial Sequence
  Description of Artificial Sequence: Synthetic peptide
TKTGSPM

SEQ ID NO: 4359 - protein, 7 aa, Artificial Sequence
  Description of Artificial Sequence: Synthetic peptide
GTTATDR

SEQ ID NO: 4360 - protein, 7 aa, Artificial Sequence
  Description of Artificial Sequence: Synthetic peptide
HNTAPTS

SEQ ID NO: 4361 - protein, 7 aa, Artificial Sequence
  Description of Artificial Sequence: Synthetic peptide
RGGSASD

SEQ ID NO: 4362 - protein, 7 aa, Artificial Sequence
  Description of Artificial Sequence: Synthetic peptide
EAANQGK

SEQ ID NO: 4363 - protein, 7 aa, Artificial Sequence
  Description of Artificial Sequence: Synthetic peptide
TRTATAA

SEQ ID NO: 4364 - protein, 7 aa, Artificial Sequence
  Description of Artificial Sequence: Synthetic peptide
HNNSATK

SEQ ID NO: 4365 - protein, 7 aa, Artificial Sequence
  Description of Artificial Sequence: Synthetic peptide
GSEDKHK

SEQ ID NO: 4366 - protein, 7 aa, Artificial Sequence
  Description of Artificial Sequence: Synthetic peptide
GQSKGNS

SEQ ID NO: 4367 - protein, 7 aa, Artificial Sequence
  Description of Artificial Sequence: Synthetic peptide
GHGDIKG

SEQ ID NO: 4368 - protein, 7 aa, Artificial Sequence
  Description of Artificial Sequence: Synthetic peptide
NASSATS

SEQ ID NO: 4369 - protein, 7 aa, Artificial Sequence
  Description of Artificial Sequence: Synthetic peptide
TTSDKST

SEQ ID NO: 4370 - protein, 7 aa, Artificial Sequence
  Description of Artificial Sequence: Synthetic peptide
SANAGGG

SEQ ID NO: 4371 - protein, 7 aa, Artificial Sequence
  Description of Artificial Sequence: Synthetic peptide
DGITTPK

SEQ ID NO: 4372 - protein, 7 aa, Artificial Sequence
  Description of Artificial Sequence: Synthetic peptide
NNSKASA

SEQ ID NO: 4373 - protein, 7 aa, Artificial Sequence
  Description of Artificial Sequence: Synthetic peptide
GHSGTTS

SEQ ID NO: 4374 - protein, 7 aa, Artificial Sequence
  Description of Artificial Sequence: Synthetic peptide
SGGSTAQ

SEQ ID NO: 4375 - protein, 7 aa, Artificial Sequence
  Description of Artificial Sequence: Synthetic peptide
SGAASSG

SEQ ID NO: 4376 - protein, 7 aa, Artificial Sequence
  Description of Artificial Sequence: Synthetic peptide
LVADGSK

SEQ ID NO: 4377 - protein, 7 aa, Artificial Sequence
  Description of Artificial Sequence: Synthetic peptide
NDGKTLA

SEQ ID NO: 4378 - protein, 7 aa, Artificial Sequence
  Description of Artificial Sequence: Synthetic peptide
MGTPNSK

SEQ ID NO: 4379 - protein, 7 aa, Artificial Sequence
  Description of Artificial Sequence: Synthetic peptide
NQASSNH

SEQ ID NO: 4380 - protein, 7 aa, Artificial Sequence
  Description of Artificial Sequence: Synthetic peptide
SQSGAGG

SEQ ID NO: 4381 - protein, 7 aa, Artificial Sequence
  Description of Artificial Sequence: Synthetic peptide
ITSSSPT

SEQ ID NO: 4382 - protein, 7 aa, Artificial Sequence
  Description of Artificial Sequence: Synthetic peptide
TNSPNGA

SEQ ID NO: 4383 - protein, 7 aa, Artificial Sequence
  Description of Artificial Sequence: Synthetic peptide
SGPTDKS

SEQ ID NO: 4384 - protein, 7 aa, Artificial Sequence
  Description of Artificial Sequence: Synthetic peptide
TSTTKTG

SEQ ID NO: 4385 - protein, 7 aa, Artificial Sequence
  Description of Artificial Sequence: Synthetic peptide
SSEQASR

SEQ ID NO: 4386 - protein, 7 aa, Artificial Sequence
  Description of Artificial Sequence: Synthetic peptide
MPNNNAG

SEQ ID NO: 4387 - protein, 7 aa, Artificial Sequence
  Description of Artificial Sequence: Synthetic peptide
HTGGHAT

SEQ ID NO: 4388 - protein, 7 aa, Artificial Sequence
  Description of Artificial Sequence: Synthetic peptide
ALPDSKA

SEQ ID NO: 4389 - protein, 7 aa, Artificial Sequence
  Description of Artificial Sequence: Synthetic peptide
ASGGKVI

SEQ ID NO: 4390 - protein, 7 aa, Artificial Sequence
  Description of Artificial Sequence: Synthetic peptide
GTSPHAG

SEQ ID NO: 4391 - protein, 7 aa, Artificial Sequence
  Description of Artificial Sequence: Synthetic peptide
GSQKTAG

SEQ ID NO: 4392 - protein, 7 aa, Artificial Sequence
  Description of Artificial Sequence: Synthetic peptide
GPTNSRA

SEQ ID NO: 4393 - protein, 7 aa, Artificial Sequence
  Description of Artificial Sequence: Synthetic peptide
GKDGVVK

SEQ ID NO: 4394 - protein, 7 aa, Artificial Sequence
  Description of Artificial Sequence: Synthetic peptide
VTNNPTV

SEQ ID NO: 4395 - protein, 7 aa, Artificial Sequence
  Description of Artificial Sequence: Synthetic peptide
SGQTSKQ

SEQ ID NO: 4396 - protein, 7 aa, Artificial Sequence
  Description of Artificial Sequence: Synthetic peptide
SSNNTTS

SEQ ID NO: 4397 - protein, 7 aa, Artificial Sequence
  Description of Artificial Sequence: Synthetic peptide
LASQGNS

SEQ ID NO: 4398 - protein, 7 aa, Artificial Sequence
  Description of Artificial Sequence: Synthetic peptide
RQEQNSV

SEQ ID NO: 4399 - protein, 7 aa, Artificial Sequence
  Description of Artificial Sequence: Synthetic peptide
DGSTAGR

SEQ ID NO: 4400 - protein, 7 aa, Artificial Sequence
  Description of Artificial Sequence: Synthetic peptide
TGGQGAN

SEQ ID NO: 4401 - protein, 7 aa, Artificial Sequence
  Description of Artificial Sequence: Synthetic peptide
HQATKSG

SEQ ID NO: 4402 - protein, 7 aa, Artificial Sequence
  Description of Artificial Sequence: Synthetic peptide
REGSSSA

SEQ ID NO: 4403 - protein, 7 aa, Artificial Sequence
  Description of Artificial Sequence: Synthetic peptide
ETGSNSR

SEQ ID NO: 4404 - protein, 7 aa, Artificial Sequence
  Description of Artificial Sequence: Synthetic peptide
GVTEPRK

SEQ ID NO: 4405 - protein, 7 aa, Artificial Sequence
  Description of Artificial Sequence: Synthetic peptide
GIGAKGT

SEQ ID NO: 4406 - protein, 7 aa, Artificial Sequence
  Description of Artificial Sequence: Synthetic peptide
TQQSSNT

SEQ ID NO: 4407 - protein, 7 aa, Artificial Sequence
  Description of Artificial Sequence: Synthetic peptide
NAENKAV

SEQ ID NO: 4408 - protein, 7 aa, Artificial Sequence
  Description of Artificial Sequence: Synthetic peptide
VTTSSSA

SEQ ID NO: 4409 - protein, 7 aa, Artificial Sequence
  Description of Artificial Sequence: Synthetic peptide
QSGNELK

SEQ ID NO: 4410 - protein, 7 aa, Artificial Sequence
  Description of Artificial Sequence: Synthetic peptide
ETGGKHV

SEQ ID NO: 4411 - protein, 7 aa, Artificial Sequence
  Description of Artificial Sequence: Synthetic peptide
ESSRSAP

SEQ ID NO: 4412 - protein, 7 aa, Artificial Sequence
  Description of Artificial Sequence: Synthetic peptide
MQKESPA

SEQ ID NO: 4413 - protein, 7 aa, Artificial Sequence
  Description of Artificial Sequence: Synthetic peptide
VMGTSSG

SEQ ID NO: 4414 - protein, 7 aa, Artificial Sequence
  Description of Artificial Sequence: Synthetic peptide
DGSPTTA

SEQ ID NO: 4415 - protein, 7 aa, Artificial Sequence
  Description of Artificial Sequence: Synthetic peptide
GGSGKDQ

SEQ ID NO: 4416 - protein, 7 aa, Artificial Sequence
  Description of Artificial Sequence: Synthetic peptide
ASGQKGD

SEQ ID NO: 4417 - protein, 7 aa, Artificial Sequence
  Description of Artificial Sequence: Synthetic peptide
SNAAGAS

SEQ ID NO: 4418 - protein, 7 aa, Artificial Sequence
  Description of Artificial Sequence: Synthetic peptide
GEIAAKG

SEQ ID NO: 4419 - protein, 7 aa, Artificial Sequence
  Description of Artificial Sequence: Synthetic peptide
TNTETTR

SEQ ID NO: 4420 - protein, 7 aa, Artificial Sequence
  Description of Artificial Sequence: Synthetic peptide
QSTSTVG

SEQ ID NO: 4421 - protein, 7 aa, Artificial Sequence
  Description of Artificial Sequence: Synthetic peptide
TTAGNGS

SEQ ID NO: 4422 - protein, 7 aa, Artificial Sequence
  Description of Artificial Sequence: Synthetic peptide
TRDSSSH

SEQ ID NO: 4423 - protein, 7 aa, Artificial Sequence
  Description of Artificial Sequence: Synthetic peptide
TGGEVPR

SEQ ID NO: 4424 - protein, 7 aa, Artificial Sequence
  Description of Artificial Sequence: Synthetic peptide
SATNKAS

SEQ ID NO: 4425 - protein, 7 aa, Artificial Sequence
  Description of Artificial Sequence: Synthetic peptide
GSSGTPG

SEQ ID NO: 4426 - protein, 7 aa, Artificial Sequence
  Description of Artificial Sequence: Synthetic peptide
TAGSQKN

SEQ ID NO: 4427 - protein, 7 aa, Artificial Sequence
  Description of Artificial Sequence: Synthetic peptide
DPGTSNR

SEQ ID NO: 4428 - protein, 7 aa, Artificial Sequence
  Description of Artificial Sequence: Synthetic peptide
QGAQSLG

SEQ ID NO: 4429 - protein, 7 aa, Artificial Sequence
  Description of Artificial Sequence: Synthetic peptide
QNRSPSE

SEQ ID NO: 4430 - protein, 7 aa, Artificial Sequence
  Description of Artificial Sequence: Synthetic peptide
DMSPPKQ

SEQ ID NO: 4431 - protein, 7 aa, Artificial Sequence
  Description of Artificial Sequence: Synthetic peptide
TGSTSSM

SEQ ID NO: 4432 - protein, 7 aa, Artificial Sequence
  Description of Artificial Sequence: Synthetic peptide
GEASPVR

SEQ ID NO: 4433 - protein, 7 aa, Artificial Sequence
  Description of Artificial Sequence: Synthetic peptide
DSVANNR

SEQ ID NO: 4434 - protein, 7 aa, Artificial Sequence
  Description of Artificial Sequence: Synthetic peptide
VPSSSNV

SEQ ID NO: 4435 - protein, 7 aa, Artificial Sequence
  Description of Artificial Sequence: Synthetic peptide
TGSKTVE

SEQ ID NO: 4436 - protein, 7 aa, Artificial Sequence
  Description of Artificial Sequence: Synthetic peptide
QIDSKKG

SEQ ID NO: 4437 - protein, 7 aa, Artificial Sequence
  Description of Artificial Sequence: Synthetic peptide
LNGAPGS

SEQ ID NO: 4438 - protein, 7 aa, Artificial Sequence
  Description of Artificial Sequence: Synthetic peptide
GTSRESG

SEQ ID NO: 4439 - protein, 7 aa, Artificial Sequence
  Description of Artificial Sequence: Synthetic peptide
VGASPER

SEQ ID NO: 4440 - protein, 7 aa, Artificial Sequence
  Description of Artificial Sequence: Synthetic peptide
ANGAPTT

SEQ ID NO: 4441 - protein, 7 aa, Artificial Sequence
  Description of Artificial Sequence: Synthetic peptide
TRNSGAT

SEQ ID NO: 4442 - protein, 7 aa, Artificial Sequence
  Description of Artificial Sequence: Synthetic peptide
STSTKSS

SEQ ID NO: 4443 - protein, 7 aa, Artificial Sequence
  Description of Artificial Sequence: Synthetic peptide
GAHSTEK

SEQ ID NO: 4444 - protein, 7 aa, Artificial Sequence
  Description of Artificial Sequence: Synthetic peptide
NGVSGKS

SEQ ID NO: 4445 - protein, 7 aa, Artificial Sequence
  Description of Artificial Sequence: Synthetic peptide
DSTTTGK

SEQ ID NO: 4446 - protein, 7 aa, Artificial Sequence
  Description of Artificial Sequence: Synthetic peptide
SNGANKL

SEQ ID NO: 4447 - protein, 7 aa, Artificial Sequence
  Description of Artificial Sequence: Synthetic peptide
ASDKASR

SEQ ID NO: 4448 - protein, 7 aa, Artificial Sequence
  Description of Artificial Sequence: Synthetic peptide
SVSQPTS

SEQ ID NO: 4449 - protein, 7 aa, Artificial Sequence
  Description of Artificial Sequence: Synthetic peptide
VGGNGQA

SEQ ID NO: 4450 - protein, 7 aa, Artificial Sequence
  Description of Artificial Sequence: Synthetic peptide
NSATAKA

SEQ ID NO: 4451 - protein, 7 aa, Artificial Sequence
  Description of Artificial Sequence: Synthetic peptide
DLSSKSI

SEQ ID NO: 4452 - protein, 7 aa, Artificial Sequence
  Description of Artificial Sequence: Synthetic peptide
ASASPNQ

SEQ ID NO: 4453 - protein, 7 aa, Artificial Sequence
  Description of Artificial Sequence: Synthetic peptide
ESGTTGR

SEQ ID NO: 4454 - protein, 7 aa, Artificial Sequence
  Description of Artificial Sequence: Synthetic peptide
TSTSAPV

SEQ ID NO: 4455 - protein, 7 aa, Artificial Sequence
  Description of Artificial Sequence: Synthetic peptide
NNGASSS

SEQ ID NO: 4456 - protein, 7 aa, Artificial Sequence
  Description of Artificial Sequence: Synthetic peptide
GGGQQPS

SEQ ID NO: 4457 - protein, 7 aa, Artificial Sequence
  Description of Artificial Sequence: Synthetic peptide
GKDNGVS

SEQ ID NO: 4458 - protein, 7 aa, Artificial Sequence
  Description of Artificial Sequence: Synthetic peptide
DRQTPTL

SEQ ID NO: 4459 - protein, 7 aa, Artificial Sequence
  Description of Artificial Sequence: Synthetic peptide
TRENKTE

SEQ ID NO: 4460 - protein, 7 aa, Artificial Sequence
  Description of Artificial Sequence: Synthetic peptide
TAGSTVH

SEQ ID NO: 4461 - protein, 7 aa, Artificial Sequence
  Description of Artificial Sequence: Synthetic peptide
SGSSTVA

SEQ ID NO: 4462 - protein, 7 aa, Artificial Sequence
  Description of Artificial Sequence: Synthetic peptide
SASQTSH

SEQ ID NO: 4463 - protein, 7 aa, Artificial Sequence
  Description of Artificial Sequence: Synthetic peptide
NSESSKG

SEQ ID NO: 4464 - protein, 7 aa, Artificial Sequence
  Description of Artificial Sequence: Synthetic peptide
GRTNAEA

SEQ ID NO: 4465 - protein, 7 aa, Artificial Sequence
  Description of Artificial Sequence: Synthetic peptide
QQSSNNV

SEQ ID NO: 4466 - protein, 7 aa, Artificial Sequence
  Description of Artificial Sequence: Synthetic peptide
QASGSPA

SEQ ID NO: 4467 - protein, 7 aa, Artificial Sequence
  Description of Artificial Sequence: Synthetic peptide
TSGGSSL

SEQ ID NO: 4468 - protein, 7 aa, Artificial Sequence
  Description of Artificial Sequence: Synthetic peptide
NNSTHPG

SEQ ID NO: 4469 - protein, 7 aa, Artificial Sequence
  Description of Artificial Sequence: Synthetic peptide
NGNSPAM

SEQ ID NO: 4470 - protein, 7 aa, Artificial Sequence
  Description of Artificial Sequence: Synthetic peptide
NGGVASS

SEQ ID NO: 4471 - protein, 7 aa, Artificial Sequence
  Description of Artificial Sequence: Synthetic peptide
TSSTSTG

SEQ ID NO: 4472 - protein, 7 aa, Artificial Sequence
  Description of Artificial Sequence: Synthetic peptide
SRTKESV

SEQ ID NO: 4473 - protein, 7 aa, Artificial Sequence
  Description of Artificial Sequence: Synthetic peptide
DSPGTLK

SEQ ID NO: 4474 - protein, 7 aa, Artificial Sequence
  Description of Artificial Sequence: Synthetic peptide
AGTGQVQ

SEQ ID NO: 4475 - protein, 7 aa, Artificial Sequence
  Description of Artificial Sequence: Synthetic peptide
AGHGSQA

SEQ ID NO: 4476 - protein, 7 aa, Artificial Sequence
  Description of Artificial Sequence: Synthetic peptide
GVESSPR

SEQ ID NO: 4477 - protein, 7 aa, Artificial Sequence
  Description of Artificial Sequence: Synthetic peptide
GVGTVTG

SEQ ID NO: 4478 - protein, 7 aa, Artificial Sequence
  Description of Artificial Sequence: Synthetic peptide
GAHKDDG

SEQ ID NO: 4479 - protein, 7 aa, Artificial Sequence
  Description of Artificial Sequence: Synthetic peptide
GSGQSHA

SEQ ID NO: 4480 - protein, 7 aa, Artificial Sequence
  Description of Artificial Sequence: Synthetic peptide
KSDGQQA

SEQ ID NO: 4481 - protein, 7 aa, Artificial Sequence
  Description of Artificial Sequence: Synthetic peptide
EATGSRL

SEQ ID NO: 4482 - protein, 7 aa, Artificial Sequence
  Description of Artificial Sequence: Synthetic peptide
ASDSKHG

SEQ ID NO: 4483 - protein, 7 aa, Artificial Sequence
  Description of Artificial Sequence: Synthetic peptide
SNSSSTS

SEQ ID NO: 4484 - protein, 7 aa, Artificial Sequence
  Description of Artificial Sequence: Synthetic peptide
AKNTTSS

SEQ ID NO: 4485 - protein, 7 aa, Artificial Sequence
  Description of Artificial Sequence: Synthetic peptide
MNSPSSL

SEQ ID NO: 4486 - protein, 7 aa, Artificial Sequence
  Description of Artificial Sequence: Synthetic peptide
TVANTPS

SEQ ID NO: 4487 - protein, 7 aa, Artificial Sequence
  Description of Artificial Sequence: Synthetic peptide
TGAQNKD

SEQ ID NO: 4488 - protein, 7 aa, Artificial Sequence
  Description of Artificial Sequence: Synthetic peptide
GPQPKDG

SEQ ID NO: 4489 - protein, 7 aa, Artificial Sequence
  Description of Artificial Sequence: Synthetic peptide
GETSGKN

SEQ ID NO: 4490 - protein, 7 aa, Artificial Sequence
  Description of Artificial Sequence: Synthetic peptide
MAESGKS

SEQ ID NO: 4491 - protein, 7 aa, Artificial Sequence
  Description of Artificial Sequence: Synthetic peptide
TGASSSV

SEQ ID NO: 4492 - protein, 7 aa, Artificial Sequence
  Description of Artificial Sequence: Synthetic peptide
RTNTTSV

SEQ ID NO: 4493 - protein, 7 aa, Artificial Sequence
  Description of Artificial Sequence: Synthetic peptide
AGSETGK

SEQ ID NO: 4494 - protein, 7 aa, Artificial Sequence
  Description of Artificial Sequence: Synthetic peptide
GNREVNK

SEQ ID NO: 4495 - protein, 7 aa, Artificial Sequence
  Description of Artificial Sequence: Synthetic peptide
SGSGSSG

SEQ ID NO: 4496 - protein, 7 aa, Artificial Sequence
  Description of Artificial Sequence: Synthetic peptide
REGQVAT

SEQ ID NO: 4497 - protein, 7 aa, Artificial Sequence
  Description of Artificial Sequence: Synthetic peptide
GMSNSPS

SEQ ID NO: 4498 - protein, 7 aa, Artificial Sequence
  Description of Artificial Sequence: Synthetic peptide
QEPKPLN

SEQ ID NO: 4499 - protein, 7 aa, Artificial Sequence
  Description of Artificial Sequence: Synthetic peptide
GADASKL

SEQ ID NO: 4500 - protein, 7 aa, Artificial Sequence
  Description of Artificial Sequence: Synthetic peptide
QSSDRSV

SEQ ID NO: 4501 - protein, 7 aa, Artificial Sequence
  Description of Artificial Sequence: Synthetic peptide
GSSPGVH

SEQ ID NO: 4502 - protein, 7 aa, Artificial Sequence
  Description of Artificial Sequence: Synthetic peptide
SGTPSSL

SEQ ID NO: 4503 - protein, 7 aa, Artificial Sequence
  Description of Artificial Sequence: Synthetic peptide
SSSKEVA

SEQ ID NO: 4504 - protein, 7 aa, Artificial Sequence
  Description of Artificial Sequence: Synthetic peptide
GRGSPKD

SEQ ID NO: 4505 - protein, 7 aa, Artificial Sequence
  Description of Artificial Sequence: Synthetic peptide
SNSSTPT

SEQ ID NO: 4506 - protein, 7 aa, Artificial Sequence
  Description of Artificial Sequence: Synthetic peptide
LSGTPST

SEQ ID NO: 4507 - protein, 7 aa, Artificial Sequence
  Description of Artificial Sequence: Synthetic peptide
TGNSNQQ

SEQ ID NO: 4508 - protein, 7 aa, Artificial Sequence
  Description of Artificial Sequence: Synthetic peptide
VSDGKNL

SEQ ID NO: 4509 - protein, 7 aa, Artificial Sequence
  Description of Artificial Sequence: Synthetic peptide
SQQSTPH

SEQ ID NO: 4510 - protein, 7 aa, Artificial Sequence
  Description of Artificial Sequence: Synthetic peptide
GSGPSAT

SEQ ID NO: 4511 - protein, 7 aa, Artificial Sequence
  Description of Artificial Sequence: Synthetic peptide
GTGPTPP

SEQ ID NO: 4512 - protein, 7 aa, Artificial Sequence
  Description of Artificial Sequence: Synthetic peptide
QTGNGGN

SEQ ID NO: 4513 - protein, 7 aa, Artificial Sequence
  Description of Artificial Sequence: Synthetic peptide
NAGGSNR

SEQ ID NO: 4514 - protein, 7 aa, Artificial Sequence
  Description of Artificial Sequence: Synthetic peptide
DTSKDSK

SEQ ID NO: 4515 - protein, 7 aa, Artificial Sequence
  Description of Artificial Sequence: Synthetic peptide
SGSPNGL

SEQ ID NO: 4516 - protein, 7 aa, Artificial Sequence
  Description of Artificial Sequence: Synthetic peptide
GTGANHA

SEQ ID NO: 4517 - protein, 7 aa, Artificial Sequence
  Description of Artificial Sequence: Synthetic peptide
LGTTKSA

SEQ ID NO: 4518 - protein, 7 aa, Artificial Sequence
  Description of Artificial Sequence: Synthetic peptide
STPSATK

SEQ ID NO: 4519 - protein, 7 aa, Artificial Sequence
  Description of Artificial Sequence: Synthetic peptide
ELRSSNV

SEQ ID NO: 4520 - protein, 7 aa, Artificial Sequence
  Description of Artificial Sequence: Synthetic peptide
KGSGSNG

SEQ ID NO: 4521 - protein, 7 aa, Artificial Sequence
  Description of Artificial Sequence: Synthetic peptide
TNSSKAL

SEQ ID NO: 4522 - protein, 7 aa, Artificial Sequence
  Description of Artificial Sequence: Synthetic peptide
QKGAGAT

SEQ ID NO: 4523 - protein, 7 aa, Artificial Sequence
  Description of Artificial Sequence: Synthetic peptide
SGNDSRT

SEQ ID NO: 4524 - protein, 7 aa, Artificial Sequence
  Description of Artificial Sequence: Synthetic peptide
TRNSSTT

SEQ ID NO: 4525 - protein, 7 aa, Artificial Sequence
  Description of Artificial Sequence: Synthetic peptide
GSSTSST

SEQ ID NO: 4526 - protein, 7 aa, Artificial Sequence
  Description of Artificial Sequence: Synthetic peptide
DSNAKSG

SEQ ID NO: 4527 - protein, 7 aa, Artificial Sequence
  Description of Artificial Sequence: Synthetic peptide
VNTGGSN

SEQ ID NO: 4528 - protein, 7 aa, Artificial Sequence
  Description of Artificial Sequence: Synthetic peptide
LNQGSVQ

SEQ ID NO: 4529 - protein, 7 aa, Artificial Sequence
  Description of Artificial Sequence: Synthetic peptide
ENVNKNN

SEQ ID NO: 4530 - protein, 7 aa, Artificial Sequence
  Description of Artificial Sequence: Synthetic peptide
NSNQTQG

SEQ ID NO: 4531 - protein, 7 aa, Artificial Sequence
  Description of Artificial Sequence: Synthetic peptide
NASQGHA

SEQ ID NO: 4532 - protein, 7 aa, Artificial Sequence
  Description of Artificial Sequence: Synthetic peptide
QTSVSSA

SEQ ID NO: 4533 - protein, 7 aa, Artificial Sequence
  Description of Artificial Sequence: Synthetic peptide
GQGATTS

SEQ ID NO: 4534 - protein, 7 aa, Artificial Sequence
  Description of Artificial Sequence: Synthetic peptide
THQSSTS

SEQ ID NO: 4535 - protein, 7 aa, Artificial Sequence
  Description of Artificial Sequence: Synthetic peptide
TGNGSAS

SEQ ID NO: 4536 - protein, 7 aa, Artificial Sequence
  Description of Artificial Sequence: Synthetic peptide
SGPDSKS

SEQ ID NO: 4537 - protein, 7 aa, Artificial Sequence
  Description of Artificial Sequence: Synthetic peptide
TGSSSVV

SEQ ID NO: 4538 - protein, 7 aa, Artificial Sequence
  Description of Artificial Sequence: Synthetic peptide
STSSKVS

SEQ ID NO: 4539 - protein, 7 aa, Artificial Sequence
  Description of Artificial Sequence: Synthetic peptide
NAQTAGG

SEQ ID NO: 4540 - protein, 7 aa, Artificial Sequence
  Description of Artificial Sequence: Synthetic peptide
NGSGQQQ

SEQ ID NO: 4541 - protein, 7 aa, Artificial Sequence
  Description of Artificial Sequence: Synthetic peptide
TRVPSAG

SEQ ID NO: 4542 - protein, 7 aa, Artificial Sequence
  Description of Artificial Sequence: Synthetic peptide
STTTGGG

SEQ ID NO: 4543 - protein, 7 aa, Artificial Sequence
  Description of Artificial Sequence: Synthetic peptide
SGEQKQA

SEQ ID NO: 4544 - protein, 7 aa, Artificial Sequence
  Description of Artificial Sequence: Synthetic peptide
MKGNTPG

SEQ ID NO: 4545 - protein, 7 aa, Artificial Sequence
  Description of Artificial Sequence: Synthetic peptide
HGSGQHQ

SEQ ID NO: 4546 - protein, 7 aa, Artificial Sequence
  Description of Artificial Sequence: Synthetic peptide
DRSDHPK

SEQ ID NO: 4547 - protein, 7 aa, Artificial Sequence
  Description of Artificial Sequence: Synthetic peptide
DRAGQTF

SEQ ID NO: 4548 - protein, 7 aa, Artificial Sequence
  Description of Artificial Sequence: Synthetic peptide
DSRNSSA

SEQ ID NO: 4549 - protein, 7 aa, Artificial Sequence
  Description of Artificial Sequence: Synthetic peptide
ESGSHSM

SEQ ID NO: 4550 - protein, 7 aa, Artificial Sequence
  Description of Artificial Sequence: Synthetic peptide
ASNSAVK

SEQ ID NO: 4551 - protein, 7 aa, Artificial Sequence
  Description of Artificial Sequence: Synthetic peptide
ASERSGT

SEQ ID NO: 4552 - protein, 7 aa, Artificial Sequence
  Description of Artificial Sequence: Synthetic peptide
ANGAGST

SEQ ID NO: 4553 - protein, 7 aa, Artificial Sequence
  Description of Artificial Sequence: Synthetic peptide
ANVEKPQ

SEQ ID NO: 4554 - protein, 7 aa, Artificial Sequence
  Description of Artificial Sequence: Synthetic peptide
GKEGGHG

SEQ ID NO: 4555 - protein, 7 aa, Artificial Sequence
  Description of Artificial Sequence: Synthetic peptide
GRTGQPG

SEQ ID NO: 4556 - protein, 7 aa, Artificial Sequence
  Description of Artificial Sequence: Synthetic peptide
HGTQQTA

SEQ ID NO: 4557 - protein, 7 aa, Artificial Sequence
  Description of Artificial Sequence: Synthetic peptide
TTSSSGS

SEQ ID NO: 4558 - protein, 7 aa, Artificial Sequence
  Description of Artificial Sequence: Synthetic peptide
LGVKDTN

SEQ ID NO: 4559 - protein, 7 aa, Artificial Sequence
  Description of Artificial Sequence: Synthetic peptide
LGVPDNR

SEQ ID NO: 4560 - protein, 7 aa, Artificial Sequence
  Description of Artificial Sequence: Synthetic peptide
TNQTSSH

SEQ ID NO: 4561 - protein, 7 aa, Artificial Sequence
  Description of Artificial Sequence: Synthetic peptide
LASDKAA

SEQ ID NO: 4562 - protein, 7 aa, Artificial Sequence
  Description of Artificial Sequence: Synthetic peptide
DGTKTTG

SEQ ID NO: 4563 - protein, 7 aa, Artificial Sequence
  Description of Artificial Sequence: Synthetic peptide
GPTGSGG

SEQ ID NO: 4564 - protein, 7 aa, Artificial Sequence
  Description of Artificial Sequence: Synthetic peptide
GDNAQLK

SEQ ID NO: 4565 - protein, 7 aa, Artificial Sequence
  Description of Artificial Sequence: Synthetic peptide
SRSATST

SEQ ID NO: 4566 - protein, 7 aa, Artificial Sequence
  Description of Artificial Sequence: Synthetic peptide
QATTSTS

SEQ ID NO: 4567 - protein, 7 aa, Artificial Sequence
  Description of Artificial Sequence: Synthetic peptide
STQATGK

SEQ ID NO: 4568 - protein, 7 aa, Artificial Sequence
  Description of Artificial Sequence: Synthetic peptide
NSGTKGG

SEQ ID NO: 4569 - protein, 7 aa, Artificial Sequence
  Description of Artificial Sequence: Synthetic peptide
NAIEKTK

SEQ ID NO: 4570 - protein, 7 aa, Artificial Sequence
  Description of Artificial Sequence: Synthetic peptide
DGKNSLA

SEQ ID NO: 4571 - protein, 7 aa, Artificial Sequence
  Description of Artificial Sequence: Synthetic peptide
STTKPND

SEQ ID NO: 4572 - protein, 7 aa, Artificial Sequence
  Description of Artificial Sequence: Synthetic peptide
GEKQGTT

SEQ ID NO: 4573 - protein, 7 aa, Artificial Sequence
  Description of Artificial Sequence: Synthetic peptide
GVANPSS

SEQ ID NO: 4574 - protein, 7 aa, Artificial Sequence
  Description of Artificial Sequence: Synthetic peptide
GTEAHRT

SEQ ID NO: 4575 - protein, 7 aa, Artificial Sequence
  Description of Artificial Sequence: Synthetic peptide
TAASTPS

SEQ ID NO: 4576 - protein, 7 aa, Artificial Sequence
  Description of Artificial Sequence: Synthetic peptide
QNGASPN

SEQ ID NO: 4577 - protein, 7 aa, Artificial Sequence
  Description of Artificial Sequence: Synthetic peptide
VSAASVS

SEQ ID NO: 4578 - protein, 7 aa, Artificial Sequence
  Description of Artificial Sequence: Synthetic peptide
GYGSKGE

SEQ ID NO: 4579 - protein, 7 aa, Artificial Sequence
  Description of Artificial Sequence: Synthetic peptide
SVSSPSA

SEQ ID NO: 4580 - protein, 7 aa, Artificial Sequence
  Description of Artificial Sequence: Synthetic peptide
QGNGHIQ

SEQ ID NO: 4581 - protein, 7 aa, Artificial Sequence
  Description of Artificial Sequence: Synthetic peptide
QSAPETK

SEQ ID NO: 4582 - protein, 7 aa, Artificial Sequence
  Description of Artificial Sequence: Synthetic peptide
ANTSHSS

SEQ ID NO: 4583 - protein, 7 aa, Artificial Sequence
  Description of Artificial Sequence: Synthetic peptide
GGKASSA

SEQ ID NO: 4584 - protein, 7 aa, Artificial Sequence
  Description of Artificial Sequence: Synthetic peptide
SRNEGPK

SEQ ID NO: 4585 - protein, 7 aa, Artificial Sequence
  Description of Artificial Sequence: Synthetic peptide
SSSQTHT

SEQ ID NO: 4586 - protein, 7 aa, Artificial Sequence
  Description of Artificial Sequence: Synthetic peptide
TVGKDPM

SEQ ID NO: 4587 - protein, 7 aa, Artificial Sequence
  Description of Artificial Sequence: Synthetic peptide
SRNTQSE

SEQ ID NO: 4588 - protein, 7 aa, Artificial Sequence
  Description of Artificial Sequence: Synthetic peptide
SKTQTPA

SEQ ID NO: 4589 - protein, 7 aa, Artificial Sequence
  Description of Artificial Sequence: Synthetic peptide
SKGQSTS

SEQ ID NO: 4590 - protein, 7 aa, Artificial Sequence
  Description of Artificial Sequence: Synthetic peptide
QGENNVK

SEQ ID NO: 4591 - protein, 7 aa, Artificial Sequence
  Description of Artificial Sequence: Synthetic peptide
TSGSTVA

SEQ ID NO: 4592 - protein, 7 aa, Artificial Sequence
  Description of Artificial Sequence: Synthetic peptide
SSAAGQG

SEQ ID NO: 4593 - protein, 7 aa, Artificial Sequence
  Description of Artificial Sequence: Synthetic peptide
VAGGNSV

SEQ ID NO: 4594 - protein, 7 aa, Artificial Sequence
  Description of Artificial Sequence: Synthetic peptide
TDNSGPK

SEQ ID NO: 4595 - protein, 7 aa, Artificial Sequence
  Description of Artificial Sequence: Synthetic peptide
VGGSSNA

SEQ ID NO: 4596 - protein, 7 aa, Artificial Sequence
  Description of Artificial Sequence: Synthetic peptide
GSQARPL

SEQ ID NO: 4597 - protein, 7 aa, Artificial Sequence
  Description of Artificial Sequence: Synthetic peptide
VSGGASP

SEQ ID NO: 4598 - protein, 7 aa, Artificial Sequence
  Description of Artificial Sequence: Synthetic peptide
QDGKPSA

SEQ ID NO: 4599 - protein, 7 aa, Artificial Sequence
  Description of Artificial Sequence: Synthetic peptide
SGTDTHR

SEQ ID NO: 4600 - protein, 7 aa, Artificial Sequence
  Description of Artificial Sequence: Synthetic peptide
AIESKPS

SEQ ID NO: 4601 - protein, 7 aa, Artificial Sequence
  Description of Artificial Sequence: Synthetic peptide
SSATAQS

SEQ ID NO: 4602 - protein, 7 aa, Artificial Sequence
  Description of Artificial Sequence: Synthetic peptide
AGTSNRV

SEQ ID NO: 4603 - protein, 7 aa, Artificial Sequence
  Description of Artificial Sequence: Synthetic peptide
GVNGASR

SEQ ID NO: 4604 - protein, 7 aa, Artificial Sequence
  Description of Artificial Sequence: Synthetic peptide
QQPPPGK

SEQ ID NO: 4605 - protein, 7 aa, Artificial Sequence
  Description of Artificial Sequence: Synthetic peptide
GTASENR

SEQ ID NO: 4606 - protein, 7 aa, Artificial Sequence
  Description of Artificial Sequence: Synthetic peptide
KSGNSNV

SEQ ID NO: 4607 - protein, 7 aa, Artificial Sequence
  Description of Artificial Sequence: Synthetic peptide
AGSPSNG

SEQ ID NO: 4608 - protein, 7 aa, Artificial Sequence
  Description of Artificial Sequence: Synthetic peptide
GLSKERP

SEQ ID NO: 4609 - protein, 7 aa, Artificial Sequence
  Description of Artificial Sequence: Synthetic peptide
GAHTGSQ

SEQ ID NO: 4610 - protein, 7 aa, Artificial Sequence
  Description of Artificial Sequence: Synthetic peptide
VGVSKES

SEQ ID NO: 4611 - protein, 7 aa, Artificial Sequence
  Description of Artificial Sequence: Synthetic peptide
DSQKANA

SEQ ID NO: 4612 - protein, 7 aa, Artificial Sequence
  Description of Artificial Sequence: Synthetic peptide
VPQNSTK

SEQ ID NO: 4613 - protein, 7 aa, Artificial Sequence
  Description of Artificial Sequence: Synthetic peptide
TDSTHTS

SEQ ID NO: 4614 - protein, 7 aa, Artificial Sequence
  Description of Artificial Sequence: Synthetic peptide
STEKSLG

SEQ ID NO: 4615 - protein, 7 aa, Artificial Sequence
  Description of Artificial Sequence: Synthetic peptide
HAGSNSS

SEQ ID NO: 4616 - protein, 7 aa, Artificial Sequence
  Description of Artificial Sequence: Synthetic peptide
ERTTPSN

SEQ ID NO: 4617 - protein, 7 aa, Artificial Sequence
  Description of Artificial Sequence: Synthetic peptide
GNGSSSG

SEQ ID NO: 4618 - protein, 7 aa, Artificial Sequence
  Description of Artificial Sequence: Synthetic peptide
SGQNSSV

SEQ ID NO: 4619 - protein, 7 aa, Artificial Sequence
  Description of Artificial Sequence: Synthetic peptide
ENPSGKG

SEQ ID NO: 4620 - protein, 7 aa, Artificial Sequence
  Description of Artificial Sequence: Synthetic peptide
NGSGQNG

SEQ ID NO: 4621 - protein, 7 aa, Artificial Sequence
  Description of Artificial Sequence: Synthetic peptide
GSNSTPS

SEQ ID NO: 4622 - protein, 7 aa, Artificial Sequence
  Description of Artificial Sequence: Synthetic peptide
DGKGEKS

SEQ ID NO: 4623 - protein, 7 aa, Artificial Sequence
  Description of Artificial Sequence: Synthetic peptide
GADPKNG

SEQ ID NO: 4624 - protein, 7 aa, Artificial Sequence
  Description of Artificial Sequence: Synthetic peptide
YSGKDVS

SEQ ID NO: 4625 - protein, 7 aa, Artificial Sequence
  Description of Artificial Sequence: Synthetic peptide
SVGASNS

SEQ ID NO: 4626 - protein, 7 aa, Artificial Sequence
  Description of Artificial Sequence: Synthetic peptide
TSNSPFT

SEQ ID NO: 4627 - protein, 7 aa, Artificial Sequence
  Description of Artificial Sequence: Synthetic peptide
EGSTQTK

SEQ ID NO: 4628 - protein, 7 aa, Artificial Sequence
  Description of Artificial Sequence: Synthetic peptide
TTEAGSK

SEQ ID NO: 4629 - protein, 7 aa, Artificial Sequence
  Description of Artificial Sequence: Synthetic peptide
ENKGSNS

SEQ ID NO: 4630 - protein, 7 aa, Artificial Sequence
  Description of Artificial Sequence: Synthetic peptide
TGISGTN

SEQ ID NO: 4631 - protein, 7 aa, Artificial Sequence
  Description of Artificial Sequence: Synthetic peptide
GDTKPIH

SEQ ID NO: 4632 - protein, 7 aa, Artificial Sequence
  Description of Artificial Sequence: Synthetic peptide
TPSDKTV

SEQ ID NO: 4633 - protein, 7 aa, Artificial Sequence
  Description of Artificial Sequence: Synthetic peptide
EPNSKQG

SEQ ID NO: 4634 - protein, 7 aa, Artificial Sequence
  Description of Artificial Sequence: Synthetic peptide
VTLDKSS

SEQ ID NO: 4635 - protein, 7 aa, Artificial Sequence
  Description of Artificial Sequence: Synthetic peptide
TTGGSST

SEQ ID NO: 4636 - protein, 7 aa, Artificial Sequence
  Description of Artificial Sequence: Synthetic peptide
TSAAGTA

SEQ ID NO: 4637 - protein, 7 aa, Artificial Sequence
  Description of Artificial Sequence: Synthetic peptide
TGESHPN

SEQ ID NO: 4638 - protein, 7 aa, Artificial Sequence
  Description of Artificial Sequence: Synthetic peptide
VSNSKST

SEQ ID NO: 4639 - protein, 7 aa, Artificial Sequence
  Description of Artificial Sequence: Synthetic peptide
SSQKPVN

SEQ ID NO: 4640 - protein, 7 aa, Artificial Sequence
  Description of Artificial Sequence: Synthetic peptide
SSEARNH

SEQ ID NO: 4641 - protein, 7 aa, Artificial Sequence
  Description of Artificial Sequence: Synthetic peptide
DQANPRQ

SEQ ID NO: 4642 - protein, 7 aa, Artificial Sequence
  Description of Artificial Sequence: Synthetic peptide
STNTPPQ

SEQ ID NO: 4643 - protein, 7 aa, Artificial Sequence
  Description of Artificial Sequence: Synthetic peptide
GNQQGAS

SEQ ID NO: 4644 - protein, 7 aa, Artificial Sequence
  Description of Artificial Sequence: Synthetic peptide
LGNSPTT

SEQ ID NO: 4645 - protein, 7 aa, Artificial Sequence
  Description of Artificial Sequence: Synthetic peptide
NQSSAGG

SEQ ID NO: 4646 - protein, 7 aa, Artificial Sequence
  Description of Artificial Sequence: Synthetic peptide
SQTSSSQ

SEQ ID NO: 4647 - protein, 7 aa, Artificial Sequence
  Description of Artificial Sequence: Synthetic peptide
KGTSNSQ

SEQ ID NO: 4648 - protein, 7 aa, Artificial Sequence
  Description of Artificial Sequence: Synthetic peptide
ERSDKPF

SEQ ID NO: 4649 - protein, 7 aa, Artificial Sequence
  Description of Artificial Sequence: Synthetic peptide
SNVSSHT

SEQ ID NO: 4650 - protein, 7 aa, Artificial Sequence
  Description of Artificial Sequence: Synthetic peptide
SNASGNN

SEQ ID NO: 4651 - protein, 7 aa, Artificial Sequence
  Description of Artificial Sequence: Synthetic peptide
QDREKTL

SEQ ID NO: 4652 - protein, 7 aa, Artificial Sequence
  Description of Artificial Sequence: Synthetic peptide
NNASTST

SEQ ID NO: 4653 - protein, 7 aa, Artificial Sequence
  Description of Artificial Sequence: Synthetic peptide
RSEGASV

SEQ ID NO: 4654 - protein, 7 aa, Artificial Sequence
  Description of Artificial Sequence: Synthetic peptide
STGSGPS

SEQ ID NO: 4655 - protein, 7 aa, Artificial Sequence
  Description of Artificial Sequence: Synthetic peptide
SSQTANK

SEQ ID NO: 4656 - protein, 7 aa, Artificial Sequence
  Description of Artificial Sequence: Synthetic peptide
MSTSANH

SEQ ID NO: 4657 - protein, 7 aa, Artificial Sequence
  Description of Artificial Sequence: Synthetic peptide
SGASTGN

SEQ ID NO: 4658 - protein, 7 aa, Artificial Sequence
  Description of Artificial Sequence: Synthetic peptide
DQLSNAK

SEQ ID NO: 4659 - protein, 7 aa, Artificial Sequence
  Description of Artificial Sequence: Synthetic peptide
DSSSHSK

SEQ ID NO: 4660 - protein, 7 aa, Artificial Sequence
  Description of Artificial Sequence: Synthetic peptide
QGTSSVP

SEQ ID NO: 4661 - protein, 7 aa, Artificial Sequence
  Description of Artificial Sequence: Synthetic peptide
GTVGSNS

SEQ ID NO: 4662 - protein, 7 aa, Artificial Sequence
  Description of Artificial Sequence: Synthetic peptide
SVSSTPS

SEQ ID NO: 4663 - protein, 7 aa, Artificial Sequence
  Description of Artificial Sequence: Synthetic peptide
NSIGQSK

SEQ ID NO: 4664 - protein, 7 aa, Artificial Sequence
  Description of Artificial Sequence: Synthetic peptide
AAGSNST

SEQ ID NO: 4665 - protein, 7 aa, Artificial Sequence
  Description of Artificial Sequence: Synthetic peptide
TSARDVQ

SEQ ID NO: 4666 - protein, 7 aa, Artificial Sequence
  Description of Artificial Sequence: Synthetic peptide
MNTSNPV

SEQ ID NO: 4667 - protein, 7 aa, Artificial Sequence
  Description of Artificial Sequence: Synthetic peptide
TGSTGNM

SEQ ID NO: 4668 - protein, 7 aa, Artificial Sequence
  Description of Artificial Sequence: Synthetic peptide
SNGTSGG

SEQ ID NO: 4669 - protein, 7 aa, Artificial Sequence
  Description of Artificial Sequence: Synthetic peptide
REGDRGG

SEQ ID NO: 4670 - protein, 7 aa, Artificial Sequence
  Description of Artificial Sequence: Synthetic peptide
MPPKPST

SEQ ID NO: 4671 - protein, 7 aa, Artificial Sequence
  Description of Artificial Sequence: Synthetic peptide
MDGTSSR

SEQ ID NO: 4672 - protein, 7 aa, Artificial Sequence
  Description of Artificial Sequence: Synthetic peptide
LTGSKSD

SEQ ID NO: 4673 - protein, 7 aa, Artificial Sequence
  Description of Artificial Sequence: Synthetic peptide
DSSNQRN

SEQ ID NO: 4674 - protein, 7 aa, Artificial Sequence
  Description of Artificial Sequence: Synthetic peptide
GTGPSKS

SEQ ID NO: 4675 - protein, 7 aa, Artificial Sequence
  Description of Artificial Sequence: Synthetic peptide
VTSSKTE

SEQ ID NO: 4676 - protein, 7 aa, Artificial Sequence
  Description of Artificial Sequence: Synthetic peptide
TDKANAV

SEQ ID NO: 4677 - protein, 7 aa, Artificial Sequence
  Description of Artificial Sequence: Synthetic peptide
TGSSGSG

SEQ ID NO: 4678 - protein, 7 aa, Artificial Sequence
  Description of Artificial Sequence: Synthetic peptide
LNGSSSR

SEQ ID NO: 4679 - protein, 7 aa, Artificial Sequence
  Description of Artificial Sequence: Synthetic peptide
ERTTGVG

SEQ ID NO: 4680 - protein, 7 aa, Artificial Sequence
  Description of Artificial Sequence: Synthetic peptide
TGSGSTS

SEQ ID NO: 4681 - protein, 7 aa, Artificial Sequence
  Description of Artificial Sequence: Synthetic peptide
ASGGKNE

SEQ ID NO: 4682 - protein, 7 aa, Artificial Sequence
  Description of Artificial Sequence: Synthetic peptide
VGENSPR

SEQ ID NO: 4683 - protein, 7 aa, Artificial Sequence
  Description of Artificial Sequence: Synthetic peptide
TANKSKD

SEQ ID NO: 4684 - protein, 7 aa, Artificial Sequence
  Description of Artificial Sequence: Synthetic peptide
SLGSKGS

SEQ ID NO: 4685 - protein, 7 aa, Artificial Sequence
  Description of Artificial Sequence: Synthetic peptide
NGSGTPS

SEQ ID NO: 4686 - protein, 7 aa, Artificial Sequence
  Description of Artificial Sequence: Synthetic peptide
KGNTSAA

SEQ ID NO: 4687 - protein, 7 aa, Artificial Sequence
  Description of Artificial Sequence: Synthetic peptide
RSDQGNI

SEQ ID NO: 4688 - protein, 7 aa, Artificial Sequence
  Description of Artificial Sequence: Synthetic peptide
LNGSNQT

SEQ ID NO: 4689 - protein, 7 aa, Artificial Sequence
  Description of Artificial Sequence: Synthetic peptide
SGSGSNL

SEQ ID NO: 4690 - protein, 7 aa, Artificial Sequence
  Description of Artificial Sequence: Synthetic peptide
ESVSKNL

SEQ ID NO: 4691 - protein, 7 aa, Artificial Sequence
  Description of Artificial Sequence: Synthetic peptide
GSLKDAT

SEQ ID NO: 4692 - protein, 7 aa, Artificial Sequence
  Description of Artificial Sequence: Synthetic peptide
MTVKSSE

SEQ ID NO: 4693 - protein, 7 aa, Artificial Sequence
  Description of Artificial Sequence: Synthetic peptide
GSVKGEP

SEQ ID NO: 4694 - protein, 7 aa, Artificial Sequence
  Description of Artificial Sequence: Synthetic peptide
AQGGSVK

SEQ ID NO: 4695 - protein, 7 aa, Artificial Sequence
  Description of Artificial Sequence: Synthetic peptide
SNSSGHV

SEQ ID NO: 4696 - protein, 7 aa, Artificial Sequence
  Description of Artificial Sequence: Synthetic peptide
GKSTSEG

SEQ ID NO: 4697 - protein, 7 aa, Artificial Sequence
  Description of Artificial Sequence: Synthetic peptide
GSSDKRN

SEQ ID NO: 4698 - protein, 7 aa, Artificial Sequence
  Description of Artificial Sequence: Synthetic peptide
SVSAPST

SEQ ID NO: 4699 - protein, 7 aa, Artificial Sequence
  Description of Artificial Sequence: Synthetic peptide
TRDSKSL

SEQ ID NO: 4700 - protein, 7 aa, Artificial Sequence
  Description of Artificial Sequence: Synthetic peptide
MRDASTT

SEQ ID NO: 4701 - protein, 7 aa, Artificial Sequence
  Description of Artificial Sequence: Synthetic peptide
QGSTSPI

SEQ ID NO: 4702 - protein, 7 aa, Artificial Sequence
  Description of Artificial Sequence: Synthetic peptide
DNRDPKL

SEQ ID NO: 4703 - protein, 7 aa, Artificial Sequence
  Description of Artificial Sequence: Synthetic peptide
TGSQSST

SEQ ID NO: 4704 - protein, 7 aa, Artificial Sequence
  Description of Artificial Sequence: Synthetic peptide
ETPTSNR

SEQ ID NO: 4705 - protein, 7 aa, Artificial Sequence
  Description of Artificial Sequence: Synthetic peptide
VRDSSNH

SEQ ID NO: 4706 - protein, 7 aa, Artificial Sequence
  Description of Artificial Sequence: Synthetic peptide
AAGSSNT

SEQ ID NO: 4707 - protein, 7 aa, Artificial Sequence
  Description of Artificial Sequence: Synthetic peptide
DGRASVS

SEQ ID NO: 4708 - protein, 7 aa, Artificial Sequence
  Description of Artificial Sequence: Synthetic peptide
GLGAQAA

SEQ ID NO: 4709 - protein, 7 aa, Artificial Sequence
  Description of Artificial Sequence: Synthetic peptide
SVSSSPS

SEQ ID NO: 4710 - protein, 7 aa, Artificial Sequence
  Description of Artificial Sequence: Synthetic peptide
QLNPKDG

SEQ ID NO: 4711 - protein, 7 aa, Artificial Sequence
  Description of Artificial Sequence: Synthetic peptide
AGTEKIS

SEQ ID NO: 4712 - protein, 7 aa, Artificial Sequence
  Description of Artificial Sequence: Synthetic peptide
TASDKTR

SEQ ID NO: 4713 - protein, 7 aa, Artificial Sequence
  Description of Artificial Sequence: Synthetic peptide
NSTTKAN

SEQ ID NO: 4714 - protein, 7 aa, Artificial Sequence
  Description of Artificial Sequence: Synthetic peptide
SKSNNRE

SEQ ID NO: 4715 - protein, 7 aa, Artificial Sequence
  Description of Artificial Sequence: Synthetic peptide
SLSQKSE

SEQ ID NO: 4716 - protein, 7 aa, Artificial Sequence
  Description of Artificial Sequence: Synthetic peptide
NVGHPNE

SEQ ID NO: 4717 - protein, 7 aa, Artificial Sequence
  Description of Artificial Sequence: Synthetic peptide
SSEHPKG

SEQ ID NO: 4718 - protein, 7 aa, Artificial Sequence
  Description of Artificial Sequence: Synthetic peptide
SAQPSGG

SEQ ID NO: 4719 - protein, 7 aa, Artificial Sequence
  Description of Artificial Sequence: Synthetic peptide
SGSSRTE

SEQ ID NO: 4720 - protein, 7 aa, Artificial Sequence
  Description of Artificial Sequence: Synthetic peptide
QDNQGKP

SEQ ID NO: 4721 - protein, 7 aa, Artificial Sequence
  Description of Artificial Sequence: Synthetic peptide
EGDKHPV

SEQ ID NO: 4722 - protein, 7 aa, Artificial Sequence
  Description of Artificial Sequence: Synthetic peptide
EGAHRPG

SEQ ID NO: 4723 - protein, 7 aa, Artificial Sequence
  Description of Artificial Sequence: Synthetic peptide
GPESRPQ

SEQ ID NO: 4724 - protein, 7 aa, Artificial Sequence
  Description of Artificial Sequence: Synthetic peptide
GTSEKTI

SEQ ID NO: 4725 - protein, 7 aa, Artificial Sequence
  Description of Artificial Sequence: Synthetic peptide
GNGSSRD

SEQ ID NO: 4726 - protein, 7 aa, Artificial Sequence
  Description of Artificial Sequence: Synthetic peptide
FPTESAG

SEQ ID NO: 4727 - protein, 7 aa, Artificial Sequence
  Description of Artificial Sequence: Synthetic peptide
NPGKDSR

SEQ ID NO: 4728 - protein, 7 aa, Artificial Sequence
  Description of Artificial Sequence: Synthetic peptide
MGGSGHG

SEQ ID NO: 4729 - protein, 7 aa, Artificial Sequence
  Description of Artificial Sequence: Synthetic peptide
TESKSSV

SEQ ID NO: 4730 - protein, 7 aa, Artificial Sequence
  Description of Artificial Sequence: Synthetic peptide
TTASPNK

SEQ ID NO: 4731 - protein, 7 aa, Artificial Sequence
  Description of Artificial Sequence: Synthetic peptide
TSKSTTS

SEQ ID NO: 4732 - protein, 7 aa, Artificial Sequence
  Description of Artificial Sequence: Synthetic peptide
DMTGTNK

SEQ ID NO: 4733 - protein, 7 aa, Artificial Sequence
  Description of Artificial Sequence: Synthetic peptide
SNTSGVT

SEQ ID NO: 4734 - protein, 7 aa, Artificial Sequence
  Description of Artificial Sequence: Synthetic peptide
EMDSKGT

SEQ ID NO: 4735 - protein, 7 aa, Artificial Sequence
  Description of Artificial Sequence: Synthetic peptide
GSGGSKE

SEQ ID NO: 4736 - protein, 7 aa, Artificial Sequence
  Description of Artificial Sequence: Synthetic peptide
EIPAGKS

SEQ ID NO: 4737 - protein, 7 aa, Artificial Sequence
  Description of Artificial Sequence: Synthetic peptide
VGDAKAM

SEQ ID NO: 4738 - protein, 7 aa, Artificial Sequence
  Description of Artificial Sequence: Synthetic peptide
EQRKSMV

SEQ ID NO: 4739 - protein, 7 aa, Artificial Sequence
  Description of Artificial Sequence: Synthetic peptide
GSGTAGN

SEQ ID NO: 4740 - protein, 7 aa, Artificial Sequence
  Description of Artificial Sequence: Synthetic peptide
SQTSANQ

SEQ ID NO: 4741 - protein, 7 aa, Artificial Sequence
  Description of Artificial Sequence: Synthetic peptide
SGGSQGQ

SEQ ID NO: 4742 - protein, 7 aa, Artificial Sequence
  Description of Artificial Sequence: Synthetic peptide
QNGKQPL

SEQ ID NO: 4743 - protein, 7 aa, Artificial Sequence
  Description of Artificial Sequence: Synthetic peptide
SRDQNGH

SEQ ID NO: 4744 - protein, 7 aa, Artificial Sequence
  Description of Artificial Sequence: Synthetic peptide
SEAGSGK

SEQ ID NO: 4745 - protein, 7 aa, Artificial Sequence
  Description of Artificial Sequence: Synthetic peptide
GDGSSRA

SEQ ID NO: 4746 - protein, 7 aa, Artificial Sequence
  Description of Artificial Sequence: Synthetic peptide
SGSKSIE

SEQ ID NO: 4747 - protein, 7 aa, Artificial Sequence
  Description of Artificial Sequence: Synthetic peptide
MTESASK

SEQ ID NO: 4748 - protein, 7 aa, Artificial Sequence
  Description of Artificial Sequence: Synthetic peptide
QSGSGTA

SEQ ID NO: 4749 - protein, 7 aa, Artificial Sequence
  Description of Artificial Sequence: Synthetic peptide
VNDSKTT

SEQ ID NO: 4750 - protein, 7 aa, Artificial Sequence
  Description of Artificial Sequence: Synthetic peptide
DGKAPLL

SEQ ID NO: 4751 - protein, 7 aa, Artificial Sequence
  Description of Artificial Sequence: Synthetic peptide
HANSAKE

SEQ ID NO: 4752 - protein, 7 aa, Artificial Sequence
  Description of Artificial Sequence: Synthetic peptide
SPQGEHK

SEQ ID NO: 4753 - protein, 7 aa, Artificial Sequence
  Description of Artificial Sequence: Synthetic peptide
SGETTKR

SEQ ID NO: 4754 - protein, 7 aa, Artificial Sequence
  Description of Artificial Sequence: Synthetic peptide
GQDSIKG

SEQ ID NO: 4755 - protein, 7 aa, Artificial Sequence
  Description of Artificial Sequence: Synthetic peptide
SGQSKPD

SEQ ID NO: 4756 - protein, 7 aa, Artificial Sequence
  Description of Artificial Sequence: Synthetic peptide
LVEKSSS

SEQ ID NO: 4757 - protein, 7 aa, Artificial Sequence
  Description of Artificial Sequence: Synthetic peptide
TPASSSI

SEQ ID NO: 4758 - protein, 7 aa, Artificial Sequence
  Description of Artificial Sequence: Synthetic peptide
NSGPSGQ

SEQ ID NO: 4759 - protein, 7 aa, Artificial Sequence
  Description of Artificial Sequence: Synthetic peptide
SSTPSSG

SEQ ID NO: 4760 - protein, 7 aa, Artificial Sequence
  Description of Artificial Sequence: Synthetic peptide
TVGSGSP

SEQ ID NO: 4761 - protein, 7 aa, Artificial Sequence
  Description of Artificial Sequence: Synthetic peptide
SGVSSTA

SEQ ID NO: 4762 - protein, 7 aa, Artificial Sequence
  Description of Artificial Sequence: Synthetic peptide
ERVQTSE

SEQ ID NO: 4763 - protein, 7 aa, Artificial Sequence
  Description of Artificial Sequence: Synthetic peptide
AAGAERG

SEQ ID NO: 4764 - protein, 7 aa, Artificial Sequence
  Description of Artificial Sequence: Synthetic peptide
GLDKSLT

SEQ ID NO: 4765 - protein, 7 aa, Artificial Sequence
  Description of Artificial Sequence: Synthetic peptide
HGNNSPS

SEQ ID NO: 4766 - protein, 7 aa, Artificial Sequence
  Description of Artificial Sequence: Synthetic peptide
NGTSKQD

SEQ ID NO: 4767 - protein, 7 aa, Artificial Sequence
  Description of Artificial Sequence: Synthetic peptide
EINKANQ

SEQ ID NO: 4768 - protein, 7 aa, Artificial Sequence
  Description of Artificial Sequence: Synthetic peptide
DGTSHKS

SEQ ID NO: 4769 - protein, 7 aa, Artificial Sequence
  Description of Artificial Sequence: Synthetic peptide
ATSQSNM

SEQ ID NO: 4770 - protein, 7 aa, Artificial Sequence
  Description of Artificial Sequence: Synthetic peptide
MNGGTGT

SEQ ID NO: 4771 - protein, 7 aa, Artificial Sequence
  Description of Artificial Sequence: Synthetic peptide
RQGDHPS

SEQ ID NO: 4772 - protein, 7 aa, Artificial Sequence
  Description of Artificial Sequence: Synthetic peptide
SSGKESG

SEQ ID NO: 4773 - protein, 7 aa, Artificial Sequence
  Description of Artificial Sequence: Synthetic peptide
SPSTTGQ

SEQ ID NO: 4774 - protein, 7 aa, Artificial Sequence
  Description of Artificial Sequence: Synthetic peptide
GGNDHKT

SEQ ID NO: 4775 - protein, 7 aa, Artificial Sequence
  Description of Artificial Sequence: Synthetic peptide
GDPKSTL

SEQ ID NO: 4776 - protein, 7 aa, Artificial Sequence
  Description of Artificial Sequence: Synthetic peptide
GASGKMM

SEQ ID NO: 4777 - protein, 7 aa, Artificial Sequence
  Description of Artificial Sequence: Synthetic peptide
GDGSHTR

SEQ ID NO: 4778 - protein, 7 aa, Artificial Sequence
  Description of Artificial Sequence: Synthetic peptide
SMSSSPT

SEQ ID NO: 4779 - protein, 7 aa, Artificial Sequence
  Description of Artificial Sequence: Synthetic peptide
QQTADTK

SEQ ID NO: 4780 - protein, 7 aa, Artificial Sequence
  Description of Artificial Sequence: Synthetic peptide
NSASTSG

SEQ ID NO: 4781 - protein, 7 aa, Artificial Sequence
  Description of Artificial Sequence: Synthetic peptide
SNTNHNS

SEQ ID NO: 4782 - protein, 7 aa, Artificial Sequence
  Description of Artificial Sequence: Synthetic peptide
NVSGQNQ

SEQ ID NO: 4783 - protein, 7 aa, Artificial Sequence
  Description of Artificial Sequence: Synthetic peptide
TSSNVPQ

SEQ ID NO: 4784 - protein, 7 aa, Artificial Sequence
  Description of Artificial Sequence: Synthetic peptide
SGASSSH

SEQ ID NO: 4785 - protein, 7 aa, Artificial Sequence
  Description of Artificial Sequence: Synthetic peptide
DGSRVAH

SEQ ID NO: 4786 - protein, 7 aa, Artificial Sequence
  Description of Artificial Sequence: Synthetic peptide
DTQSNRT

SEQ ID NO: 4787 - protein, 7 aa, Artificial Sequence
  Description of Artificial Sequence: Synthetic peptide
MTSKTVG

SEQ ID NO: 4788 - protein, 7 aa, Artificial Sequence
  Description of Artificial Sequence: Synthetic peptide
EGNQTGS

SEQ ID NO: 4789 - protein, 7 aa, Artificial Sequence
  Description of Artificial Sequence: Synthetic peptide
GSNGAST

SEQ ID NO: 4790 - protein, 7 aa, Artificial Sequence
  Description of Artificial Sequence: Synthetic peptide
FPSSTPK

SEQ ID NO: 4791 - protein, 7 aa, Artificial Sequence
  Description of Artificial Sequence: Synthetic peptide
SLTEVNK

SEQ ID NO: 4792 - protein, 7 aa, Artificial Sequence
  Description of Artificial Sequence: Synthetic peptide
GTASPSS

SEQ ID NO: 4793 - protein, 7 aa, Artificial Sequence
  Description of Artificial Sequence: Synthetic peptide
GQSDAIK

SEQ ID NO: 4794 - protein, 7 aa, Artificial Sequence
  Description of Artificial Sequence: Synthetic peptide
DNHEKTS

SEQ ID NO: 4795 - protein, 7 aa, Artificial Sequence
  Description of Artificial Sequence: Synthetic peptide
GKTDGTH

SEQ ID NO: 4796 - protein, 7 aa, Artificial Sequence
  Description of Artificial Sequence: Synthetic peptide
GSEVAPK

SEQ ID NO: 4797 - protein, 7 aa, Artificial Sequence
  Description of Artificial Sequence: Synthetic peptide
GNTGASS

SEQ ID NO: 4798 - protein, 7 aa, Artificial Sequence
  Description of Artificial Sequence: Synthetic peptide
SSGGTRN

SEQ ID NO: 4799 - protein, 7 aa, Artificial Sequence
  Description of Artificial Sequence: Synthetic peptide
DSNVTHK

SEQ ID NO: 4800 - protein, 7 aa, Artificial Sequence
  Description of Artificial Sequence: Synthetic peptide
GYEGNGK

SEQ ID NO: 4801 - protein, 7 aa, Artificial Sequence
  Description of Artificial Sequence: Synthetic peptide
GTGAAGT

SEQ ID NO: 4802 - protein, 7 aa, Artificial Sequence
  Description of Artificial Sequence: Synthetic peptide
NSSSPTT

SEQ ID NO: 4803 - protein, 7 aa, Artificial Sequence
  Description of Artificial Sequence: Synthetic peptide
TGSPSGQ

SEQ ID NO: 4804 - protein, 7 aa, Artificial Sequence
  Description of Artificial Sequence: Synthetic peptide
AGTSTSN

SEQ ID NO: 4805 - protein, 7 aa, Artificial Sequence
  Description of Artificial Sequence: Synthetic peptide
QATSAAA

SEQ ID NO: 4806 - protein, 7 aa, Artificial Sequence
  Description of Artificial Sequence: Synthetic peptide
TSAARAE

SEQ ID NO: 4807 - protein, 7 aa, Artificial Sequence
  Description of Artificial Sequence: Synthetic peptide
AGSPSTQ

SEQ ID NO: 4808 - protein, 7 aa, Artificial Sequence
  Description of Artificial Sequence: Synthetic peptide
VPDHSVK

SEQ ID NO: 4809 - protein, 7 aa, Artificial Sequence
  Description of Artificial Sequence: Synthetic peptide
SSGTVPG

SEQ ID NO: 4810 - protein, 7 aa, Artificial Sequence
  Description of Artificial Sequence: Synthetic peptide
NLGTSSG

SEQ ID NO: 4811 - protein, 7 aa, Artificial Sequence
  Description of Artificial Sequence: Synthetic peptide
THNTSNA

SEQ ID NO: 4812 - protein, 7 aa, Artificial Sequence
  Description of Artificial Sequence: Synthetic peptide
TNSGTGK

SEQ ID NO: 4813 - protein, 7 aa, Artificial Sequence
  Description of Artificial Sequence: Synthetic peptide
NTHKTAS

SEQ ID NO: 4814 - protein, 7 aa, Artificial Sequence
  Description of Artificial Sequence: Synthetic peptide
NPGASPG

SEQ ID NO: 4815 - protein, 7 aa, Artificial Sequence
  Description of Artificial Sequence: Synthetic peptide
TGGSPKN

SEQ ID NO: 4816 - protein, 7 aa, Artificial Sequence
  Description of Artificial Sequence: Synthetic peptide
HSGKDSS

SEQ ID NO: 4817 - protein, 7 aa, Artificial Sequence
  Description of Artificial Sequence: Synthetic peptide
QGAATVA

SEQ ID NO: 4818 - protein, 7 aa, Artificial Sequence
  Description of Artificial Sequence: Synthetic peptide
LVGEKAV

SEQ ID NO: 4819 - protein, 7 aa, Artificial Sequence
  Description of Artificial Sequence: Synthetic peptide
DKSSGTG

SEQ ID NO: 4820 - protein, 7 aa, Artificial Sequence
  Description of Artificial Sequence: Synthetic peptide
AVGSATG

SEQ ID NO: 4821 - protein, 7 aa, Artificial Sequence
  Description of Artificial Sequence: Synthetic peptide
GGVPPTG

SEQ ID NO: 4822 - protein, 7 aa, Artificial Sequence
  Description of Artificial Sequence: Synthetic peptide
RQDKVAA

SEQ ID NO: 4823 - protein, 7 aa, Artificial Sequence
  Description of Artificial Sequence: Synthetic peptide
GTQESSR

SEQ ID NO: 4824 - protein, 7 aa, Artificial Sequence
  Description of Artificial Sequence: Synthetic peptide
GTNKSVV

SEQ ID NO: 4825 - protein, 7 aa, Artificial Sequence
  Description of Artificial Sequence: Synthetic peptide
SAQTSSL

SEQ ID NO: 4826 - protein, 7 aa, Artificial Sequence
  Description of Artificial Sequence: Synthetic peptide
GHEGPKG

SEQ ID NO: 4827 - protein, 7 aa, Artificial Sequence
  Description of Artificial Sequence: Synthetic peptide
TGSSTTA

SEQ ID NO: 4828 - protein, 7 aa, Artificial Sequence
  Description of Artificial Sequence: Synthetic peptide
HEDAKAG

SEQ ID NO: 4829 - protein, 7 aa, Artificial Sequence
  Description of Artificial Sequence: Synthetic peptide
GGPATAT

SEQ ID NO: 4830 - protein, 7 aa, Artificial Sequence
  Description of Artificial Sequence: Synthetic peptide
DRTNEAH

SEQ ID NO: 4831 - protein, 7 aa, Artificial Sequence
  Description of Artificial Sequence: Synthetic peptide
GGGNHSV

SEQ ID NO: 4832 - protein, 7 aa, Artificial Sequence
  Description of Artificial Sequence: Synthetic peptide
VTNSTTK

SEQ ID NO: 4833 - protein, 7 aa, Artificial Sequence
  Description of Artificial Sequence: Synthetic peptide
QSAQGAA

SEQ ID NO: 4834 - protein, 7 aa, Artificial Sequence
  Description of Artificial Sequence: Synthetic peptide
DGRGATS

SEQ ID NO: 4835 - protein, 7 aa, Artificial Sequence
  Description of Artificial Sequence: Synthetic peptide
NGARSSE

SEQ ID NO: 4836 - protein, 7 aa, Artificial Sequence
  Description of Artificial Sequence: Synthetic peptide
SESQGHK

SEQ ID NO: 4837 - protein, 7 aa, Artificial Sequence
  Description of Artificial Sequence: Synthetic peptide
IASQKAE

SEQ ID NO: 4838 - protein, 7 aa, Artificial Sequence
  Description of Artificial Sequence: Synthetic peptide
QNSPGNV

SEQ ID NO: 4839 - protein, 7 aa, Artificial Sequence
  Description of Artificial Sequence: Synthetic peptide
MAAGNEK

SEQ ID NO: 4840 - protein, 7 aa, Artificial Sequence
  Description of Artificial Sequence: Synthetic peptide
DRGEHSR

SEQ ID NO: 4841 - protein, 7 aa, Artificial Sequence
  Description of Artificial Sequence: Synthetic peptide
HTTSQNS

SEQ ID NO: 4842 - protein, 7 aa, Artificial Sequence
  Description of Artificial Sequence: Synthetic peptide
IGSGSST

SEQ ID NO: 4843 - protein, 7 aa, Artificial Sequence
  Description of Artificial Sequence: Synthetic peptide
DATGQRV

SEQ ID NO: 4844 - protein, 7 aa, Artificial Sequence
  Description of Artificial Sequence: Synthetic peptide
NRNGASG

SEQ ID NO: 4845 - protein, 7 aa, Artificial Sequence
  Description of Artificial Sequence: Synthetic peptide
SNGSASS

SEQ ID NO: 4846 - protein, 7 aa, Artificial Sequence
  Description of Artificial Sequence: Synthetic peptide
ELTKANT

SEQ ID NO: 4847 - protein, 7 aa, Artificial Sequence
  Description of Artificial Sequence: Synthetic peptide
MPNGNQQ

SEQ ID NO: 4848 - protein, 7 aa, Artificial Sequence
  Description of Artificial Sequence: Synthetic peptide
GGESRSS

SEQ ID NO: 4849 - protein, 7 aa, Artificial Sequence
  Description of Artificial Sequence: Synthetic peptide
ASASKVS

SEQ ID NO: 4850 - protein, 7 aa, Artificial Sequence
  Description of Artificial Sequence: Synthetic peptide
SSTPSSA

SEQ ID NO: 4851 - protein, 7 aa, Artificial Sequence
  Description of Artificial Sequence: Synthetic peptide
SSVSGSN

SEQ ID NO: 4852 - protein, 7 aa, Artificial Sequence
  Description of Artificial Sequence: Synthetic peptide
STQSDRS

SEQ ID NO: 4853 - protein, 7 aa, Artificial Sequence
  Description of Artificial Sequence: Synthetic peptide
VSNGSGA

SEQ ID NO: 4854 - protein, 7 aa, Artificial Sequence
  Description of Artificial Sequence: Synthetic peptide
SNNSGPT

SEQ ID NO: 4855 - protein, 7 aa, Artificial Sequence
  Description of Artificial Sequence: Synthetic peptide
LTPGTAA

SEQ ID NO: 4856 - protein, 7 aa, Artificial Sequence
  Description of Artificial Sequence: Synthetic peptide
SNASPHA

SEQ ID NO: 4857 - protein, 7 aa, Artificial Sequence
  Description of Artificial Sequence: Synthetic peptide
TNASSTA

SEQ ID NO: 4858 - protein, 7 aa, Artificial Sequence
  Description of Artificial Sequence: Synthetic peptide
AGHKETT

SEQ ID NO: 4859 - protein, 7 aa, Artificial Sequence
  Description of Artificial Sequence: Synthetic peptide
GSEATAK

SEQ ID NO: 4860 - protein, 7 aa, Artificial Sequence
  Description of Artificial Sequence: Synthetic peptide
GATSPHQ

SEQ ID NO: 4861 - protein, 7 aa, Artificial Sequence
  Description of Artificial Sequence: Synthetic peptide
NSGSPGS

SEQ ID NO: 4862 - protein, 7 aa, Artificial Sequence
  Description of Artificial Sequence: Synthetic peptide
SVGNSSS

SEQ ID NO: 4863 - protein, 7 aa, Artificial Sequence
  Description of Artificial Sequence: Synthetic peptide
SRVKNES

SEQ ID NO: 4864 - protein, 7 aa, Artificial Sequence
  Description of Artificial Sequence: Synthetic peptide
TSAGSKD

SEQ ID NO: 4865 - protein, 7 aa, Artificial Sequence
  Description of Artificial Sequence: Synthetic peptide
SREKTEH

SEQ ID NO: 4866 - protein, 7 aa, Artificial Sequence
  Description of Artificial Sequence: Synthetic peptide
SNGTSSG

SEQ ID NO: 4867 - protein, 7 aa, Artificial Sequence
  Description of Artificial Sequence: Synthetic peptide
NGGKGSS

SEQ ID NO: 4868 - protein, 7 aa, Artificial Sequence
  Description of Artificial Sequence: Synthetic peptide
KTAQVSA

SEQ ID NO: 4869 - protein, 7 aa, Artificial Sequence
  Description of Artificial Sequence: Synthetic peptide
QSKSPSH

SEQ ID NO: 4870 - protein, 7 aa, Artificial Sequence
  Description of Artificial Sequence: Synthetic peptide
HNGEQSR

SEQ ID NO: 4871 - protein, 7 aa, Artificial Sequence
  Description of Artificial Sequence: Synthetic peptide
ESTTPGR

SEQ ID NO: 4872 - protein, 7 aa, Artificial Sequence
  Description of Artificial Sequence: Synthetic peptide
SSESKSV

SEQ ID NO: 4873 - protein, 7 aa, Artificial Sequence
  Description of Artificial Sequence: Synthetic peptide
QTGSSNG

SEQ ID NO: 4874 - protein, 7 aa, Artificial Sequence
  Description of Artificial Sequence: Synthetic peptide
ESASHSR

SEQ ID NO: 4875 - protein, 7 aa, Artificial Sequence
  Description of Artificial Sequence: Synthetic peptide
EAHSANK

SEQ ID NO: 4876 - protein, 7 aa, Artificial Sequence
  Description of Artificial Sequence: Synthetic peptide
GDKTSLK

SEQ ID NO: 4877 - protein, 7 aa, Artificial Sequence
  Description of Artificial Sequence: Synthetic peptide
AGVSKPS

SEQ ID NO: 4878 - protein, 7 aa, Artificial Sequence
  Description of Artificial Sequence: Synthetic peptide
THGASSS

SEQ ID NO: 4879 - protein, 7 aa, Artificial Sequence
  Description of Artificial Sequence: Synthetic peptide
STGSGSS

SEQ ID NO: 4880 - protein, 7 aa, Artificial Sequence
  Description of Artificial Sequence: Synthetic peptide
RKGASTE

SEQ ID NO: 4881 - protein, 7 aa, Artificial Sequence
  Description of Artificial Sequence: Synthetic peptide
SLTDKSS

SEQ ID NO: 4882 - protein, 7 aa, Artificial Sequence
  Description of Artificial Sequence: Synthetic peptide
LATKDNS

SEQ ID NO: 4883 - protein, 7 aa, Artificial Sequence
  Description of Artificial Sequence: Synthetic peptide
KNGSTPE

SEQ ID NO: 4884 - protein, 7 aa, Artificial Sequence
  Description of Artificial Sequence: Synthetic peptide
STATSAA

SEQ ID NO: 4885 - protein, 7 aa, Artificial Sequence
  Description of Artificial Sequence: Synthetic peptide
TTTTKSS

SEQ ID NO: 4886 - protein, 7 aa, Artificial Sequence
  Description of Artificial Sequence: Synthetic peptide
TQGNPSQ

SEQ ID NO: 4887 - protein, 7 aa, Artificial Sequence
  Description of Artificial Sequence: Synthetic peptide
VSGSGGK

SEQ ID NO: 4888 - protein, 7 aa, Artificial Sequence
  Description of Artificial Sequence: Synthetic peptide
MPKNTPS

SEQ ID NO: 4889 - protein, 7 aa, Artificial Sequence
  Description of Artificial Sequence: Synthetic peptide
SQKSPPI

SEQ ID NO: 4890 - protein, 7 aa, Artificial Sequence
  Description of Artificial Sequence: Synthetic peptide
DSIRESK

SEQ ID NO: 4891 - protein, 7 aa, Artificial Sequence
  Description of Artificial Sequence: Synthetic peptide
AGDQSKL

SEQ ID NO: 4892 - protein, 7 aa, Artificial Sequence
  Description of Artificial Sequence: Synthetic peptide
EHNGGNK

SEQ ID NO: 4893 - protein, 7 aa, Artificial Sequence
  Description of Artificial Sequence: Synthetic peptide
STMTTSS

SEQ ID NO: 4894 - protein, 7 aa, Artificial Sequence
  Description of Artificial Sequence: Synthetic peptide
SNASKNE

SEQ ID NO: 4895 - protein, 7 aa, Artificial Sequence
  Description of Artificial Sequence: Synthetic peptide
GNGSGPS

SEQ ID NO: 4896 - protein, 7 aa, Artificial Sequence
  Description of Artificial Sequence: Synthetic peptide
TTHTTSG

SEQ ID NO: 4897 - protein, 7 aa, Artificial Sequence
  Description of Artificial Sequence: Synthetic peptide
SQEPSRG

SEQ ID NO: 4898 - protein, 7 aa, Artificial Sequence
  Description of Artificial Sequence: Synthetic peptide
SKQQSSE

SEQ ID NO: 4899 - protein, 7 aa, Artificial Sequence
  Description of Artificial Sequence: Synthetic peptide
DSSGKAN

SEQ ID NO: 4900 - protein, 7 aa, Artificial Sequence
  Description of Artificial Sequence: Synthetic peptide
GANNSST

SEQ ID NO: 4901 - protein, 7 aa, Artificial Sequence
  Description of Artificial Sequence: Synthetic peptide
MDGSSPH

SEQ ID NO: 4902 - protein, 7 aa, Artificial Sequence
  Description of Artificial Sequence: Synthetic peptide
DPSSRPQ

SEQ ID NO: 4903 - protein, 7 aa, Artificial Sequence
  Description of Artificial Sequence: Synthetic peptide
AGETGIK

SEQ ID NO: 4904 - protein, 7 aa, Artificial Sequence
  Description of Artificial Sequence: Synthetic peptide
GNSQTQG

SEQ ID NO: 4905 - protein, 7 aa, Artificial Sequence
  Description of Artificial Sequence: Synthetic peptide
TGQTSTS

SEQ ID NO: 4906 - protein, 7 aa, Artificial Sequence
  Description of Artificial Sequence: Synthetic peptide
VASKSTV

SEQ ID NO: 4907 - protein, 7 aa, Artificial Sequence
  Description of Artificial Sequence: Synthetic peptide
EGANHAS

SEQ ID NO: 4908 - protein, 7 aa, Artificial Sequence
  Description of Artificial Sequence: Synthetic peptide
LNTPSAA

SEQ ID NO: 4909 - protein, 7 aa, Artificial Sequence
  Description of Artificial Sequence: Synthetic peptide
QASDKTY

SEQ ID NO: 4910 - protein, 7 aa, Artificial Sequence
  Description of Artificial Sequence: Synthetic peptide
SQGGSTS

SEQ ID NO: 4911 - protein, 7 aa, Artificial Sequence
  Description of Artificial Sequence: Synthetic peptide
LDGKNSM

SEQ ID NO: 4912 - protein, 7 aa, Artificial Sequence
  Description of Artificial Sequence: Synthetic peptide
MNTPNPH

SEQ ID NO: 4913 - protein, 7 aa, Artificial Sequence
  Description of Artificial Sequence: Synthetic peptide
DVPSKSA

SEQ ID NO: 4914 - protein, 7 aa, Artificial Sequence
  Description of Artificial Sequence: Synthetic peptide
GISNGNS

SEQ ID NO: 4915 - protein, 7 aa, Artificial Sequence
  Description of Artificial Sequence: Synthetic peptide
ALSSSNK

SEQ ID NO: 4916 - protein, 7 aa, Artificial Sequence
  Description of Artificial Sequence: Synthetic peptide
VSSKEAT

SEQ ID NO: 4917 - protein, 7 aa, Artificial Sequence
  Description of Artificial Sequence: Synthetic peptide
SGGAPST

SEQ ID NO: 4918 - protein, 7 aa, Artificial Sequence
  Description of Artificial Sequence: Synthetic peptide
NDTSGTR

SEQ ID NO: 4919 - protein, 7 aa, Artificial Sequence
  Description of Artificial Sequence: Synthetic peptide
TGSESVR

SEQ ID NO: 4920 - protein, 7 aa, Artificial Sequence
  Description of Artificial Sequence: Synthetic peptide
GDGKSTI

SEQ ID NO: 4921 - protein, 7 aa, Artificial Sequence
  Description of Artificial Sequence: Synthetic peptide
LSGDPRG

SEQ ID NO: 4922 - protein, 7 aa, Artificial Sequence
  Description of Artificial Sequence: Synthetic peptide
GSVPGNT

SEQ ID NO: 4923 - protein, 7 aa, Artificial Sequence
  Description of Artificial Sequence: Synthetic peptide
TTTSTTA

SEQ ID NO: 4924 - protein, 7 aa, Artificial Sequence
  Description of Artificial Sequence: Synthetic peptide
QNATAVS

SEQ ID NO: 4925 - protein, 7 aa, Artificial Sequence
  Description of Artificial Sequence: Synthetic peptide
QVPEGQK

SEQ ID NO: 4926 - protein, 7 aa, Artificial Sequence
  Description of Artificial Sequence: Synthetic peptide
STSKTES

SEQ ID NO: 4927 - protein, 7 aa, Artificial Sequence
  Description of Artificial Sequence: Synthetic peptide
ESGSHSA

SEQ ID NO: 4928 - protein, 7 aa, Artificial Sequence
  Description of Artificial Sequence: Synthetic peptide
GSTAAPH

SEQ ID NO: 4929 - protein, 7 aa, Artificial Sequence
  Description of Artificial Sequence: Synthetic peptide
NGAPTAS

SEQ ID NO: 4930 - protein, 7 aa, Artificial Sequence
  Description of Artificial Sequence: Synthetic peptide
TGSSPST

SEQ ID NO: 4931 - protein, 7 aa, Artificial Sequence
  Description of Artificial Sequence: Synthetic peptide
VTGNESK

SEQ ID NO: 4932 - protein, 7 aa, Artificial Sequence
  Description of Artificial Sequence: Synthetic peptide
SGATTSG

SEQ ID NO: 4933 - protein, 7 aa, Artificial Sequence
  Description of Artificial Sequence: Synthetic peptide
AGANSTL

SEQ ID NO: 4934 - protein, 7 aa, Artificial Sequence
  Description of Artificial Sequence: Synthetic peptide
QQDGSHH

SEQ ID NO: 4935 - protein, 7 aa, Artificial Sequence
  Description of Artificial Sequence: Synthetic peptide
GASTSPH

SEQ ID NO: 4936 - protein, 7 aa, Artificial Sequence
  Description of Artificial Sequence: Synthetic peptide
NRGSGTS

SEQ ID NO: 4937 - protein, 7 aa, Artificial Sequence
  Description of Artificial Sequence: Synthetic peptide
NSNSSAG

SEQ ID NO: 4938 - protein, 7 aa, Artificial Sequence
  Description of Artificial Sequence: Synthetic peptide
QSGGTSH

SEQ ID NO: 4939 - protein, 7 aa, Artificial Sequence
  Description of Artificial Sequence: Synthetic peptide
VSGKETS

SEQ ID NO: 4940 - protein, 7 aa, Artificial Sequence
  Description of Artificial Sequence: Synthetic peptide
GTNKDLR

SEQ ID NO: 4941 - protein, 7 aa, Artificial Sequence
  Description of Artificial Sequence: Synthetic peptide
QLSGGTK

SEQ ID NO: 4942 - protein, 7 aa, Artificial Sequence
  Description of Artificial Sequence: Synthetic peptide
DATLKGN

SEQ ID NO: 4943 - protein, 7 aa, Artificial Sequence
  Description of Artificial Sequence: Synthetic peptide
AGNQVAS

SEQ ID NO: 4944 - protein, 7 aa, Artificial Sequence
  Description of Artificial Sequence: Synthetic peptide
ASNEKGG

SEQ ID NO: 4945 - protein, 7 aa, Artificial Sequence
  Description of Artificial Sequence: Synthetic peptide
TSSSAAT

SEQ ID NO: 4946 - protein, 7 aa, Artificial Sequence
  Description of Artificial Sequence: Synthetic peptide
TRDTGSV

SEQ ID NO: 4947 - protein, 7 aa, Artificial Sequence
  Description of Artificial Sequence: Synthetic peptide
KLSKPSD

SEQ ID NO: 4948 - protein, 7 aa, Artificial Sequence
  Description of Artificial Sequence: Synthetic peptide
MGESKIM

SEQ ID NO: 4949 - protein, 7 aa, Artificial Sequence
  Description of Artificial Sequence: Synthetic peptide
GDAKNLA

SEQ ID NO: 4950 - protein, 7 aa, Artificial Sequence
  Description of Artificial Sequence: Synthetic peptide
SQGSSTE

SEQ ID NO: 4951 - protein, 7 aa, Artificial Sequence
  Description of Artificial Sequence: Synthetic peptide
NTGSSGQ

SEQ ID NO: 4952 - protein, 7 aa, Artificial Sequence
  Description of Artificial Sequence: Synthetic peptide
ERGASSI

SEQ ID NO: 4953 - protein, 7 aa, Artificial Sequence
  Description of Artificial Sequence: Synthetic peptide
ATTASKG

SEQ ID NO: 4954 - protein, 7 aa, Artificial Sequence
  Description of Artificial Sequence: Synthetic peptide
AADAKGS

SEQ ID NO: 4955 - protein, 7 aa, Artificial Sequence
  Description of Artificial Sequence: Synthetic peptide
GQGSESR

SEQ ID NO: 4956 - protein, 7 aa, Artificial Sequence
  Description of Artificial Sequence: Synthetic peptide
NASNHKE

SEQ ID NO: 4957 - protein, 7 aa, Artificial Sequence
  Description of Artificial Sequence: Synthetic peptide
GNADNRH

SEQ ID NO: 4958 - protein, 7 aa, Artificial Sequence
  Description of Artificial Sequence: Synthetic peptide
SSNSPNM

SEQ ID NO: 4959 - protein, 7 aa, Artificial Sequence
  Description of Artificial Sequence: Synthetic peptide
SGSQPVG

SEQ ID NO: 4960 - protein, 7 aa, Artificial Sequence
  Description of Artificial Sequence: Synthetic peptide
SNSERSA

SEQ ID NO: 4961 - protein, 7 aa, Artificial Sequence
  Description of Artificial Sequence: Synthetic peptide
SVDQVNR

SEQ ID NO: 4962 - protein, 7 aa, Artificial Sequence
  Description of Artificial Sequence: Synthetic peptide
GPAKSSI

SEQ ID NO: 4963 - protein, 7 aa, Artificial Sequence
  Description of Artificial Sequence: Synthetic peptide
GVGSSNL

SEQ ID NO: 4964 - protein, 7 aa, Artificial Sequence
  Description of Artificial Sequence: Synthetic peptide
NNNKSST

SEQ ID NO: 4965 - protein, 7 aa, Artificial Sequence
  Description of Artificial Sequence: Synthetic peptide
AGNSPSL

SEQ ID NO: 4966 - protein, 7 aa, Artificial Sequence
  Description of Artificial Sequence: Synthetic peptide
GRDAVIG

SEQ ID NO: 4967 - protein, 7 aa, Artificial Sequence
  Description of Artificial Sequence: Synthetic peptide
TSSTSTQ

SEQ ID NO: 4968 - protein, 7 aa, Artificial Sequence
  Description of Artificial Sequence: Synthetic peptide
EVAKTSQ

SEQ ID NO: 4969 - protein, 7 aa, Artificial Sequence
  Description of Artificial Sequence: Synthetic peptide
TDQSQVK

SEQ ID NO: 4970 - protein, 7 aa, Artificial Sequence
  Description of Artificial Sequence: Synthetic peptide
TQATATV

SEQ ID NO: 4971 - protein, 7 aa, Artificial Sequence
  Description of Artificial Sequence: Synthetic peptide
DGSGQNQ

SEQ ID NO: 4972 - protein, 7 aa, Artificial Sequence
  Description of Artificial Sequence: Synthetic peptide
AGVGSTP

SEQ ID NO: 4973 - protein, 7 aa, Artificial Sequence
  Description of Artificial Sequence: Synthetic peptide
NSSKPSE

SEQ ID NO: 4974 - protein, 7 aa, Artificial Sequence
  Description of Artificial Sequence: Synthetic peptide
SGGASGS

SEQ ID NO: 4975 - protein, 7 aa, Artificial Sequence
  Description of Artificial Sequence: Synthetic peptide
HSNQSSS

SEQ ID NO: 4976 - protein, 7 aa, Artificial Sequence
  Description of Artificial Sequence: Synthetic peptide
VTPSNPP

SEQ ID NO: 4977 - protein, 7 aa, Artificial Sequence
  Description of Artificial Sequence: Synthetic peptide
TGASVNE

SEQ ID NO: 4978 - protein, 7 aa, Artificial Sequence
  Description of Artificial Sequence: Synthetic peptide
AQGPTSG

SEQ ID NO: 4979 - protein, 7 aa, Artificial Sequence
  Description of Artificial Sequence: Synthetic peptide
AGPTNNQ

SEQ ID NO: 4980 - protein, 7 aa, Artificial Sequence
  Description of Artificial Sequence: Synthetic peptide
NSGADLK

SEQ ID NO: 4981 - protein, 7 aa, Artificial Sequence
  Description of Artificial Sequence: Synthetic peptide
DSAGKPS

SEQ ID NO: 4982 - protein, 7 aa, Artificial Sequence
  Description of Artificial Sequence: Synthetic peptide
SNGSSIA

SEQ ID NO: 4983 - protein, 7 aa, Artificial Sequence
  Description of Artificial Sequence: Synthetic peptide
RTNSEPK

SEQ ID NO: 4984 - protein, 7 aa, Artificial Sequence
  Description of Artificial Sequence: Synthetic peptide
QTDKPNS

SEQ ID NO: 4985 - protein, 7 aa, Artificial Sequence
  Description of Artificial Sequence: Synthetic peptide
EGQPAIR

SEQ ID NO: 4986 - protein, 7 aa, Artificial Sequence
  Description of Artificial Sequence: Synthetic peptide
GTVNGKG

SEQ ID NO: 4987 - protein, 7 aa, Artificial Sequence
  Description of Artificial Sequence: Synthetic peptide
AGTDKRT

SEQ ID NO: 4988 - protein, 7 aa, Artificial Sequence
  Description of Artificial Sequence: Synthetic peptide
TSPGKPL

SEQ ID NO: 4989 - protein, 7 aa, Artificial Sequence
  Description of Artificial Sequence: Synthetic peptide
HAGKSNT

SEQ ID NO: 4990 - protein, 7 aa, Artificial Sequence
  Description of Artificial Sequence: Synthetic peptide
NANPPNT

SEQ ID NO: 4991 - protein, 7 aa, Artificial Sequence
  Description of Artificial Sequence: Synthetic peptide
SDVSGAK

SEQ ID NO: 4992 - protein, 7 aa, Artificial Sequence
  Description of Artificial Sequence: Synthetic peptide
SGTNVTA

SEQ ID NO: 4993 - protein, 7 aa, Artificial Sequence
  Description of Artificial Sequence: Synthetic peptide
SNGSPTA

SEQ ID NO: 4994 - protein, 7 aa, Artificial Sequence
  Description of Artificial Sequence: Synthetic peptide
TGNGPTS

SEQ ID NO: 4995 - protein, 7 aa, Artificial Sequence
  Description of Artificial Sequence: Synthetic peptide
DAVHGKA

SEQ ID NO: 4996 - protein, 7 aa, Artificial Sequence
  Description of Artificial Sequence: Synthetic peptide
GTTSSPS

SEQ ID NO: 4997 - protein, 7 aa, Artificial Sequence
  Description of Artificial Sequence: Synthetic peptide
NGTTRSQ

SEQ ID NO: 4998 - protein, 7 aa, Artificial Sequence
  Description of Artificial Sequence: Synthetic peptide
RDGTSAT

SEQ ID NO: 4999 - protein, 7 aa, Artificial Sequence
  Description of Artificial Sequence: Synthetic peptide
SPSKEKV

SEQ ID NO: 5000 - protein, 7 aa, Artificial Sequence
  Description of Artificial Sequence: Synthetic peptide
HISPTKG

SEQ ID NO: 5001 - protein, 7 aa, Artificial Sequence
  Description of Artificial Sequence: Synthetic peptide
DTKPGTS

SEQ ID NO: 5002 - protein, 7 aa, Artificial Sequence
  Description of Artificial Sequence: Synthetic peptide
GRKSEGG

SEQ ID NO: 5003 - protein, 7 aa, Artificial Sequence
  Description of Artificial Sequence: Synthetic peptide
SSDTTSK

SEQ ID NO: 5004 - protein, 7 aa, Artificial Sequence
  Description of Artificial Sequence: Synthetic peptide
DNNRNPV

SEQ ID NO: 5005 - protein, 7 aa, Artificial Sequence
  Description of Artificial Sequence: Synthetic peptide
QTVGTQA

SEQ ID NO: 5006 - protein, 7 aa, Artificial Sequence
  Description of Artificial Sequence: Synthetic peptide
ASAPSGK

SEQ ID NO: 5007 - protein, 7 aa, Artificial Sequence
  Description of Artificial Sequence: Synthetic peptide
TLQTASS

SEQ ID NO: 5008 - protein, 7 aa, Artificial Sequence
  Description of Artificial Sequence: Synthetic peptide
DGSSHKT

SEQ ID NO: 5009 - protein, 7 aa, Artificial Sequence
  Description of Artificial Sequence: Synthetic peptide
MSQSPTL

SEQ ID NO: 5010 - protein, 7 aa, Artificial Sequence
  Description of Artificial Sequence: Synthetic peptide
NHASSAA

SEQ ID NO: 5011 - protein, 7 aa, Artificial Sequence
  Description of Artificial Sequence: Synthetic peptide
NTSSPTS

SEQ ID NO: 5012 - protein, 7 aa, Artificial Sequence
  Description of Artificial Sequence: Synthetic peptide
NMGTTAK

SEQ ID NO: 5013 - protein, 7 aa, Artificial Sequence
  Description of Artificial Sequence: Synthetic peptide
QGNGNQI

SEQ ID NO: 5014 - protein, 7 aa, Artificial Sequence
  Description of Artificial Sequence: Synthetic peptide
VGTNNSS

SEQ ID NO: 5015 - protein, 7 aa, Artificial Sequence
  Description of Artificial Sequence: Synthetic peptide
GSSSKTV

SEQ ID NO: 5016 - protein, 7 aa, Artificial Sequence
  Description of Artificial Sequence: Synthetic peptide
DNRAKDG

SEQ ID NO: 5017 - protein, 7 aa, Artificial Sequence
  Description of Artificial Sequence: Synthetic peptide
KTESSAQ

SEQ ID NO: 5018 - protein, 7 aa, Artificial Sequence
  Description of Artificial Sequence: Synthetic peptide
VKNSPST

SEQ ID NO: 5019 - protein, 7 aa, Artificial Sequence
  Description of Artificial Sequence: Synthetic peptide
TGTGSRE

SEQ ID NO: 5020 - protein, 7 aa, Artificial Sequence
  Description of Artificial Sequence: Synthetic peptide
VTGANSA

SEQ ID NO: 5021 - protein, 7 aa, Artificial Sequence
  Description of Artificial Sequence: Synthetic peptide
SSADRNT

SEQ ID NO: 5022 - protein, 7 aa, Artificial Sequence
  Description of Artificial Sequence: Synthetic peptide
SGSSTSV

SEQ ID NO: 5023 - protein, 7 aa, Artificial Sequence
  Description of Artificial Sequence: Synthetic peptide
TMSSKTL

SEQ ID NO: 5024 - protein, 7 aa, Artificial Sequence
  Description of Artificial Sequence: Synthetic peptide
GREATPS

SEQ ID NO: 5025 - protein, 7 aa, Artificial Sequence
  Description of Artificial Sequence: Synthetic peptide
GGSTGGS

SEQ ID NO: 5026 - protein, 7 aa, Artificial Sequence
  Description of Artificial Sequence: Synthetic peptide
NGSTENR

SEQ ID NO: 5027 - protein, 7 aa, Artificial Sequence
  Description of Artificial Sequence: Synthetic peptide
SASSSKV

SEQ ID NO: 5028 - protein, 7 aa, Artificial Sequence
  Description of Artificial Sequence: Synthetic peptide
QLTEKGS

SEQ ID NO: 5029 - protein, 7 aa, Artificial Sequence
  Description of Artificial Sequence: Synthetic peptide
EPVSGGS

SEQ ID NO: 5030 - protein, 7 aa, Artificial Sequence
  Description of Artificial Sequence: Synthetic peptide
STNSPKA

SEQ ID NO: 5031 - protein, 7 aa, Artificial Sequence
  Description of Artificial Sequence: Synthetic peptide
STTKGGD

SEQ ID NO: 5032 - protein, 7 aa, Artificial Sequence
  Description of Artificial Sequence: Synthetic peptide
LQTSKAT

SEQ ID NO: 5033 - protein, 7 aa, Artificial Sequence
  Description of Artificial Sequence: Synthetic peptide
LQSSKDG

SEQ ID NO: 5034 - protein, 7 aa, Artificial Sequence
  Description of Artificial Sequence: Synthetic peptide
STGSPAL

SEQ ID NO: 5035 - protein, 7 aa, Artificial Sequence
  Description of Artificial Sequence: Synthetic peptide
TSAGTNS

SEQ ID NO: 5036 - protein, 7 aa, Artificial Sequence
  Description of Artificial Sequence: Synthetic peptide
GPSTAQN

SEQ ID NO: 5037 - protein, 7 aa, Artificial Sequence
  Description of Artificial Sequence: Synthetic peptide
SGSGSGT

SEQ ID NO: 5038 - protein, 7 aa, Artificial Sequence
  Description of Artificial Sequence: Synthetic peptide
KADSARG

SEQ ID NO: 5039 - protein, 7 aa, Artificial Sequence
  Description of Artificial Sequence: Synthetic peptide
NNGGKAN

SEQ ID NO: 5040 - protein, 7 aa, Artificial Sequence
  Description of Artificial Sequence: Synthetic peptide
MENKSNV

SEQ ID NO: 5041 - protein, 7 aa, Artificial Sequence
  Description of Artificial Sequence: Synthetic peptide
ESPKLGS

SEQ ID NO: 5042 - protein, 7 aa, Artificial Sequence
  Description of Artificial Sequence: Synthetic peptide
VTAPSAA

SEQ ID NO: 5043 - protein, 7 aa, Artificial Sequence
  Description of Artificial Sequence: Synthetic peptide
GTTSNST

SEQ ID NO: 5044 - protein, 7 aa, Artificial Sequence
  Description of Artificial Sequence: Synthetic peptide
ASSKSIM

SEQ ID NO: 5045 - protein, 7 aa, Artificial Sequence
  Description of Artificial Sequence: Synthetic peptide
GNLKGAN

SEQ ID NO: 5046 - protein, 7 aa, Artificial Sequence
  Description of Artificial Sequence: Synthetic peptide
TGATPTN

SEQ ID NO: 5047 - protein, 7 aa, Artificial Sequence
  Description of Artificial Sequence: Synthetic peptide
GPGTGKA

SEQ ID NO: 5048 - protein, 7 aa, Artificial Sequence
  Description of Artificial Sequence: Synthetic peptide
MGVGSPK

SEQ ID NO: 5049 - protein, 7 aa, Artificial Sequence
  Description of Artificial Sequence: Synthetic peptide
STASGTN

SEQ ID NO: 5050 - protein, 7 aa, Artificial Sequence
  Description of Artificial Sequence: Synthetic peptide
NSNATGK

SEQ ID NO: 5051 - protein, 7 aa, Artificial Sequence
  Description of Artificial Sequence: Synthetic peptide
MTGSSTS

SEQ ID NO: 5052 - protein, 7 aa, Artificial Sequence
  Description of Artificial Sequence: Synthetic peptide
SDSTRNT

SEQ ID NO: 5053 - protein, 7 aa, Artificial Sequence
  Description of Artificial Sequence: Synthetic peptide
TSESRTS

SEQ ID NO: 5054 - protein, 7 aa, Artificial Sequence
  Description of Artificial Sequence: Synthetic peptide
APNDSKL

SEQ ID NO: 5055 - protein, 7 aa, Artificial Sequence
  Description of Artificial Sequence: Synthetic peptide
GTGDSRA

SEQ ID NO: 5056 - protein, 7 aa, Artificial Sequence
  Description of Artificial Sequence: Synthetic peptide
SGANNTR

SEQ ID NO: 5057 - protein, 7 aa, Artificial Sequence
  Description of Artificial Sequence: Synthetic peptide
LTGKDRL

SEQ ID NO: 5058 - protein, 7 aa, Artificial Sequence
  Description of Artificial Sequence: Synthetic peptide
ESSTKGV

SEQ ID NO: 5059 - protein, 7 aa, Artificial Sequence
  Description of Artificial Sequence: Synthetic peptide
DTRQSQK

SEQ ID NO: 5060 - protein, 7 aa, Artificial Sequence
  Description of Artificial Sequence: Synthetic peptide
SSKSTAT

SEQ ID NO: 5061 - protein, 7 aa, Artificial Sequence
  Description of Artificial Sequence: Synthetic peptide
RLGDKAE

SEQ ID NO: 5062 - protein, 7 aa, Artificial Sequence
  Description of Artificial Sequence: Synthetic peptide
TGDAKIH

SEQ ID NO: 5063 - protein, 7 aa, Artificial Sequence
  Description of Artificial Sequence: Synthetic peptide
SNDKQGL

SEQ ID NO: 5064 - protein, 7 aa, Artificial Sequence
  Description of Artificial Sequence: Synthetic peptide
ENTHKTV

SEQ ID NO: 5065 - protein, 7 aa, Artificial Sequence
  Description of Artificial Sequence: Synthetic peptide
AGSQEKT

SEQ ID NO: 5066 - protein, 7 aa, Artificial Sequence
  Description of Artificial Sequence: Synthetic peptide
NMNDARS

SEQ ID NO: 5067 - protein, 7 aa, Artificial Sequence
  Description of Artificial Sequence: Synthetic peptide
DSMASVK

SEQ ID NO: 5068 - protein, 7 aa, Artificial Sequence
  Description of Artificial Sequence: Synthetic peptide
QDSLKER

SEQ ID NO: 5069 - protein, 7 aa, Artificial Sequence
  Description of Artificial Sequence: Synthetic peptide
ENTTKSS

SEQ ID NO: 5070 - protein, 7 aa, Artificial Sequence
  Description of Artificial Sequence: Synthetic peptide
ASNASPS

SEQ ID NO: 5071 - protein, 7 aa, Artificial Sequence
  Description of Artificial Sequence: Synthetic peptide
STAPVNA

SEQ ID NO: 5072 - protein, 7 aa, Artificial Sequence
  Description of Artificial Sequence: Synthetic peptide
NAGAASH

SEQ ID NO: 5073 - protein, 7 aa, Artificial Sequence
  Description of Artificial Sequence: Synthetic peptide
TSGSDPR

SEQ ID NO: 5074 - protein, 7 aa, Artificial Sequence
  Description of Artificial Sequence: Synthetic peptide
SGQSVNS

SEQ ID NO: 5075 - protein, 7 aa, Artificial Sequence
  Description of Artificial Sequence: Synthetic peptide
SSNKISQ

SEQ ID NO: 5076 - protein, 7 aa, Artificial Sequence
  Description of Artificial Sequence: Synthetic peptide
QNAQKTS

SEQ ID NO: 5077 - protein, 7 aa, Artificial Sequence
  Description of Artificial Sequence: Synthetic peptide
EVRSNKG

SEQ ID NO: 5078 - protein, 7 aa, Artificial Sequence
  Description of Artificial Sequence: Synthetic peptide
VRDQTTG

SEQ ID NO: 5079 - protein, 7 aa, Artificial Sequence
  Description of Artificial Sequence: Synthetic peptide
FPAGSKD

SEQ ID NO: 5080 - protein, 7 aa, Artificial Sequence
  Description of Artificial Sequence: Synthetic peptide
NSKASAS

SEQ ID NO: 5081 - protein, 7 aa, Artificial Sequence
  Description of Artificial Sequence: Synthetic peptide
NAAQHNT

SEQ ID NO: 5082 - protein, 7 aa, Artificial Sequence
  Description of Artificial Sequence: Synthetic peptide
NSGNAST

SEQ ID NO: 5083 - protein, 7 aa, Artificial Sequence
  Description of Artificial Sequence: Synthetic peptide
THTQSTG

SEQ ID NO: 5084 - protein, 7 aa, Artificial Sequence
  Description of Artificial Sequence: Synthetic peptide
TGHNSLK

SEQ ID NO: 5085 - protein, 7 aa, Artificial Sequence
  Description of Artificial Sequence: Synthetic peptide
TVNAKAG

SEQ ID NO: 5086 - protein, 7 aa, Artificial Sequence
  Description of Artificial Sequence: Synthetic peptide
TNSPTTQ

SEQ ID NO: 5087 - protein, 7 aa, Artificial Sequence
  Description of Artificial Sequence: Synthetic peptide
TMGGSNS

SEQ ID NO: 5088 - protein, 7 aa, Artificial Sequence
  Description of Artificial Sequence: Synthetic peptide
TIGDHPR

SEQ ID NO: 5089 - protein, 7 aa, Artificial Sequence
  Description of Artificial Sequence: Synthetic peptide
TSSPPAN

SEQ ID NO: 5090 - protein, 7 aa, Artificial Sequence
  Description of Artificial Sequence: Synthetic peptide
SSSGTKS

SEQ ID NO: 5091 - protein, 7 aa, Artificial Sequence
  Description of Artificial Sequence: Synthetic peptide
SPESNSK

SEQ ID NO: 5092 - protein, 7 aa, Artificial Sequence
  Description of Artificial Sequence: Synthetic peptide
SGASSAV

SEQ ID NO: 5093 - protein, 7 aa, Artificial Sequence
  Description of Artificial Sequence: Synthetic peptide
SGAQGNM

SEQ ID NO: 5094 - protein, 7 aa, Artificial Sequence
  Description of Artificial Sequence: Synthetic peptide
MSAGKAG

SEQ ID NO: 5095 - protein, 7 aa, Artificial Sequence
  Description of Artificial Sequence: Synthetic peptide
MSSDKGS

SEQ ID NO: 5096 - protein, 7 aa, Artificial Sequence
  Description of Artificial Sequence: Synthetic peptide
HTGGEKA

SEQ ID NO: 5097 - protein, 7 aa, Artificial Sequence
  Description of Artificial Sequence: Synthetic peptide
QNTTGTT

SEQ ID NO: 5098 - protein, 7 aa, Artificial Sequence
  Description of Artificial Sequence: Synthetic peptide
LTSRDQV

SEQ ID NO: 5099 - protein, 7 aa, Artificial Sequence
  Description of Artificial Sequence: Synthetic peptide
LQSGVTG

SEQ ID NO: 5100 - protein, 7 aa, Artificial Sequence
  Description of Artificial Sequence: Synthetic peptide
ESTGASS

SEQ ID NO: 5101 - protein, 7 aa, Artificial Sequence
  Description of Artificial Sequence: Synthetic peptide
EGAGSAG

SEQ ID NO: 5102 - protein, 7 aa, Artificial Sequence
  Description of Artificial Sequence: Synthetic peptide
EVSRNPG

SEQ ID NO: 5103 - protein, 7 aa, Artificial Sequence
  Description of Artificial Sequence: Synthetic peptide
DRVGSST

SEQ ID NO: 5104 - protein, 7 aa, Artificial Sequence
  Description of Artificial Sequence: Synthetic peptide
ATKSNAG

SEQ ID NO: 5105 - protein, 7 aa, Artificial Sequence
  Description of Artificial Sequence: Synthetic peptide
APPTGGH

SEQ ID NO: 5106 - protein, 7 aa, Artificial Sequence
  Description of Artificial Sequence: Synthetic peptide
GHTARDG

SEQ ID NO: 5107 - protein, 7 aa, Artificial Sequence
  Description of Artificial Sequence: Synthetic peptide
GAAGAAS

SEQ ID NO: 5108 - protein, 7 aa, Artificial Sequence
  Description of Artificial Sequence: Synthetic peptide
GGSNAPV

SEQ ID NO: 5109 - protein, 7 aa, Artificial Sequence
  Description of Artificial Sequence: Synthetic peptide
VAGATAG

SEQ ID NO: 5110 - protein, 7 aa, Artificial Sequence
  Description of Artificial Sequence: Synthetic peptide
SMNDKST

SEQ ID NO: 5111 - protein, 7 aa, Artificial Sequence
  Description of Artificial Sequence: Synthetic peptide
SHITSEK

SEQ ID NO: 5112 - protein, 7 aa, Artificial Sequence
  Description of Artificial Sequence: Synthetic peptide
LTNSNAA

SEQ ID NO: 5113 - protein, 7 aa, Artificial Sequence
  Description of Artificial Sequence: Synthetic peptide
LQGTGAG

SEQ ID NO: 5114 - protein, 7 aa, Artificial Sequence
  Description of Artificial Sequence: Synthetic peptide
ANTTKSS

SEQ ID NO: 5115 - protein, 7 aa, Artificial Sequence
  Description of Artificial Sequence: Synthetic peptide
AANDRNL

SEQ ID NO: 5116 - protein, 7 aa, Artificial Sequence
  Description of Artificial Sequence: Synthetic peptide
HGNNTPT

SEQ ID NO: 5117 - protein, 7 aa, Artificial Sequence
  Description of Artificial Sequence: Synthetic peptide
TQNTATS

SEQ ID NO: 5118 - protein, 7 aa, Artificial Sequence
  Description of Artificial Sequence: Synthetic peptide
TSGQPSR

SEQ ID NO: 5119 - protein, 7 aa, Artificial Sequence
  Description of Artificial Sequence: Synthetic peptide
TMTQTSS

SEQ ID NO: 5120 - protein, 7 aa, Artificial Sequence
  Description of Artificial Sequence: Synthetic peptide
SDQKGAQ

SEQ ID NO: 5121 - protein, 7 aa, Artificial Sequence
  Description of Artificial Sequence: Synthetic peptide
GQRGQEG

SEQ ID NO: 5122 - protein, 7 aa, Artificial Sequence
  Description of Artificial Sequence: Synthetic peptide
ENSSSSR

SEQ ID NO: 5123 - protein, 7 aa, Artificial Sequence
  Description of Artificial Sequence: Synthetic peptide
TAATHPA

SEQ ID NO: 5124 - protein, 7 aa, Artificial Sequence
  Description of Artificial Sequence: Synthetic peptide
ASTGKMT

SEQ ID NO: 5125 - protein, 7 aa, Artificial Sequence
  Description of Artificial Sequence: Synthetic peptide
SSESNRS

SEQ ID NO: 5126 - protein, 7 aa, Artificial Sequence
  Description of Artificial Sequence: Synthetic peptide
SSGNGSS

SEQ ID NO: 5127 - protein, 7 aa, Artificial Sequence
  Description of Artificial Sequence: Synthetic peptide
SNGSSTA

SEQ ID NO: 5128 - protein, 7 aa, Artificial Sequence
  Description of Artificial Sequence: Synthetic peptide
GSSTRPE

SEQ ID NO: 5129 - protein, 7 aa, Artificial Sequence
  Description of Artificial Sequence: Synthetic peptide
HVEPKLG

SEQ ID NO: 5130 - protein, 7 aa, Artificial Sequence
  Description of Artificial Sequence: Synthetic peptide
GSSDSRS

SEQ ID NO: 5131 - protein, 7 aa, Artificial Sequence
  Description of Artificial Sequence: Synthetic peptide
GDSKVNN

SEQ ID NO: 5132 - protein, 7 aa, Artificial Sequence
  Description of Artificial Sequence: Synthetic peptide
VGKSSNS

SEQ ID NO: 5133 - protein, 7 aa, Artificial Sequence
  Description of Artificial Sequence: Synthetic peptide
SPGSSVS

SEQ ID NO: 5134 - protein, 7 aa, Artificial Sequence
  Description of Artificial Sequence: Synthetic peptide
LTGPSNT

SEQ ID NO: 5135 - protein, 7 aa, Artificial Sequence
  Description of Artificial Sequence: Synthetic peptide
GGIGTKE

SEQ ID NO: 5136 - protein, 7 aa, Artificial Sequence
  Description of Artificial Sequence: Synthetic peptide
QVAPSNS

SEQ ID NO: 5137 - protein, 7 aa, Artificial Sequence
  Description of Artificial Sequence: Synthetic peptide
GTSQTSS

SEQ ID NO: 5138 - protein, 7 aa, Artificial Sequence
  Description of Artificial Sequence: Synthetic peptide
SGNSSHA

SEQ ID NO: 5139 - protein, 7 aa, Artificial Sequence
  Description of Artificial Sequence: Synthetic peptide
MTTTKAE

SEQ ID NO: 5140 - protein, 7 aa, Artificial Sequence
  Description of Artificial Sequence: Synthetic peptide
EASTRSG

SEQ ID NO: 5141 - protein, 7 aa, Artificial Sequence
  Description of Artificial Sequence: Synthetic peptide
SNKPGTN

SEQ ID NO: 5142 - protein, 7 aa, Artificial Sequence
  Description of Artificial Sequence: Synthetic peptide
NSRPQNN

SEQ ID NO: 5143 - protein, 7 aa, Artificial Sequence
  Description of Artificial Sequence: Synthetic peptide
QGQSNGS

SEQ ID NO: 5144 - protein, 7 aa, Artificial Sequence
  Description of Artificial Sequence: Synthetic peptide
NPTAGGS

SEQ ID NO: 5145 - protein, 7 aa, Artificial Sequence
  Description of Artificial Sequence: Synthetic peptide
HGSGNKG

SEQ ID NO: 5146 - protein, 7 aa, Artificial Sequence
  Description of Artificial Sequence: Synthetic peptide
SGGSGAK

SEQ ID NO: 5147 - protein, 7 aa, Artificial Sequence
  Description of Artificial Sequence: Synthetic peptide
THTSKMS

SEQ ID NO: 5148 - protein, 7 aa, Artificial Sequence
  Description of Artificial Sequence: Synthetic peptide
RDVKPAS

SEQ ID NO: 5149 - protein, 7 aa, Artificial Sequence
  Description of Artificial Sequence: Synthetic peptide
DRSAETR

SEQ ID NO: 5150 - protein, 7 aa, Artificial Sequence
  Description of Artificial Sequence: Synthetic peptide
DAVTSTK

SEQ ID NO: 5151 - protein, 7 aa, Artificial Sequence
  Description of Artificial Sequence: Synthetic peptide
QSTGKLG

SEQ ID NO: 5152 - protein, 7 aa, Artificial Sequence
  Description of Artificial Sequence: Synthetic peptide
DSLSSPK

SEQ ID NO: 5153 - protein, 7 aa, Artificial Sequence
  Description of Artificial Sequence: Synthetic peptide
GDTRVSS

SEQ ID NO: 5154 - protein, 7 aa, Artificial Sequence
  Description of Artificial Sequence: Synthetic peptide
HSAQGSS

SEQ ID NO: 5155 - protein, 7 aa, Artificial Sequence
  Description of Artificial Sequence: Synthetic peptide
GMNTKAT

SEQ ID NO: 5156 - protein, 7 aa, Artificial Sequence
  Description of Artificial Sequence: Synthetic peptide
YGSDKSL

SEQ ID NO: 5157 - protein, 7 aa, Artificial Sequence
  Description of Artificial Sequence: Synthetic peptide
TEDGKQH

SEQ ID NO: 5158 - protein, 7 aa, Artificial Sequence
  Description of Artificial Sequence: Synthetic peptide
STDSQGK

SEQ ID NO: 5159 - protein, 7 aa, Artificial Sequence
  Description of Artificial Sequence: Synthetic peptide
VMADKSS

SEQ ID NO: 5160 - protein, 7 aa, Artificial Sequence
  Description of Artificial Sequence: Synthetic peptide
GASSARE

SEQ ID NO: 5161 - protein, 7 aa, Artificial Sequence
  Description of Artificial Sequence: Synthetic peptide
VNGSTVT

SEQ ID NO: 5162 - protein, 7 aa, Artificial Sequence
  Description of Artificial Sequence: Synthetic peptide
GKQGVSA

SEQ ID NO: 5163 - protein, 7 aa, Artificial Sequence
  Description of Artificial Sequence: Synthetic peptide
TVTDGNR

SEQ ID NO: 5164 - protein, 7 aa, Artificial Sequence
  Description of Artificial Sequence: Synthetic peptide
VSDHKSG

SEQ ID NO: 5165 - protein, 7 aa, Artificial Sequence
  Description of Artificial Sequence: Synthetic peptide
HSASHQA

SEQ ID NO: 5166 - protein, 7 aa, Artificial Sequence
  Description of Artificial Sequence: Synthetic peptide
VSTPSNL

SEQ ID NO: 5167 - protein, 7 aa, Artificial Sequence
  Description of Artificial Sequence: Synthetic peptide
SAGSSRT

SEQ ID NO: 5168 - protein, 7 aa, Artificial Sequence
  Description of Artificial Sequence: Synthetic peptide
TPGASNV

SEQ ID NO: 5169 - protein, 7 aa, Artificial Sequence
  Description of Artificial Sequence: Synthetic peptide
TTSAPPN

SEQ ID NO: 5170 - protein, 7 aa, Artificial Sequence
  Description of Artificial Sequence: Synthetic peptide
NSKQVPG

SEQ ID NO: 5171 - protein, 7 aa, Artificial Sequence
  Description of Artificial Sequence: Synthetic peptide
QSDSAPR

SEQ ID NO: 5172 - protein, 7 aa, Artificial Sequence
  Description of Artificial Sequence: Synthetic peptide
LSNKGSG

SEQ ID NO: 5173 - protein, 7 aa, Artificial Sequence
  Description of Artificial Sequence: Synthetic peptide
KNSGASQ

SEQ ID NO: 5174 - protein, 7 aa, Artificial Sequence
  Description of Artificial Sequence: Synthetic peptide
TIADSNR

SEQ ID NO: 5175 - protein, 7 aa, Artificial Sequence
  Description of Artificial Sequence: Synthetic peptide
SAGGQMS

SEQ ID NO: 5176 - protein, 7 aa, Artificial Sequence
  Description of Artificial Sequence: Synthetic peptide
NSDNRGI

SEQ ID NO: 5177 - protein, 7 aa, Artificial Sequence
  Description of Artificial Sequence: Synthetic peptide
NTGSDVK

SEQ ID NO: 5178 - protein, 7 aa, Artificial Sequence
  Description of Artificial Sequence: Synthetic peptide
NASTSSG

SEQ ID NO: 5179 - protein, 7 aa, Artificial Sequence
  Description of Artificial Sequence: Synthetic peptide
RRDKELS

SEQ ID NO: 5180 - protein, 7 aa, Artificial Sequence
  Description of Artificial Sequence: Synthetic peptide
ETVNKPS

SEQ ID NO: 5181 - protein, 7 aa, Artificial Sequence
  Description of Artificial Sequence: Synthetic peptide
NQGNGSS

SEQ ID NO: 5182 - protein, 7 aa, Artificial Sequence
  Description of Artificial Sequence: Synthetic peptide
EGSSRVG

SEQ ID NO: 5183 - protein, 7 aa, Artificial Sequence
  Description of Artificial Sequence: Synthetic peptide
GSIAGSN

SEQ ID NO: 5184 - protein, 7 aa, Artificial Sequence
  Description of Artificial Sequence: Synthetic peptide
NQTSNST

SEQ ID NO: 5185 - protein, 7 aa, Artificial Sequence
  Description of Artificial Sequence: Synthetic peptide
EGTDRFG

SEQ ID NO: 5186 - protein, 7 aa, Artificial Sequence
  Description of Artificial Sequence: Synthetic peptide
AGGNASQ

SEQ ID NO: 5187 - protein, 7 aa, Artificial Sequence
  Description of Artificial Sequence: Synthetic peptide
RNTSPGV

SEQ ID NO: 5188 - protein, 7 aa, Artificial Sequence
  Description of Artificial Sequence: Synthetic peptide
TGSNSTG

SEQ ID NO: 5189 - protein, 7 aa, Artificial Sequence
  Description of Artificial Sequence: Synthetic peptide
QPGSSLK

SEQ ID NO: 5190 - protein, 7 aa, Artificial Sequence
  Description of Artificial Sequence: Synthetic peptide
INEGNSK

SEQ ID NO: 5191 - protein, 7 aa, Artificial Sequence
  Description of Artificial Sequence: Synthetic peptide
NVPSGNS

SEQ ID NO: 5192 - protein, 7 aa, Artificial Sequence
  Description of Artificial Sequence: Synthetic peptide
ERGANTK

SEQ ID NO: 5193 - protein, 7 aa, Artificial Sequence
  Description of Artificial Sequence: Synthetic peptide
GSAQGSV

SEQ ID NO: 5194 - protein, 7 aa, Artificial Sequence
  Description of Artificial Sequence: Synthetic peptide
DPVTPRA

SEQ ID NO: 5195 - protein, 7 aa, Artificial Sequence
  Description of Artificial Sequence: Synthetic peptide
DSKSGTT

SEQ ID NO: 5196 - protein, 7 aa, Artificial Sequence
  Description of Artificial Sequence: Synthetic peptide
GTTTESR

SEQ ID NO: 5197 - protein, 7 aa, Artificial Sequence
  Description of Artificial Sequence: Synthetic peptide
AGNRDNV

SEQ ID NO: 5198 - protein, 7 aa, Artificial Sequence
  Description of Artificial Sequence: Synthetic peptide
AIQGDSK

SEQ ID NO: 5199 - protein, 7 aa, Artificial Sequence
  Description of Artificial Sequence: Synthetic peptide
GKSDPQG

SEQ ID NO: 5200 - protein, 7 aa, Artificial Sequence
  Description of Artificial Sequence: Synthetic peptide
ELSSPKT

SEQ ID NO: 5201 - protein, 7 aa, Artificial Sequence
  Description of Artificial Sequence: Synthetic peptide
GSSPSVH

SEQ ID NO: 5202 - protein, 7 aa, Artificial Sequence
  Description of Artificial Sequence: Synthetic peptide
QPQDAPK

SEQ ID NO: 5203 - protein, 7 aa, Artificial Sequence
  Description of Artificial Sequence: Synthetic peptide
NSGTNSS

SEQ ID NO: 5204 - protein, 7 aa, Artificial Sequence
  Description of Artificial Sequence: Synthetic peptide
ATGSHSV

SEQ ID NO: 5205 - protein, 7 aa, Artificial Sequence
  Description of Artificial Sequence: Synthetic peptide
DSSTSAK

SEQ ID NO: 5206 - protein, 7 aa, Artificial Sequence
  Description of Artificial Sequence: Synthetic peptide
QQPQAGS

SEQ ID NO: 5207 - protein, 7 aa, Artificial Sequence
  Description of Artificial Sequence: Synthetic peptide
GSSSVRE

SEQ ID NO: 5208 - protein, 7 aa, Artificial Sequence
  Description of Artificial Sequence: Synthetic peptide
SVGGDLK

SEQ ID NO: 5209 - protein, 7 aa, Artificial Sequence
  Description of Artificial Sequence: Synthetic peptide
VQTAQNG

SEQ ID NO: 5210 - protein, 7 aa, Artificial Sequence
  Description of Artificial Sequence: Synthetic peptide
DKTDKTY

SEQ ID NO: 5211 - protein, 7 aa, Artificial Sequence
  Description of Artificial Sequence: Synthetic peptide
SGGDSHR

SEQ ID NO: 5212 - protein, 7 aa, Artificial Sequence
  Description of Artificial Sequence: Synthetic peptide
SMGSEKA

SEQ ID NO: 5213 - protein, 7 aa, Artificial Sequence
  Description of Artificial Sequence: Synthetic peptide
QPPDSKT

SEQ ID NO: 5214 - protein, 7 aa, Artificial Sequence
  Description of Artificial Sequence: Synthetic peptide
ATGQPPR

SEQ ID NO: 5215 - protein, 7 aa, Artificial Sequence
  Description of Artificial Sequence: Synthetic peptide
VGSSSGG

SEQ ID NO: 5216 - protein, 7 aa, Artificial Sequence
  Description of Artificial Sequence: Synthetic peptide
SANSTPR

SEQ ID NO: 5217 - protein, 7 aa, Artificial Sequence
  Description of Artificial Sequence: Synthetic peptide
NSSRESV

SEQ ID NO: 5218 - protein, 7 aa, Artificial Sequence
  Description of Artificial Sequence: Synthetic peptide
NHGDRGG

SEQ ID NO: 5219 - protein, 7 aa, Artificial Sequence
  Description of Artificial Sequence: Synthetic peptide
GVGDTNR

SEQ ID NO: 5220 - protein, 7 aa, Artificial Sequence
  Description of Artificial Sequence: Synthetic peptide
SDSNHRN

SEQ ID NO: 5221 - protein, 7 aa, Artificial Sequence
  Description of Artificial Sequence: Synthetic peptide
STERSGN

SEQ ID NO: 5222 - protein, 7 aa, Artificial Sequence
  Description of Artificial Sequence: Synthetic peptide
HSSDSVK

SEQ ID NO: 5223 - protein, 7 aa, Artificial Sequence
  Description of Artificial Sequence: Synthetic peptide
HGQATIS

SEQ ID NO: 5224 - protein, 7 aa, Artificial Sequence
  Description of Artificial Sequence: Synthetic peptide
SPVPTSA

SEQ ID NO: 5225 - protein, 7 aa, Artificial Sequence
  Description of Artificial Sequence: Synthetic peptide
TKTTANG

SEQ ID NO: 5226 - protein, 7 aa, Artificial Sequence
  Description of Artificial Sequence: Synthetic peptide
EDHGSKG

SEQ ID NO: 5227 - protein, 7 aa, Artificial Sequence
  Description of Artificial Sequence: Synthetic peptide
EGRTPLM

SEQ ID NO: 5228 - protein, 7 aa, Artificial Sequence
  Description of Artificial Sequence: Synthetic peptide
VASERSV

SEQ ID NO: 5229 - protein, 7 aa, Artificial Sequence
  Description of Artificial Sequence: Synthetic peptide
QVSSGHA

SEQ ID NO: 5230 - protein, 7 aa, Artificial Sequence
  Description of Artificial Sequence: Synthetic peptide
LTGTDKG

SEQ ID NO: 5231 - protein, 7 aa, Artificial Sequence
  Description of Artificial Sequence: Synthetic peptide
SNGSAVS

SEQ ID NO: 5232 - protein, 7 aa, Artificial Sequence
  Description of Artificial Sequence: Synthetic peptide
TGAARPD

SEQ ID NO: 5233 - protein, 7 aa, Artificial Sequence
  Description of Artificial Sequence: Synthetic peptide
VSSSSAT

SEQ ID NO: 5234 - protein, 7 aa, Artificial Sequence
  Description of Artificial Sequence: Synthetic peptide
ASSSSQQ

SEQ ID NO: 5235 - protein, 7 aa, Artificial Sequence
  Description of Artificial Sequence: Synthetic peptide
SAPGDTK

SEQ ID NO: 5236 - protein, 7 aa, Artificial Sequence
  Description of Artificial Sequence: Synthetic peptide
GDSQKQG

SEQ ID NO: 5237 - protein, 7 aa, Artificial Sequence
  Description of Artificial Sequence: Synthetic peptide
TGSTGMS

SEQ ID NO: 5238 - protein, 7 aa, Artificial Sequence
  Description of Artificial Sequence: Synthetic peptide
GTSQPST

SEQ ID NO: 5239 - protein, 7 aa, Artificial Sequence
  Description of Artificial Sequence: Synthetic peptide
GTSPGHN

SEQ ID NO: 5240 - protein, 7 aa, Artificial Sequence
  Description of Artificial Sequence: Synthetic peptide
GAGEDRH

SEQ ID NO: 5241 - protein, 7 aa, Artificial Sequence
  Description of Artificial Sequence: Synthetic peptide
GSTKQNE

SEQ ID NO: 5242 - protein, 7 aa, Artificial Sequence
  Description of Artificial Sequence: Synthetic peptide
DASNPGR

SEQ ID NO: 5243 - protein, 7 aa, Artificial Sequence
  Description of Artificial Sequence: Synthetic peptide
SHASAQG

SEQ ID NO: 5244 - protein, 7 aa, Artificial Sequence
  Description of Artificial Sequence: Synthetic peptide
EGGSHVL

SEQ ID NO: 5245 - protein, 7 aa, Artificial Sequence
  Description of Artificial Sequence: Synthetic peptide
THGDKLM

SEQ ID NO: 5246 - protein, 7 aa, Artificial Sequence
  Description of Artificial Sequence: Synthetic peptide
GNVSGHS

SEQ ID NO: 5247 - protein, 7 aa, Artificial Sequence
  Description of Artificial Sequence: Synthetic peptide
STTTKGM

SEQ ID NO: 5248 - protein, 7 aa, Artificial Sequence
  Description of Artificial Sequence: Synthetic peptide
ESTSGGK

SEQ ID NO: 5249 - protein, 7 aa, Artificial Sequence
  Description of Artificial Sequence: Synthetic peptide
GDVGKSV

SEQ ID NO: 5250 - protein, 7 aa, Artificial Sequence
  Description of Artificial Sequence: Synthetic peptide
TSQTHPK

SEQ ID NO: 5251 - protein, 7 aa, Artificial Sequence
  Description of Artificial Sequence: Synthetic peptide
ESSASPR

SEQ ID NO: 5252 - protein, 7 aa, Artificial Sequence
  Description of Artificial Sequence: Synthetic peptide
TQSTSGT

SEQ ID NO: 5253 - protein, 7 aa, Artificial Sequence
  Description of Artificial Sequence: Synthetic peptide
AANSGST

SEQ ID NO: 5254 - protein, 7 aa, Artificial Sequence
  Description of Artificial Sequence: Synthetic peptide
ASGSHAT

SEQ ID NO: 5255 - protein, 7 aa, Artificial Sequence
  Description of Artificial Sequence: Synthetic peptide
EPTAKGN

SEQ ID NO: 5256 - protein, 7 aa, Artificial Sequence
  Description of Artificial Sequence: Synthetic peptide
SGSSSSV

SEQ ID NO: 5257 - protein, 7 aa, Artificial Sequence
  Description of Artificial Sequence: Synthetic peptide
NSGNSSG

SEQ ID NO: 5258 - protein, 7 aa, Artificial Sequence
  Description of Artificial Sequence: Synthetic peptide
TGMDKAL

SEQ ID NO: 5259 - protein, 7 aa, Artificial Sequence
  Description of Artificial Sequence: Synthetic peptide
EGTGKLL

SEQ ID NO: 5260 - protein, 7 aa, Artificial Sequence
  Description of Artificial Sequence: Synthetic peptide
ASSRTPE

SEQ ID NO: 5261 - protein, 7 aa, Artificial Sequence
  Description of Artificial Sequence: Synthetic peptide
NPKPSNT

SEQ ID NO: 5262 - protein, 7 aa, Artificial Sequence
  Description of Artificial Sequence: Synthetic peptide
TTERSGV

SEQ ID NO: 5263 - protein, 7 aa, Artificial Sequence
  Description of Artificial Sequence: Synthetic peptide
GQTDTMK

SEQ ID NO: 5264 - protein, 7 aa, Artificial Sequence
  Description of Artificial Sequence: Synthetic peptide
QGSDTVR

SEQ ID NO: 5265 - protein, 7 aa, Artificial Sequence
  Description of Artificial Sequence: Synthetic peptide
HQNAGVQ

SEQ ID NO: 5266 - protein, 7 aa, Artificial Sequence
  Description of Artificial Sequence: Synthetic peptide
NGDSVHK

SEQ ID NO: 5267 - protein, 7 aa, Artificial Sequence
  Description of Artificial Sequence: Synthetic peptide
SSGSAKE

SEQ ID NO: 5268 - protein, 7 aa, Artificial Sequence
  Description of Artificial Sequence: Synthetic peptide
NTSSSAN

SEQ ID NO: 5269 - protein, 7 aa, Artificial Sequence
  Description of Artificial Sequence: Synthetic peptide
IMQNKQS

SEQ ID NO: 5270 - protein, 7 aa, Artificial Sequence
  Description of Artificial Sequence: Synthetic peptide
SSASPKG

SEQ ID NO: 5271 - protein, 7 aa, Artificial Sequence
  Description of Artificial Sequence: Synthetic peptide
MTGPRAS

SEQ ID NO: 5272 - protein, 7 aa, Artificial Sequence
  Description of Artificial Sequence: Synthetic peptide
QGEGAGK

SEQ ID NO: 5273 - protein, 7 aa, Artificial Sequence
  Description of Artificial Sequence: Synthetic peptide
DQTGAPH

SEQ ID NO: 5274 - protein, 7 aa, Artificial Sequence
  Description of Artificial Sequence: Synthetic peptide
GTKVTNQ

SEQ ID NO: 5275 - protein, 7 aa, Artificial Sequence
  Description of Artificial Sequence: Synthetic peptide
EKLQHTS

SEQ ID NO: 5276 - protein, 7 aa, Artificial Sequence
  Description of Artificial Sequence: Synthetic peptide
EQASHNA

SEQ ID NO: 5277 - protein, 7 aa, Artificial Sequence
  Description of Artificial Sequence: Synthetic peptide
VQSSSTA

SEQ ID NO: 5278 - protein, 7 aa, Artificial Sequence
  Description of Artificial Sequence: Synthetic peptide
SSASQNV

SEQ ID NO: 5279 - protein, 7 aa, Artificial Sequence
  Description of Artificial Sequence: Synthetic peptide
SGASAAA

SEQ ID NO: 5280 - protein, 7 aa, Artificial Sequence
  Description of Artificial Sequence: Synthetic peptide
SVGGSAN

SEQ ID NO: 5281 - protein, 7 aa, Artificial Sequence
  Description of Artificial Sequence: Synthetic peptide
LQNSQAQ

SEQ ID NO: 5282 - protein, 7 aa, Artificial Sequence
  Description of Artificial Sequence: Synthetic peptide
DNAHTTS

SEQ ID NO: 5283 - protein, 7 aa, Artificial Sequence
  Description of Artificial Sequence: Synthetic peptide
AQNPTNM

SEQ ID NO: 5284 - protein, 7 aa, Artificial Sequence
  Description of Artificial Sequence: Synthetic peptide
GVSDKTS

SEQ ID NO: 5285 - protein, 7 aa, Artificial Sequence
  Description of Artificial Sequence: Synthetic peptide
NGSSSAT

SEQ ID NO: 5286 - protein, 7 aa, Artificial Sequence
  Description of Artificial Sequence: Synthetic peptide
SSNATMK

SEQ ID NO: 5287 - protein, 7 aa, Artificial Sequence
  Description of Artificial Sequence: Synthetic peptide
VTNKASV

SEQ ID NO: 5288 - protein, 7 aa, Artificial Sequence
  Description of Artificial Sequence: Synthetic peptide
SDERAST

SEQ ID NO: 5289 - protein, 7 aa, Artificial Sequence
  Description of Artificial Sequence: Synthetic peptide
VAGDKPN

SEQ ID NO: 5290 - protein, 7 aa, Artificial Sequence
  Description of Artificial Sequence: Synthetic peptide
SSTEKPL

SEQ ID NO: 5291 - protein, 7 aa, Artificial Sequence
  Description of Artificial Sequence: Synthetic peptide
VSTGNSN

SEQ ID NO: 5292 - protein, 7 aa, Artificial Sequence
  Description of Artificial Sequence: Synthetic peptide
VTGSNAT

SEQ ID NO: 5293 - protein, 7 aa, Artificial Sequence
  Description of Artificial Sequence: Synthetic peptide
SSTKGEG

SEQ ID NO: 5294 - protein, 7 aa, Artificial Sequence
  Description of Artificial Sequence: Synthetic peptide
SGGTSSI

SEQ ID NO: 5295 - protein, 7 aa, Artificial Sequence
  Description of Artificial Sequence: Synthetic peptide
MVSTGGK

SEQ ID NO: 5296 - protein, 7 aa, Artificial Sequence
  Description of Artificial Sequence: Synthetic peptide
ERANNNN

SEQ ID NO: 5297 - protein, 7 aa, Artificial Sequence
  Description of Artificial Sequence: Synthetic peptide
VAGTSSN

SEQ ID NO: 5298 - protein, 7 aa, Artificial Sequence
  Description of Artificial Sequence: Synthetic peptide
DSGPTSR

SEQ ID NO: 5299 - protein, 7 aa, Artificial Sequence
  Description of Artificial Sequence: Synthetic peptide
TNMAPST

SEQ ID NO: 5300 - protein, 7 aa, Artificial Sequence
  Description of Artificial Sequence: Synthetic peptide
ASQKASG

SEQ ID NO: 5301 - protein, 7 aa, Artificial Sequence
  Description of Artificial Sequence: Synthetic peptide
SSAANSK

SEQ ID NO: 5302 - protein, 7 aa, Artificial Sequence
  Description of Artificial Sequence: Synthetic peptide
TSQGGNA

SEQ ID NO: 5303 - protein, 7 aa, Artificial Sequence
  Description of Artificial Sequence: Synthetic peptide
TGSTHAA

SEQ ID NO: 5304 - protein, 7 aa, Artificial Sequence
  Description of Artificial Sequence: Synthetic peptide
STVDPKA

SEQ ID NO: 5305 - protein, 7 aa, Artificial Sequence
  Description of Artificial Sequence: Synthetic peptide
AAGNSSK

SEQ ID NO: 5306 - protein, 7 aa, Artificial Sequence
  Description of Artificial Sequence: Synthetic peptide
GVNGVKA

SEQ ID NO: 5307 - protein, 7 aa, Artificial Sequence
  Description of Artificial Sequence: Synthetic peptide
GTNAPPS

SEQ ID NO: 5308 - protein, 7 aa, Artificial Sequence
  Description of Artificial Sequence: Synthetic peptide
SGTQVSG

SEQ ID NO: 5309 - protein, 7 aa, Artificial Sequence
  Description of Artificial Sequence: Synthetic peptide
SHGSPTS

SEQ ID NO: 5310 - protein, 7 aa, Artificial Sequence
  Description of Artificial Sequence: Synthetic peptide
GMSKEAS

SEQ ID NO: 5311 - protein, 7 aa, Artificial Sequence
  Description of Artificial Sequence: Synthetic peptide
SSSGGSQ

SEQ ID NO: 5312 - protein, 7 aa, Artificial Sequence
  Description of Artificial Sequence: Synthetic peptide
QQATPHG

SEQ ID NO: 5313 - protein, 7 aa, Artificial Sequence
  Description of Artificial Sequence: Synthetic peptide
GVGNPVN

SEQ ID NO: 5314 - protein, 7 aa, Artificial Sequence
  Description of Artificial Sequence: Synthetic peptide
ASTGEPK

SEQ ID NO: 5315 - protein, 7 aa, Artificial Sequence
  Description of Artificial Sequence: Synthetic peptide
GSPNGNV

SEQ ID NO: 5316 - protein, 7 aa, Artificial Sequence
  Description of Artificial Sequence: Synthetic peptide
NQPTTAG

SEQ ID NO: 5317 - protein, 7 aa, Artificial Sequence
  Description of Artificial Sequence: Synthetic peptide
QKGDRSN

SEQ ID NO: 5318 - protein, 7 aa, Artificial Sequence
  Description of Artificial Sequence: Synthetic peptide
LATGKDG

SEQ ID NO: 5319 - protein, 7 aa, Artificial Sequence
  Description of Artificial Sequence: Synthetic peptide
EQSKIAV

SEQ ID NO: 5320 - protein, 7 aa, Artificial Sequence
  Description of Artificial Sequence: Synthetic peptide
ANTKQTQ

SEQ ID NO: 5321 - protein, 7 aa, Artificial Sequence
  Description of Artificial Sequence: Synthetic peptide
VSSGQPA

SEQ ID NO: 5322 - protein, 7 aa, Artificial Sequence
  Description of Artificial Sequence: Synthetic peptide
SSGTSTK

SEQ ID NO: 5323 - protein, 7 aa, Artificial Sequence
  Description of Artificial Sequence: Synthetic peptide
TDQKTSV

SEQ ID NO: 5324 - protein, 7 aa, Artificial Sequence
  Description of Artificial Sequence: Synthetic peptide
ASTQGNS

SEQ ID NO: 5325 - protein, 7 aa, Artificial Sequence
  Description of Artificial Sequence: Synthetic peptide
DSDKVRN

SEQ ID NO: 5326 - protein, 7 aa, Artificial Sequence
  Description of Artificial Sequence: Synthetic peptide
KEGTANR

SEQ ID NO: 5327 - protein, 7 aa, Artificial Sequence
  Description of Artificial Sequence: Synthetic peptide
STSSQSV

SEQ ID NO: 5328 - protein, 7 aa, Artificial Sequence
  Description of Artificial Sequence: Synthetic peptide
GVSSKSN

SEQ ID NO: 5329 - protein, 7 aa, Artificial Sequence
  Description of Artificial Sequence: Synthetic peptide
YPAGDKG

SEQ ID NO: 5330 - protein, 7 aa, Artificial Sequence
  Description of Artificial Sequence: Synthetic peptide
AHAKESG

SEQ ID NO: 5331 - protein, 7 aa, Artificial Sequence
  Description of Artificial Sequence: Synthetic peptide
QNSTSAS

SEQ ID NO: 5332 - protein, 7 aa, Artificial Sequence
  Description of Artificial Sequence: Synthetic peptide
GADPTSR

SEQ ID NO: 5333 - protein, 7 aa, Artificial Sequence
  Description of Artificial Sequence: Synthetic peptide
SQVNSSK

SEQ ID NO: 5334 - protein, 7 aa, Artificial Sequence
  Description of Artificial Sequence: Synthetic peptide
DSRNPNA

SEQ ID NO: 5335 - protein, 7 aa, Artificial Sequence
  Description of Artificial Sequence: Synthetic peptide
DSGSASV

SEQ ID NO: 5336 - protein, 7 aa, Artificial Sequence
  Description of Artificial Sequence: Synthetic peptide
ANPPTSG

SEQ ID NO: 5337 - protein, 7 aa, Artificial Sequence
  Description of Artificial Sequence: Synthetic peptide
GQGDRLT

SEQ ID NO: 5338 - protein, 7 aa, Artificial Sequence
  Description of Artificial Sequence: Synthetic peptide
SGRDSSG

SEQ ID NO: 5339 - protein, 7 aa, Artificial Sequence
  Description of Artificial Sequence: Synthetic peptide
GGNSTSN

SEQ ID NO: 5340 - protein, 7 aa, Artificial Sequence
  Description of Artificial Sequence: Synthetic peptide
GLGDGRQ

SEQ ID NO: 5341 - protein, 7 aa, Artificial Sequence
  Description of Artificial Sequence: Synthetic peptide
SASGSTQ

SEQ ID NO: 5342 - protein, 7 aa, Artificial Sequence
  Description of Artificial Sequence: Synthetic peptide
RAENSPT

SEQ ID NO: 5343 - protein, 7 aa, Artificial Sequence
  Description of Artificial Sequence: Synthetic peptide
VTDSKSL

SEQ ID NO: 5344 - protein, 7 aa, Artificial Sequence
  Description of Artificial Sequence: Synthetic peptide
KNGSSSG

SEQ ID NO: 5345 - protein, 7 aa, Artificial Sequence
  Description of Artificial Sequence: Synthetic peptide
DSKSNLN

SEQ ID NO: 5346 - protein, 7 aa, Artificial Sequence
  Description of Artificial Sequence: Synthetic peptide
SANDKRV

SEQ ID NO: 5347 - protein, 7 aa, Artificial Sequence
  Description of Artificial Sequence: Synthetic peptide
ATKEQSH

SEQ ID NO: 5348 - protein, 7 aa, Artificial Sequence
  Description of Artificial Sequence: Synthetic peptide
SNDPSVK

SEQ ID NO: 5349 - protein, 7 aa, Artificial Sequence
  Description of Artificial Sequence: Synthetic peptide
LTQDKPS

SEQ ID NO: 5350 - protein, 7 aa, Artificial Sequence
  Description of Artificial Sequence: Synthetic peptide
HGGTSSS

SEQ ID NO: 5351 - protein, 7 aa, Artificial Sequence
  Description of Artificial Sequence: Synthetic peptide
GVDKANL

SEQ ID NO: 5352 - protein, 7 aa, Artificial Sequence
  Description of Artificial Sequence: Synthetic peptide
NHVTKPT

SEQ ID NO: 5353 - protein, 7 aa, Artificial Sequence
  Description of Artificial Sequence: Synthetic peptide
SRDTKNN

SEQ ID NO: 5354 - protein, 7 aa, Artificial Sequence
  Description of Artificial Sequence: Synthetic peptide
EGASKLP

SEQ ID NO: 5355 - protein, 7 aa, Artificial Sequence
  Description of Artificial Sequence: Synthetic peptide
STSPQNA

SEQ ID NO: 5356 - protein, 7 aa, Artificial Sequence
  Description of Artificial Sequence: Synthetic peptide
YGDKTKS

SEQ ID NO: 5357 - protein, 7 aa, Artificial Sequence
  Description of Artificial Sequence: Synthetic peptide
TRNATSV

SEQ ID NO: 5358 - protein, 7 aa, Artificial Sequence
  Description of Artificial Sequence: Synthetic peptide
MSTERSG

SEQ ID NO: 5359 - protein, 7 aa, Artificial Sequence
  Description of Artificial Sequence: Synthetic peptide
IQASGAQ

SEQ ID NO: 5360 - protein, 7 aa, Artificial Sequence
  Description of Artificial Sequence: Synthetic peptide
QSQGASM

SEQ ID NO: 5361 - protein, 7 aa, Artificial Sequence
  Description of Artificial Sequence: Synthetic peptide
AEKGASS

SEQ ID NO: 5362 - protein, 7 aa, Artificial Sequence
  Description of Artificial Sequence: Synthetic peptide
SAGQGLG

SEQ ID NO: 5363 - protein, 7 aa, Artificial Sequence
  Description of Artificial Sequence: Synthetic peptide
NASSKGT

SEQ ID NO: 5364 - protein, 7 aa, Artificial Sequence
  Description of Artificial Sequence: Synthetic peptide
TAGSSRG

SEQ ID NO: 5365 - protein, 7 aa, Artificial Sequence
  Description of Artificial Sequence: Synthetic peptide
LTKTGSA

SEQ ID NO: 5366 - protein, 7 aa, Artificial Sequence
  Description of Artificial Sequence: Synthetic peptide
GSSRPSE

SEQ ID NO: 5367 - protein, 7 aa, Artificial Sequence
  Description of Artificial Sequence: Synthetic peptide
GTDQGRS

SEQ ID NO: 5368 - protein, 7 aa, Artificial Sequence
  Description of Artificial Sequence: Synthetic peptide
STGAATT

SEQ ID NO: 5369 - protein, 7 aa, Artificial Sequence
  Description of Artificial Sequence: Synthetic peptide
ASTGQSV

SEQ ID NO: 5370 - protein, 7 aa, Artificial Sequence
  Description of Artificial Sequence: Synthetic peptide
GIGNKPN

SEQ ID NO: 5371 - protein, 7 aa, Artificial Sequence
  Description of Artificial Sequence: Synthetic peptide
ATARPPG

SEQ ID NO: 5372 - protein, 7 aa, Artificial Sequence
  Description of Artificial Sequence: Synthetic peptide
NTAPAKG

SEQ ID NO: 5373 - protein, 7 aa, Artificial Sequence
  Description of Artificial Sequence: Synthetic peptide
LGGNGQG

SEQ ID NO: 5374 - protein, 7 aa, Artificial Sequence
  Description of Artificial Sequence: Synthetic peptide
NGVAPAG

SEQ ID NO: 5375 - protein, 7 aa, Artificial Sequence
  Description of Artificial Sequence: Synthetic peptide
TSGSSPK

SEQ ID NO: 5376 - protein, 7 aa, Artificial Sequence
  Description of Artificial Sequence: Synthetic peptide
LTGPSAG

SEQ ID NO: 5377 - protein, 7 aa, Artificial Sequence
  Description of Artificial Sequence: Synthetic peptide
DQREKGA

SEQ ID NO: 5378 - protein, 7 aa, Artificial Sequence
  Description of Artificial Sequence: Synthetic peptide
DQGRTPG

SEQ ID NO: 5379 - protein, 7 aa, Artificial Sequence
  Description of Artificial Sequence: Synthetic peptide
AGDKSPY

SEQ ID NO: 5380 - protein, 7 aa, Artificial Sequence
  Description of Artificial Sequence: Synthetic peptide
GAIKPTG

SEQ ID NO: 5381 - protein, 7 aa, Artificial Sequence
  Description of Artificial Sequence: Synthetic peptide
GHTDIKG

SEQ ID NO: 5382 - protein, 7 aa, Artificial Sequence
  Description of Artificial Sequence: Synthetic peptide
VAGMEKG

SEQ ID NO: 5383 - protein, 7 aa, Artificial Sequence
  Description of Artificial Sequence: Synthetic peptide
SPTTTNL

SEQ ID NO: 5384 - protein, 7 aa, Artificial Sequence
  Description of Artificial Sequence: Synthetic peptide
LQGSNSA

SEQ ID NO: 5385 - protein, 7 aa, Artificial Sequence
  Description of Artificial Sequence: Synthetic peptide
NQERPNA

SEQ ID NO: 5386 - protein, 7 aa, Artificial Sequence
  Description of Artificial Sequence: Synthetic peptide
NAAKTMG

SEQ ID NO: 5387 - protein, 7 aa, Artificial Sequence
  Description of Artificial Sequence: Synthetic peptide
TTGNAGL

SEQ ID NO: 5388 - protein, 7 aa, Artificial Sequence
  Description of Artificial Sequence: Synthetic peptide
TRDSTRA

SEQ ID NO: 5389 - protein, 7 aa, Artificial Sequence
  Description of Artificial Sequence: Synthetic peptide
SRTNANM

SEQ ID NO: 5390 - protein, 7 aa, Artificial Sequence
  Description of Artificial Sequence: Synthetic peptide
QIRPSDG

SEQ ID NO: 5391 - protein, 7 aa, Artificial Sequence
  Description of Artificial Sequence: Synthetic peptide
NRDSSAS

SEQ ID NO: 5392 - protein, 7 aa, Artificial Sequence
  Description of Artificial Sequence: Synthetic peptide
KGGGNSS

SEQ ID NO: 5393 - protein, 7 aa, Artificial Sequence
  Description of Artificial Sequence: Synthetic peptide
NNTPSTT

SEQ ID NO: 5394 - protein, 7 aa, Artificial Sequence
  Description of Artificial Sequence: Synthetic peptide
TSSSAHT

SEQ ID NO: 5395 - protein, 7 aa, Artificial Sequence
  Description of Artificial Sequence: Synthetic peptide
GASDQPR

SEQ ID NO: 5396 - protein, 7 aa, Artificial Sequence
  Description of Artificial Sequence: Synthetic peptide
QSSTTNT

SEQ ID NO: 5397 - protein, 7 aa, Artificial Sequence
  Description of Artificial Sequence: Synthetic peptide
SGEGSGR

SEQ ID NO: 5398 - protein, 7 aa, Artificial Sequence
  Description of Artificial Sequence: Synthetic peptide
IVGGAGA

SEQ ID NO: 5399 - protein, 7 aa, Artificial Sequence
  Description of Artificial Sequence: Synthetic peptide
GTVDTRT

SEQ ID NO: 5400 - protein, 7 aa, Artificial Sequence
  Description of Artificial Sequence: Synthetic peptide
SSDSNPR

SEQ ID NO: 5401 - protein, 7 aa, Artificial Sequence
  Description of Artificial Sequence: Synthetic peptide
GSATTIK

SEQ ID NO: 5402 - protein, 7 aa, Artificial Sequence
  Description of Artificial Sequence: Synthetic peptide
HTGTPTV

SEQ ID NO: 5403 - protein, 7 aa, Artificial Sequence
  Description of Artificial Sequence: Synthetic peptide
DGPRSDK

SEQ ID NO: 5404 - protein, 7 aa, Artificial Sequence
  Description of Artificial Sequence: Synthetic peptide
SSTAEVK

SEQ ID NO: 5405 - protein, 7 aa, Artificial Sequence
  Description of Artificial Sequence: Synthetic peptide
TGSGGSA

SEQ ID NO: 5406 - protein, 7 aa, Artificial Sequence
  Description of Artificial Sequence: Synthetic peptide
NGSSTTN

SEQ ID NO: 5407 - protein, 7 aa, Artificial Sequence
  Description of Artificial Sequence: Synthetic peptide
LGQASHG

SEQ ID NO: 5408 - protein, 7 aa, Artificial Sequence
  Description of Artificial Sequence: Synthetic peptide
LQDKPAG

SEQ ID NO: 5409 - protein, 7 aa, Artificial Sequence
  Description of Artificial Sequence: Synthetic peptide
SNNNSAS

SEQ ID NO: 5410 - protein, 7 aa, Artificial Sequence
  Description of Artificial Sequence: Synthetic peptide
NQSPAVQ

SEQ ID NO: 5411 - protein, 7 aa, Artificial Sequence
  Description of Artificial Sequence: Synthetic peptide
DSFKSGS

SEQ ID NO: 5412 - protein, 7 aa, Artificial Sequence
  Description of Artificial Sequence: Synthetic peptide
GTQDGTR

SEQ ID NO: 5413 - protein, 7 aa, Artificial Sequence
  Description of Artificial Sequence: Synthetic peptide
VTGANPN

SEQ ID NO: 5414 - protein, 7 aa, Artificial Sequence
  Description of Artificial Sequence: Synthetic peptide
STGASSH

SEQ ID NO: 5415 - protein, 7 aa, Artificial Sequence
  Description of Artificial Sequence: Synthetic peptide
AQSKENT

SEQ ID NO: 5416 - protein, 7 aa, Artificial Sequence
  Description of Artificial Sequence: Synthetic peptide
TKQATPL

SEQ ID NO: 5417 - protein, 7 aa, Artificial Sequence
  Description of Artificial Sequence: Synthetic peptide
TSEQVAR

SEQ ID NO: 5418 - protein, 7 aa, Artificial Sequence
  Description of Artificial Sequence: Synthetic peptide
SSGEKAL

SEQ ID NO: 5419 - protein, 7 aa, Artificial Sequence
  Description of Artificial Sequence: Synthetic peptide
IGGTAAG

SEQ ID NO: 5420 - protein, 7 aa, Artificial Sequence
  Description of Artificial Sequence: Synthetic peptide
LTTSTNA

SEQ ID NO: 5421 - protein, 7 aa, Artificial Sequence
  Description of Artificial Sequence: Synthetic peptide
YGSKGSA

SEQ ID NO: 5422 - protein, 7 aa, Artificial Sequence
  Description of Artificial Sequence: Synthetic peptide
TSGKNNN

SEQ ID NO: 5423 - protein, 7 aa, Artificial Sequence
  Description of Artificial Sequence: Synthetic peptide
GSKSGVA

SEQ ID NO: 5424 - protein, 7 aa, Artificial Sequence
  Description of Artificial Sequence: Synthetic peptide
SGSGDKS

SEQ ID NO: 5425 - protein, 7 aa, Artificial Sequence
  Description of Artificial Sequence: Synthetic peptide
MNNTSNK

SEQ ID NO: 5426 - protein, 7 aa, Artificial Sequence
  Description of Artificial Sequence: Synthetic peptide
DNGKAIA

SEQ ID NO: 5427 - protein, 7 aa, Artificial Sequence
  Description of Artificial Sequence: Synthetic peptide
TNVDKAS

SEQ ID NO: 5428 - protein, 7 aa, Artificial Sequence
  Description of Artificial Sequence: Synthetic peptide
MPGETKG

SEQ ID NO: 5429 - protein, 7 aa, Artificial Sequence
  Description of Artificial Sequence: Synthetic peptide
QANQGGN

SEQ ID NO: 5430 - protein, 7 aa, Artificial Sequence
  Description of Artificial Sequence: Synthetic peptide
ERSTSST

SEQ ID NO: 5431 - protein, 7 aa, Artificial Sequence
  Description of Artificial Sequence: Synthetic peptide
LARDKSV

SEQ ID NO: 5432 - protein, 7 aa, Artificial Sequence
  Description of Artificial Sequence: Synthetic peptide
TGSSSPV

SEQ ID NO: 5433 - protein, 7 aa, Artificial Sequence
  Description of Artificial Sequence: Synthetic peptide
ESSTPAR

SEQ ID NO: 5434 - protein, 7 aa, Artificial Sequence
  Description of Artificial Sequence: Synthetic peptide
SASPSTQ

SEQ ID NO: 5435 - protein, 7 aa, Artificial Sequence
  Description of Artificial Sequence: Synthetic peptide
NNAQGSS

SEQ ID NO: 5436 - protein, 7 aa, Artificial Sequence
  Description of Artificial Sequence: Synthetic peptide
DAQRPTA

SEQ ID NO: 5437 - protein, 7 aa, Artificial Sequence
  Description of Artificial Sequence: Synthetic peptide
DTTAKQG

SEQ ID NO: 5438 - protein, 7 aa, Artificial Sequence
  Description of Artificial Sequence: Synthetic peptide
AGGNNAH

SEQ ID NO: 5439 - protein, 7 aa, Artificial Sequence
  Description of Artificial Sequence: Synthetic peptide
ASKGNSL

SEQ ID NO: 5440 - protein, 7 aa, Artificial Sequence
  Description of Artificial Sequence: Synthetic peptide
GDKANAH

SEQ ID NO: 5441 - protein, 7 aa, Artificial Sequence
  Description of Artificial Sequence: Synthetic peptide
EPGAAIK

SEQ ID NO: 5442 - protein, 7 aa, Artificial Sequence
  Description of Artificial Sequence: Synthetic peptide
ISDKTPQ

SEQ ID NO: 5443 - protein, 7 aa, Artificial Sequence
  Description of Artificial Sequence: Synthetic peptide
FSNAKNG

SEQ ID NO: 5444 - protein, 7 aa, Artificial Sequence
  Description of Artificial Sequence: Synthetic peptide
TSEHKSQ

SEQ ID NO: 5445 - protein, 7 aa, Artificial Sequence
  Description of Artificial Sequence: Synthetic peptide
TGGNGFA

SEQ ID NO: 5446 - protein, 7 aa, Artificial Sequence
  Description of Artificial Sequence: Synthetic peptide
SSKPSAA

SEQ ID NO: 5447 - protein, 7 aa, Artificial Sequence
  Description of Artificial Sequence: Synthetic peptide
VGKSELT

SEQ ID NO: 5448 - protein, 7 aa, Artificial Sequence
  Description of Artificial Sequence: Synthetic peptide
NSRTPST

SEQ ID NO: 5449 - protein, 7 aa, Artificial Sequence
  Description of Artificial Sequence: Synthetic peptide
TGQERSS

SEQ ID NO: 5450 - protein, 7 aa, Artificial Sequence
  Description of Artificial Sequence: Synthetic peptide
NSAGSNS

SEQ ID NO: 5451 - protein, 7 aa, Artificial Sequence
  Description of Artificial Sequence: Synthetic peptide
SGSNTVQ

SEQ ID NO: 5452 - protein, 7 aa, Artificial Sequence
  Description of Artificial Sequence: Synthetic peptide
SSTKVAQ

SEQ ID NO: 5453 - protein, 7 aa, Artificial Sequence
  Description of Artificial Sequence: Synthetic peptide
ASGGSRT

SEQ ID NO: 5454 - protein, 7 aa, Artificial Sequence
  Description of Artificial Sequence: Synthetic peptide
QSSTSQV

SEQ ID NO: 5455 - protein, 7 aa, Artificial Sequence
  Description of Artificial Sequence: Synthetic peptide
NVGNPVS

SEQ ID NO: 5456 - protein, 7 aa, Artificial Sequence
  Description of Artificial Sequence: Synthetic peptide
SNTASAS

SEQ ID NO: 5457 - protein, 7 aa, Artificial Sequence
  Description of Artificial Sequence: Synthetic peptide
EGTHPIV

SEQ ID NO: 5458 - protein, 7 aa, Artificial Sequence
  Description of Artificial Sequence: Synthetic peptide
AVAGAKA

SEQ ID NO: 5459 - protein, 7 aa, Artificial Sequence
  Description of Artificial Sequence: Synthetic peptide
GESGPKS

SEQ ID NO: 5460 - protein, 7 aa, Artificial Sequence
  Description of Artificial Sequence: Synthetic peptide
THGKTPV

SEQ ID NO: 5461 - protein, 7 aa, Artificial Sequence
  Description of Artificial Sequence: Synthetic peptide
VASQTQA

SEQ ID NO: 5462 - protein, 7 aa, Artificial Sequence
  Description of Artificial Sequence: Synthetic peptide
SSTTSVH

SEQ ID NO: 5463 - protein, 7 aa, Artificial Sequence
  Description of Artificial Sequence: Synthetic peptide
SGTSSLQ

SEQ ID NO: 5464 - protein, 7 aa, Artificial Sequence
  Description of Artificial Sequence: Synthetic peptide
SSGASNS

SEQ ID NO: 5465 - protein, 7 aa, Artificial Sequence
  Description of Artificial Sequence: Synthetic peptide
QNKPGSV

SEQ ID NO: 5466 - protein, 7 aa, Artificial Sequence
  Description of Artificial Sequence: Synthetic peptide
TTGSAAL

SEQ ID NO: 5467 - protein, 7 aa, Artificial Sequence
  Description of Artificial Sequence: Synthetic peptide
NVRQTNE

SEQ ID NO: 5468 - protein, 7 aa, Artificial Sequence
  Description of Artificial Sequence: Synthetic peptide
DQGTSTL

SEQ ID NO: 5469 - protein, 7 aa, Artificial Sequence
  Description of Artificial Sequence: Synthetic peptide
VSGQVSS

SEQ ID NO: 5470 - protein, 7 aa, Artificial Sequence
  Description of Artificial Sequence: Synthetic peptide
NLKSSPS

SEQ ID NO: 5471 - protein, 7 aa, Artificial Sequence
  Description of Artificial Sequence: Synthetic peptide
NSGDAQH

SEQ ID NO: 5472 - protein, 7 aa, Artificial Sequence
  Description of Artificial Sequence: Synthetic peptide
GTAGAMS

SEQ ID NO: 5473 - protein, 7 aa, Artificial Sequence
  Description of Artificial Sequence: Synthetic peptide
TKDKGMT

SEQ ID NO: 5474 - protein, 7 aa, Artificial Sequence
  Description of Artificial Sequence: Synthetic peptide
ANTKDGR

SEQ ID NO: 5475 - protein, 7 aa, Artificial Sequence
  Description of Artificial Sequence: Synthetic peptide
NGNLSTG

SEQ ID NO: 5476 - protein, 7 aa, Artificial Sequence
  Description of Artificial Sequence: Synthetic peptide
TSKGNSG

SEQ ID NO: 5477 - protein, 7 aa, Artificial Sequence
  Description of Artificial Sequence: Synthetic peptide
STSPSGG

SEQ ID NO: 5478 - protein, 7 aa, Artificial Sequence
  Description of Artificial Sequence: Synthetic peptide
SGSPGAG

SEQ ID NO: 5479 - protein, 7 aa, Artificial Sequence
  Description of Artificial Sequence: Synthetic peptide
QQSSGTG

SEQ ID NO: 5480 - protein, 7 aa, Artificial Sequence
  Description of Artificial Sequence: Synthetic peptide
DVTAKNA

SEQ ID NO: 5481 - protein, 7 aa, Artificial Sequence
  Description of Artificial Sequence: Synthetic peptide
ASDKSAG

SEQ ID NO: 5482 - protein, 7 aa, Artificial Sequence
  Description of Artificial Sequence: Synthetic peptide
APTEGGR

SEQ ID NO: 5483 - protein, 7 aa, Artificial Sequence
  Description of Artificial Sequence: Synthetic peptide
GSPNGHA

SEQ ID NO: 5484 - protein, 7 aa, Artificial Sequence
  Description of Artificial Sequence: Synthetic peptide
GGTEKLS

SEQ ID NO: 5485 - protein, 7 aa, Artificial Sequence
  Description of Artificial Sequence: Synthetic peptide
VRNSATE

SEQ ID NO: 5486 - protein, 7 aa, Artificial Sequence
  Description of Artificial Sequence: Synthetic peptide
LDGKSVS

SEQ ID NO: 5487 - protein, 7 aa, Artificial Sequence
  Description of Artificial Sequence: Synthetic peptide
GAETNRV

SEQ ID NO: 5488 - protein, 7 aa, Artificial Sequence
  Description of Artificial Sequence: Synthetic peptide
MQTKQPG

SEQ ID NO: 5489 - protein, 7 aa, Artificial Sequence
  Description of Artificial Sequence: Synthetic peptide
LGTQNVT

SEQ ID NO: 5490 - protein, 7 aa, Artificial Sequence
  Description of Artificial Sequence: Synthetic peptide
DQQSNLK

SEQ ID NO: 5491 - protein, 7 aa, Artificial Sequence
  Description of Artificial Sequence: Synthetic peptide
GPGSGST

SEQ ID NO: 5492 - protein, 7 aa, Artificial Sequence
  Description of Artificial Sequence: Synthetic peptide
QGSNPPT

SEQ ID NO: 5493 - protein, 7 aa, Artificial Sequence
  Description of Artificial Sequence: Synthetic peptide
DDASQKL

SEQ ID NO: 5494 - protein, 7 aa, Artificial Sequence
  Description of Artificial Sequence: Synthetic peptide
GNVSKGG

SEQ ID NO: 5495 - protein, 7 aa, Artificial Sequence
  Description of Artificial Sequence: Synthetic peptide
GADTKAH

SEQ ID NO: 5496 - protein, 7 aa, Artificial Sequence
  Description of Artificial Sequence: Synthetic peptide
MGSNPPN

SEQ ID NO: 5497 - protein, 7 aa, Artificial Sequence
  Description of Artificial Sequence: Synthetic peptide
KSGTHPD

SEQ ID NO: 5498 - protein, 7 aa, Artificial Sequence
  Description of Artificial Sequence: Synthetic peptide
EVSPKTS

SEQ ID NO: 5499 - protein, 7 aa, Artificial Sequence
  Description of Artificial Sequence: Synthetic peptide
DSTALSK

SEQ ID NO: 5500 - protein, 7 aa, Artificial Sequence
  Description of Artificial Sequence: Synthetic peptide
RDGGKGS

SEQ ID NO: 5501 - protein, 7 aa, Artificial Sequence
  Description of Artificial Sequence: Synthetic peptide
SNLSTPK

SEQ ID NO: 5502 - protein, 7 aa, Artificial Sequence
  Description of Artificial Sequence: Synthetic peptide
KSTPSAV

SEQ ID NO: 5503 - protein, 7 aa, Artificial Sequence
  Description of Artificial Sequence: Synthetic peptide
GNAQSPV

SEQ ID NO: 5504 - protein, 7 aa, Artificial Sequence
  Description of Artificial Sequence: Synthetic peptide
GVTNSAA

SEQ ID NO: 5505 - protein, 7 aa, Artificial Sequence
  Description of Artificial Sequence: Synthetic peptide
FTDSKAS

SEQ ID NO: 5506 - protein, 7 aa, Artificial Sequence
  Description of Artificial Sequence: Synthetic peptide
SNNSTIK

SEQ ID NO: 5507 - protein, 7 aa, Artificial Sequence
  Description of Artificial Sequence: Synthetic peptide
MPLESSK

SEQ ID NO: 5508 - protein, 7 aa, Artificial Sequence
  Description of Artificial Sequence: Synthetic peptide
TGKQSGS

SEQ ID NO: 5509 - protein, 7 aa, Artificial Sequence
  Description of Artificial Sequence: Synthetic peptide
VPNGSPN

SEQ ID NO: 5510 - protein, 7 aa, Artificial Sequence
  Description of Artificial Sequence: Synthetic peptide
NGTAQNL

SEQ ID NO: 5511 - protein, 7 aa, Artificial Sequence
  Description of Artificial Sequence: Synthetic peptide
SMNKSGL

SEQ ID NO: 5512 - protein, 7 aa, Artificial Sequence
  Description of Artificial Sequence: Synthetic peptide
LADKGTA

SEQ ID NO: 5513 - protein, 7 aa, Artificial Sequence
  Description of Artificial Sequence: Synthetic peptide
NGPVPVK

SEQ ID NO: 5514 - protein, 7 aa, Artificial Sequence
  Description of Artificial Sequence: Synthetic peptide
SRATSNA

SEQ ID NO: 5515 - protein, 7 aa, Artificial Sequence
  Description of Artificial Sequence: Synthetic peptide
SGSDSHR

SEQ ID NO: 5516 - protein, 7 aa, Artificial Sequence
  Description of Artificial Sequence: Synthetic peptide
NGGDKFK

SEQ ID NO: 5517 - protein, 7 aa, Artificial Sequence
  Description of Artificial Sequence: Synthetic peptide
AQADQSK

SEQ ID NO: 5518 - protein, 7 aa, Artificial Sequence
  Description of Artificial Sequence: Synthetic peptide
STKSAEG

SEQ ID NO: 5519 - protein, 7 aa, Artificial Sequence
  Description of Artificial Sequence: Synthetic peptide
NSESKAS

SEQ ID NO: 5520 - protein, 7 aa, Artificial Sequence
  Description of Artificial Sequence: Synthetic peptide
HTANATS

SEQ ID NO: 5521 - protein, 7 aa, Artificial Sequence
  Description of Artificial Sequence: Synthetic peptide
STSQSSA

SEQ ID NO: 5522 - protein, 7 aa, Artificial Sequence
  Description of Artificial Sequence: Synthetic peptide
QNSTHPS

SEQ ID NO: 5523 - protein, 7 aa, Artificial Sequence
  Description of Artificial Sequence: Synthetic peptide
DTQKSLN

SEQ ID NO: 5524 - protein, 7 aa, Artificial Sequence
  Description of Artificial Sequence: Synthetic peptide
SGIGSAT

SEQ ID NO: 5525 - protein, 7 aa, Artificial Sequence
  Description of Artificial Sequence: Synthetic peptide
IGREKSQ

SEQ ID NO: 5526 - protein, 7 aa, Artificial Sequence
  Description of Artificial Sequence: Synthetic peptide
QKQHASE

SEQ ID NO: 5527 - protein, 7 aa, Artificial Sequence
  Description of Artificial Sequence: Synthetic peptide
DSTKQAF

SEQ ID NO: 5528 - protein, 7 aa, Artificial Sequence
  Description of Artificial Sequence: Synthetic peptide
LRDSGNG

SEQ ID NO: 5529 - protein, 7 aa, Artificial Sequence
  Description of Artificial Sequence: Synthetic peptide
SASTPKD

SEQ ID NO: 5530 - protein, 7 aa, Artificial Sequence
  Description of Artificial Sequence: Synthetic peptide
SGAPSSL

SEQ ID NO: 5531 - protein, 7 aa, Artificial Sequence
  Description of Artificial Sequence: Synthetic peptide
KTSSTNV

SEQ ID NO: 5532 - protein, 7 aa, Artificial Sequence
  Description of Artificial Sequence: Synthetic peptide
GGGPSAG

SEQ ID NO: 5533 - protein, 7 aa, Artificial Sequence
  Description of Artificial Sequence: Synthetic peptide
EGVNSAK

SEQ ID NO: 5534 - protein, 7 aa, Artificial Sequence
  Description of Artificial Sequence: Synthetic peptide
STGKPGN

SEQ ID NO: 5535 - protein, 7 aa, Artificial Sequence
  Description of Artificial Sequence: Synthetic peptide
EGGGQAH

SEQ ID NO: 5536 - protein, 7 aa, Artificial Sequence
  Description of Artificial Sequence: Synthetic peptide
SGKGTSI

SEQ ID NO: 5537 - protein, 7 aa, Artificial Sequence
  Description of Artificial Sequence: Synthetic peptide
SSTNGTS

SEQ ID NO: 5538 - protein, 7 aa, Artificial Sequence
  Description of Artificial Sequence: Synthetic peptide
ASDNSPR

SEQ ID NO: 5539 - protein, 7 aa, Artificial Sequence
  Description of Artificial Sequence: Synthetic peptide
TKNSGNS

SEQ ID NO: 5540 - protein, 7 aa, Artificial Sequence
  Description of Artificial Sequence: Synthetic peptide
SANGKPM

SEQ ID NO: 5541 - protein, 7 aa, Artificial Sequence
  Description of Artificial Sequence: Synthetic peptide
STGDQRQ

SEQ ID NO: 5542 - protein, 7 aa, Artificial Sequence
  Description of Artificial Sequence: Synthetic peptide
SGQNVNG

SEQ ID NO: 5543 - protein, 7 aa, Artificial Sequence
  Description of Artificial Sequence: Synthetic peptide
VRSTSNV

SEQ ID NO: 5544 - protein, 7 aa, Artificial Sequence
  Description of Artificial Sequence: Synthetic peptide
SSAQKGD

SEQ ID NO: 5545 - protein, 7 aa, Artificial Sequence
  Description of Artificial Sequence: Synthetic peptide
VGTPHSG

SEQ ID NO: 5546 - protein, 7 aa, Artificial Sequence
  Description of Artificial Sequence: Synthetic peptide
KGGDSSS

SEQ ID NO: 5547 - protein, 7 aa, Artificial Sequence
  Description of Artificial Sequence: Synthetic peptide
NQVQQSH

SEQ ID NO: 5548 - protein, 7 aa, Artificial Sequence
  Description of Artificial Sequence: Synthetic peptide
SPDKSTA

SEQ ID NO: 5549 - protein, 7 aa, Artificial Sequence
  Description of Artificial Sequence: Synthetic peptide
LTTSSSG

SEQ ID NO: 5550 - protein, 7 aa, Artificial Sequence
  Description of Artificial Sequence: Synthetic peptide
ENKSPSL

SEQ ID NO: 5551 - protein, 7 aa, Artificial Sequence
  Description of Artificial Sequence: Synthetic peptide
DMSSKAT

SEQ ID NO: 5552 - protein, 7 aa, Artificial Sequence
  Description of Artificial Sequence: Synthetic peptide
LGTQPGT

SEQ ID NO: 5553 - protein, 7 aa, Artificial Sequence
  Description of Artificial Sequence: Synthetic peptide
NGASKDS

SEQ ID NO: 5554 - protein, 7 aa, Artificial Sequence
  Description of Artificial Sequence: Synthetic peptide
SSTATHV

SEQ ID NO: 5555 - protein, 7 aa, Artificial Sequence
  Description of Artificial Sequence: Synthetic peptide
HQGAASS

SEQ ID NO: 5556 - protein, 7 aa, Artificial Sequence
  Description of Artificial Sequence: Synthetic peptide
GRNSTPH

SEQ ID NO: 5557 - protein, 7 aa, Artificial Sequence
  Description of Artificial Sequence: Synthetic peptide
QTSTSVA

SEQ ID NO: 5558 - protein, 7 aa, Artificial Sequence
  Description of Artificial Sequence: Synthetic peptide
VGTKQPV

SEQ ID NO: 5559 - protein, 7 aa, Artificial Sequence
  Description of Artificial Sequence: Synthetic peptide
GDNNAKT

SEQ ID NO: 5560 - protein, 7 aa, Artificial Sequence
  Description of Artificial Sequence: Synthetic peptide
VGGGAIK

SEQ ID NO: 5561 - protein, 7 aa, Artificial Sequence
  Description of Artificial Sequence: Synthetic peptide
GTGAEKA

SEQ ID NO: 5562 - protein, 7 aa, Artificial Sequence
  Description of Artificial Sequence: Synthetic peptide
NSPTQGS

SEQ ID NO: 5563 - protein, 7 aa, Artificial Sequence
  Description of Artificial Sequence: Synthetic peptide
DTGSKHS

SEQ ID NO: 5564 - protein, 7 aa, Artificial Sequence
  Description of Artificial Sequence: Synthetic peptide
GTTQVSK

SEQ ID NO: 5565 - protein, 7 aa, Artificial Sequence
  Description of Artificial Sequence: Synthetic peptide
YGGKTGT

SEQ ID NO: 5566 - protein, 7 aa, Artificial Sequence
  Description of Artificial Sequence: Synthetic peptide
DSSNKSV

SEQ ID NO: 5567 - protein, 7 aa, Artificial Sequence
  Description of Artificial Sequence: Synthetic peptide
NAGSSSH

SEQ ID NO: 5568 - protein, 7 aa, Artificial Sequence
  Description of Artificial Sequence: Synthetic peptide
NQGNGGM

SEQ ID NO: 5569 - protein, 7 aa, Artificial Sequence
  Description of Artificial Sequence: Synthetic peptide
AGSSQSG

SEQ ID NO: 5570 - protein, 7 aa, Artificial Sequence
  Description of Artificial Sequence: Synthetic peptide
ASTGDKV

SEQ ID NO: 5571 - protein, 7 aa, Artificial Sequence
  Description of Artificial Sequence: Synthetic peptide
GTTSAKE

SEQ ID NO: 5572 - protein, 7 aa, Artificial Sequence
  Description of Artificial Sequence: Synthetic peptide
GIGTGNL

SEQ ID NO: 5573 - protein, 7 aa, Artificial Sequence
  Description of Artificial Sequence: Synthetic peptide
SPVPNGL

SEQ ID NO: 5574 - protein, 7 aa, Artificial Sequence
  Description of Artificial Sequence: Synthetic peptide
DQSSKLQ

SEQ ID NO: 5575 - protein, 7 aa, Artificial Sequence
  Description of Artificial Sequence: Synthetic peptide
QSANPPI

SEQ ID NO: 5576 - protein, 7 aa, Artificial Sequence
  Description of Artificial Sequence: Synthetic peptide
GSESRPL

SEQ ID NO: 5577 - protein, 7 aa, Artificial Sequence
  Description of Artificial Sequence: Synthetic peptide
CTASKAE

SEQ ID NO: 5578 - protein, 7 aa, Artificial Sequence
  Description of Artificial Sequence: Synthetic peptide
QADAPSR

SEQ ID NO: 5579 - protein, 7 aa, Artificial Sequence
  Description of Artificial Sequence: Synthetic peptide
EAISAPK

SEQ ID NO: 5580 - protein, 7 aa, Artificial Sequence
  Description of Artificial Sequence: Synthetic peptide
DSGSANR

SEQ ID NO: 5581 - protein, 7 aa, Artificial Sequence
  Description of Artificial Sequence: Synthetic peptide
ATGPTSH

SEQ ID NO: 5582 - protein, 7 aa, Artificial Sequence
  Description of Artificial Sequence: Synthetic peptide
TAAASSK

SEQ ID NO: 5583 - protein, 7 aa, Artificial Sequence
  Description of Artificial Sequence: Synthetic peptide
SGAERSL

SEQ ID NO: 5584 - protein, 7 aa, Artificial Sequence
  Description of Artificial Sequence: Synthetic peptide
DSKSGTS

SEQ ID NO: 5585 - protein, 7 aa, Artificial Sequence
  Description of Artificial Sequence: Synthetic peptide
SVGQSPN

SEQ ID NO: 5586 - protein, 7 aa, Artificial Sequence
  Description of Artificial Sequence: Synthetic peptide
GVAQRDG

SEQ ID NO: 5587 - protein, 7 aa, Artificial Sequence
  Description of Artificial Sequence: Synthetic peptide
DSGQASK

SEQ ID NO: 5588 - protein, 7 aa, Artificial Sequence
  Description of Artificial Sequence: Synthetic peptide
AGDNATR

SEQ ID NO: 5589 - protein, 7 aa, Artificial Sequence
  Description of Artificial Sequence: Synthetic peptide
MAKPTST

SEQ ID NO: 5590 - protein, 7 aa, Artificial Sequence
  Description of Artificial Sequence: Synthetic peptide
DATSRNT

SEQ ID NO: 5591 - protein, 7 aa, Artificial Sequence
  Description of Artificial Sequence: Synthetic peptide
TNEGNHR

SEQ ID NO: 5592 - protein, 7 aa, Artificial Sequence
  Description of Artificial Sequence: Synthetic peptide
TGQSPGS

SEQ ID NO: 5593 - protein, 7 aa, Artificial Sequence
  Description of Artificial Sequence: Synthetic peptide
NSSPPTT

SEQ ID NO: 5594 - protein, 7 aa, Artificial Sequence
  Description of Artificial Sequence: Synthetic peptide
ITGQGGV

SEQ ID NO: 5595 - protein, 7 aa, Artificial Sequence
  Description of Artificial Sequence: Synthetic peptide
LSGSASS

SEQ ID NO: 5596 - protein, 7 aa, Artificial Sequence
  Description of Artificial Sequence: Synthetic peptide
AKGNGMN

SEQ ID NO: 5597 - protein, 7 aa, Artificial Sequence
  Description of Artificial Sequence: Synthetic peptide
SQGEVGR

SEQ ID NO: 5598 - protein, 7 aa, Artificial Sequence
  Description of Artificial Sequence: Synthetic peptide
DGSKSAL

SEQ ID NO: 5599 - protein, 7 aa, Artificial Sequence
  Description of Artificial Sequence: Synthetic peptide
GPDNAQK

SEQ ID NO: 5600 - protein, 7 aa, Artificial Sequence
  Description of Artificial Sequence: Synthetic peptide
GVDGKPS

SEQ ID NO: 5601 - protein, 7 aa, Artificial Sequence
  Description of Artificial Sequence: Synthetic peptide
NQGSNLS

SEQ ID NO: 5602 - protein, 7 aa, Artificial Sequence
  Description of Artificial Sequence: Synthetic peptide
RDSNANG

SEQ ID NO: 5603 - protein, 7 aa, Artificial Sequence
  Description of Artificial Sequence: Synthetic peptide
AGESSMK

SEQ ID NO: 5604 - protein, 7 aa, Artificial Sequence
  Description of Artificial Sequence: Synthetic peptide
DSSSKNS

SEQ ID NO: 5605 - protein, 7 aa, Artificial Sequence
  Description of Artificial Sequence: Synthetic peptide
TGTNTVQ

SEQ ID NO: 5606 - protein, 7 aa, Artificial Sequence
  Description of Artificial Sequence: Synthetic peptide
IGETTKG

SEQ ID NO: 5607 - protein, 7 aa, Artificial Sequence
  Description of Artificial Sequence: Synthetic peptide
MREDKLL

SEQ ID NO: 5608 - protein, 7 aa, Artificial Sequence
  Description of Artificial Sequence: Synthetic peptide
TSPQGQA

SEQ ID NO: 5609 - protein, 7 aa, Artificial Sequence
  Description of Artificial Sequence: Synthetic peptide
GMDQTRS

SEQ ID NO: 5610 - protein, 7 aa, Artificial Sequence
  Description of Artificial Sequence: Synthetic peptide
VNGGSIK

SEQ ID NO: 5611 - protein, 7 aa, Artificial Sequence
  Description of Artificial Sequence: Synthetic peptide
SSPGTER

SEQ ID NO: 5612 - protein, 7 aa, Artificial Sequence
  Description of Artificial Sequence: Synthetic peptide
VPDSRSQ

SEQ ID NO: 5613 - protein, 7 aa, Artificial Sequence
  Description of Artificial Sequence: Synthetic peptide
SSDQSRK

SEQ ID NO: 5614 - protein, 7 aa, Artificial Sequence
  Description of Artificial Sequence: Synthetic peptide
EGSSTIV

SEQ ID NO: 5615 - protein, 7 aa, Artificial Sequence
  Description of Artificial Sequence: Synthetic peptide
VTNAATG

SEQ ID NO: 5616 - protein, 7 aa, Artificial Sequence
  Description of Artificial Sequence: Synthetic peptide
YSGDKPT

SEQ ID NO: 5617 - protein, 7 aa, Artificial Sequence
  Description of Artificial Sequence: Synthetic peptide
SATTANT

SEQ ID NO: 5618 - protein, 7 aa, Artificial Sequence
  Description of Artificial Sequence: Synthetic peptide
SAVQAPS

SEQ ID NO: 5619 - protein, 7 aa, Artificial Sequence
  Description of Artificial Sequence: Synthetic peptide
SSSKTAN

SEQ ID NO: 5620 - protein, 7 aa, Artificial Sequence
  Description of Artificial Sequence: Synthetic peptide
NNSGTLS

SEQ ID NO: 5621 - protein, 7 aa, Artificial Sequence
  Description of Artificial Sequence: Synthetic peptide
GDPSPRQ

SEQ ID NO: 5622 - protein, 7 aa, Artificial Sequence
  Description of Artificial Sequence: Synthetic peptide
MVQSPAT

SEQ ID NO: 5623 - protein, 7 aa, Artificial Sequence
  Description of Artificial Sequence: Synthetic peptide
RGQDKPN

SEQ ID NO: 5624 - protein, 7 aa, Artificial Sequence
  Description of Artificial Sequence: Synthetic peptide
TSSSTHS

SEQ ID NO: 5625 - protein, 7 aa, Artificial Sequence
  Description of Artificial Sequence: Synthetic peptide
GAGSANS

SEQ ID NO: 5626 - protein, 7 aa, Artificial Sequence
  Description of Artificial Sequence: Synthetic peptide
MQSAKSG

SEQ ID NO: 5627 - protein, 7 aa, Artificial Sequence
  Description of Artificial Sequence: Synthetic peptide
SRDEKLR

SEQ ID NO: 5628 - protein, 7 aa, Artificial Sequence
  Description of Artificial Sequence: Synthetic peptide
LTQSPGT

SEQ ID NO: 5629 - protein, 7 aa, Artificial Sequence
  Description of Artificial Sequence: Synthetic peptide
DGSNVKS

SEQ ID NO: 5630 - protein, 7 aa, Artificial Sequence
  Description of Artificial Sequence: Synthetic peptide
GSLPANS

SEQ ID NO: 5631 - protein, 7 aa, Artificial Sequence
  Description of Artificial Sequence: Synthetic peptide
AAGGTHG

SEQ ID NO: 5632 - protein, 7 aa, Artificial Sequence
  Description of Artificial Sequence: Synthetic peptide
NNSKNGG

SEQ ID NO: 5633 - protein, 7 aa, Artificial Sequence
  Description of Artificial Sequence: Synthetic peptide
SVGMTPP

SEQ ID NO: 5634 - protein, 7 aa, Artificial Sequence
  Description of Artificial Sequence: Synthetic peptide
SNTATPQ

SEQ ID NO: 5635 - protein, 7 aa, Artificial Sequence
  Description of Artificial Sequence: Synthetic peptide
ALHKSST

SEQ ID NO: 5636 - protein, 7 aa, Artificial Sequence
  Description of Artificial Sequence: Synthetic peptide
GLVRETG

SEQ ID NO: 5637 - protein, 7 aa, Artificial Sequence
  Description of Artificial Sequence: Synthetic peptide
KNNSSSQ

SEQ ID NO: 5638 - protein, 7 aa, Artificial Sequence
  Description of Artificial Sequence: Synthetic peptide
ASPSKDS

SEQ ID NO: 5639 - protein, 7 aa, Artificial Sequence
  Description of Artificial Sequence: Synthetic peptide
HSSERAG

SEQ ID NO: 5640 - protein, 7 aa, Artificial Sequence
  Description of Artificial Sequence: Synthetic peptide
GPSTNNS

SEQ ID NO: 5641 - protein, 7 aa, Artificial Sequence
  Description of Artificial Sequence: Synthetic peptide
AGGDTAK

SEQ ID NO: 5642 - protein, 7 aa, Artificial Sequence
  Description of Artificial Sequence: Synthetic peptide
GTGHSSS

SEQ ID NO: 5643 - protein, 7 aa, Artificial Sequence
  Description of Artificial Sequence: Synthetic peptide
ASNDKMS

SEQ ID NO: 5644 - protein, 7 aa, Artificial Sequence
  Description of Artificial Sequence: Synthetic peptide
TPSTSNH

SEQ ID NO: 5645 - protein, 7 aa, Artificial Sequence
  Description of Artificial Sequence: Synthetic peptide
DTPAHTK

SEQ ID NO: 5646 - protein, 7 aa, Artificial Sequence
  Description of Artificial Sequence: Synthetic peptide
ISAGSSS

SEQ ID NO: 5647 - protein, 7 aa, Artificial Sequence
  Description of Artificial Sequence: Synthetic peptide
DQNRTHG

SEQ ID NO: 5648 - protein, 7 aa, Artificial Sequence
  Description of Artificial Sequence: Synthetic peptide
ANMGDVK

SEQ ID NO: 5649 - protein, 7 aa, Artificial Sequence
  Description of Artificial Sequence: Synthetic peptide
GTSPGSM

SEQ ID NO: 5650 - protein, 7 aa, Artificial Sequence
  Description of Artificial Sequence: Synthetic peptide
EGHEHSR

SEQ ID NO: 5651 - protein, 7 aa, Artificial Sequence
  Description of Artificial Sequence: Synthetic peptide
SNNTSPN

SEQ ID NO: 5652 - protein, 7 aa, Artificial Sequence
  Description of Artificial Sequence: Synthetic peptide
NTTAPSH

SEQ ID NO: 5653 - protein, 7 aa, Artificial Sequence
  Description of Artificial Sequence: Synthetic peptide
GSDSGTR

SEQ ID NO: 5654 - protein, 7 aa, Artificial Sequence
  Description of Artificial Sequence: Synthetic peptide
MGNPTAS

SEQ ID NO: 5655 - protein, 7 aa, Artificial Sequence
  Description of Artificial Sequence: Synthetic peptide
EARSPPK

SEQ ID NO: 5656 - protein, 7 aa, Artificial Sequence
  Description of Artificial Sequence: Synthetic peptide
DPLNVKV

SEQ ID NO: 5657 - protein, 7 aa, Artificial Sequence
  Description of Artificial Sequence: Synthetic peptide
DKPTPSI

SEQ ID NO: 5658 - protein, 7 aa, Artificial Sequence
  Description of Artificial Sequence: Synthetic peptide
NHSDKAA

SEQ ID NO: 5659 - protein, 7 aa, Artificial Sequence
  Description of Artificial Sequence: Synthetic peptide
ADQSPKL

SEQ ID NO: 5660 - protein, 7 aa, Artificial Sequence
  Description of Artificial Sequence: Synthetic peptide
GQKGNAV

SEQ ID NO: 5661 - protein, 7 aa, Artificial Sequence
  Description of Artificial Sequence: Synthetic peptide
SGTSHPA

SEQ ID NO: 5662 - protein, 7 aa, Artificial Sequence
  Description of Artificial Sequence: Synthetic peptide
ANTSSNS

SEQ ID NO: 5663 - protein, 7 aa, Artificial Sequence
  Description of Artificial Sequence: Synthetic peptide
QGKSGGA

SEQ ID NO: 5664 - protein, 7 aa, Artificial Sequence
  Description of Artificial Sequence: Synthetic peptide
NTNPSGA

SEQ ID NO: 5665 - protein, 7 aa, Artificial Sequence
  Description of Artificial Sequence: Synthetic peptide
KDNPERG

SEQ ID NO: 5666 - protein, 7 aa, Artificial Sequence
  Description of Artificial Sequence: Synthetic peptide
NGGSKVA

SEQ ID NO: 5667 - protein, 7 aa, Artificial Sequence
  Description of Artificial Sequence: Synthetic peptide
NVDQAKN

SEQ ID NO: 5668 - protein, 7 aa, Artificial Sequence
  Description of Artificial Sequence: Synthetic peptide
TSDSKVS

SEQ ID NO: 5669 - protein, 7 aa, Artificial Sequence
  Description of Artificial Sequence: Synthetic peptide
TGHNATT

SEQ ID NO: 5670 - protein, 7 aa, Artificial Sequence
  Description of Artificial Sequence: Synthetic peptide
TGEKVRV

SEQ ID NO: 5671 - protein, 7 aa, Artificial Sequence
  Description of Artificial Sequence: Synthetic peptide
TNGEQRT

SEQ ID NO: 5672 - protein, 7 aa, Artificial Sequence
  Description of Artificial Sequence: Synthetic peptide
TGKDSMS

SEQ ID NO: 5673 - protein, 7 aa, Artificial Sequence
  Description of Artificial Sequence: Synthetic peptide
STHSASN

SEQ ID NO: 5674 - protein, 7 aa, Artificial Sequence
  Description of Artificial Sequence: Synthetic peptide
SREEPRT

SEQ ID NO: 5675 - protein, 7 aa, Artificial Sequence
  Description of Artificial Sequence: Synthetic peptide
STSKSVA

SEQ ID NO: 5676 - protein, 7 aa, Artificial Sequence
  Description of Artificial Sequence: Synthetic peptide
SGNGKLL

SEQ ID NO: 5677 - protein, 7 aa, Artificial Sequence
  Description of Artificial Sequence: Synthetic peptide
IASSSAA

SEQ ID NO: 5678 - protein, 7 aa, Artificial Sequence
  Description of Artificial Sequence: Synthetic peptide
QGQERKS

SEQ ID NO: 5679 - protein, 7 aa, Artificial Sequence
  Description of Artificial Sequence: Synthetic peptide
LQGSNVA

SEQ ID NO: 5680 - protein, 7 aa, Artificial Sequence
  Description of Artificial Sequence: Synthetic peptide
DSVSPKK

SEQ ID NO: 5681 - protein, 7 aa, Artificial Sequence
  Description of Artificial Sequence: Synthetic peptide
DVPSSKG

SEQ ID NO: 5682 - protein, 7 aa, Artificial Sequence
  Description of Artificial Sequence: Synthetic peptide
ESDSRSH

SEQ ID NO: 5683 - protein, 7 aa, Artificial Sequence
  Description of Artificial Sequence: Synthetic peptide
DNTRNGG

SEQ ID NO: 5684 - protein, 7 aa, Artificial Sequence
  Description of Artificial Sequence: Synthetic peptide
ALSNNSK

SEQ ID NO: 5685 - protein, 7 aa, Artificial Sequence
  Description of Artificial Sequence: Synthetic peptide
ATSQHSN

SEQ ID NO: 5686 - protein, 7 aa, Artificial Sequence
  Description of Artificial Sequence: Synthetic peptide
AKQPNAN

SEQ ID NO: 5687 - protein, 7 aa, Artificial Sequence
  Description of Artificial Sequence: Synthetic peptide
GTEVKAG

SEQ ID NO: 5688 - protein, 7 aa, Artificial Sequence
  Description of Artificial Sequence: Synthetic peptide
GTGSSIS

SEQ ID NO: 5689 - protein, 7 aa, Artificial Sequence
  Description of Artificial Sequence: Synthetic peptide
VVSGNGG

SEQ ID NO: 5690 - protein, 7 aa, Artificial Sequence
  Description of Artificial Sequence: Synthetic peptide
SATSNGG

SEQ ID NO: 5691 - protein, 7 aa, Artificial Sequence
  Description of Artificial Sequence: Synthetic peptide
DRGEKHT

SEQ ID NO: 5692 - protein, 7 aa, Artificial Sequence
  Description of Artificial Sequence: Synthetic peptide
GTADSHY

SEQ ID NO: 5693 - protein, 7 aa, Artificial Sequence
  Description of Artificial Sequence: Synthetic peptide
SGAPTLL

SEQ ID NO: 5694 - protein, 7 aa, Artificial Sequence
  Description of Artificial Sequence: Synthetic peptide
AASDKSS

SEQ ID NO: 5695 - protein, 7 aa, Artificial Sequence
  Description of Artificial Sequence: Synthetic peptide
STSDRHT

SEQ ID NO: 5696 - protein, 7 aa, Artificial Sequence
  Description of Artificial Sequence: Synthetic peptide
IDKVSPS

SEQ ID NO: 5697 - protein, 7 aa, Artificial Sequence
  Description of Artificial Sequence: Synthetic peptide
EGKSVNA

SEQ ID NO: 5698 - protein, 7 aa, Artificial Sequence
  Description of Artificial Sequence: Synthetic peptide
LKDKANS

SEQ ID NO: 5699 - protein, 7 aa, Artificial Sequence
  Description of Artificial Sequence: Synthetic peptide
ATGADMR

SEQ ID NO: 5700 - protein, 7 aa, Artificial Sequence
  Description of Artificial Sequence: Synthetic peptide
ERNTAGS

SEQ ID NO: 5701 - protein, 7 aa, Artificial Sequence
  Description of Artificial Sequence: Synthetic peptide
DGMPQKV

SEQ ID NO: 5702 - protein, 7 aa, Artificial Sequence
  Description of Artificial Sequence: Synthetic peptide
AGQRSDG

SEQ ID NO: 5703 - protein, 7 aa, Artificial Sequence
  Description of Artificial Sequence: Synthetic peptide
AGKSSQP

SEQ ID NO: 5704 - protein, 7 aa, Artificial Sequence
  Description of Artificial Sequence: Synthetic peptide
VSKSSNS

SEQ ID NO: 5705 - protein, 7 aa, Artificial Sequence
  Description of Artificial Sequence: Synthetic peptide
TSSSTPT

SEQ ID NO: 5706 - protein, 7 aa, Artificial Sequence
  Description of Artificial Sequence: Synthetic peptide
SGGAGSQ

SEQ ID NO: 5707 - protein, 7 aa, Artificial Sequence
  Description of Artificial Sequence: Synthetic peptide
SPGNVAT

SEQ ID NO: 5708 - protein, 7 aa, Artificial Sequence
  Description of Artificial Sequence: Synthetic peptide
VQNSDAK

SEQ ID NO: 5709 - protein, 7 aa, Artificial Sequence
  Description of Artificial Sequence: Synthetic peptide
ANDKAPS

SEQ ID NO: 5710 - protein, 7 aa, Artificial Sequence
  Description of Artificial Sequence: Synthetic peptide
SDGTRGT

SEQ ID NO: 5711 - protein, 7 aa, Artificial Sequence
  Description of Artificial Sequence: Synthetic peptide
AISTSNS

SEQ ID NO: 5712 - protein, 7 aa, Artificial Sequence
  Description of Artificial Sequence: Synthetic peptide
GQKEGPS

SEQ ID NO: 5713 - protein, 7 aa, Artificial Sequence
  Description of Artificial Sequence: Synthetic peptide
AQGGSSG

SEQ ID NO: 5714 - protein, 7 aa, Artificial Sequence
  Description of Artificial Sequence: Synthetic peptide
STSNSRG

SEQ ID NO: 5715 - protein, 7 aa, Artificial Sequence
  Description of Artificial Sequence: Synthetic peptide
SSGGRDK

SEQ ID NO: 5716 - protein, 7 aa, Artificial Sequence
  Description of Artificial Sequence: Synthetic peptide
LPSQGGG

SEQ ID NO: 5717 - protein, 7 aa, Artificial Sequence
  Description of Artificial Sequence: Synthetic peptide
NTGTNAS

SEQ ID NO: 5718 - protein, 7 aa, Artificial Sequence
  Description of Artificial Sequence: Synthetic peptide
TTGQNSQ

SEQ ID NO: 5719 - protein, 7 aa, Artificial Sequence
  Description of Artificial Sequence: Synthetic peptide
AASSSTS

SEQ ID NO: 5720 - protein, 7 aa, Artificial Sequence
  Description of Artificial Sequence: Synthetic peptide
TLGSGGS

SEQ ID NO: 5721 - protein, 7 aa, Artificial Sequence
  Description of Artificial Sequence: Synthetic peptide
KGSSSGG

SEQ ID NO: 5722 - protein, 7 aa, Artificial Sequence
  Description of Artificial Sequence: Synthetic peptide
SSGDHRT

SEQ ID NO: 5723 - protein, 7 aa, Artificial Sequence
  Description of Artificial Sequence: Synthetic peptide
DTGGLGK

SEQ ID NO: 5724 - protein, 7 aa, Artificial Sequence
  Description of Artificial Sequence: Synthetic peptide
AGQSATG

SEQ ID NO: 5725 - protein, 7 aa, Artificial Sequence
  Description of Artificial Sequence: Synthetic peptide
NAGANST

SEQ ID NO: 5726 - protein, 7 aa, Artificial Sequence
  Description of Artificial Sequence: Synthetic peptide
ESVASVK

SEQ ID NO: 5727 - protein, 7 aa, Artificial Sequence
  Description of Artificial Sequence: Synthetic peptide
DSASSGK

SEQ ID NO: 5728 - protein, 7 aa, Artificial Sequence
  Description of Artificial Sequence: Synthetic peptide
STDNAGK

SEQ ID NO: 5729 - protein, 7 aa, Artificial Sequence
  Description of Artificial Sequence: Synthetic peptide
QSSNAAA

SEQ ID NO: 5730 - protein, 7 aa, Artificial Sequence
  Description of Artificial Sequence: Synthetic peptide
TTASPAT

SEQ ID NO: 5731 - protein, 7 aa, Artificial Sequence
  Description of Artificial Sequence: Synthetic peptide
TTTQSNI

SEQ ID NO: 5732 - protein, 7 aa, Artificial Sequence
  Description of Artificial Sequence: Synthetic peptide
SSGDRSG

SEQ ID NO: 5733 - protein, 7 aa, Artificial Sequence
  Description of Artificial Sequence: Synthetic peptide
ENSDKVR

SEQ ID NO: 5734 - protein, 7 aa, Artificial Sequence
  Description of Artificial Sequence: Synthetic peptide
ATTKTSQ

SEQ ID NO: 5735 - protein, 7 aa, Artificial Sequence
  Description of Artificial Sequence: Synthetic peptide
SNGATPA

SEQ ID NO: 5736 - protein, 7 aa, Artificial Sequence
  Description of Artificial Sequence: Synthetic peptide
SSRDQVK

SEQ ID NO: 5737 - protein, 7 aa, Artificial Sequence
  Description of Artificial Sequence: Synthetic peptide
VSSGTGK

SEQ ID NO: 5738 - protein, 7 aa, Artificial Sequence
  Description of Artificial Sequence: Synthetic peptide
SNEGPSK

SEQ ID NO: 5739 - protein, 7 aa, Artificial Sequence
  Description of Artificial Sequence: Synthetic peptide
DLGNKTH

SEQ ID NO: 5740 - protein, 7 aa, Artificial Sequence
  Description of Artificial Sequence: Synthetic peptide
DAGNLKT

SEQ ID NO: 5741 - protein, 7 aa, Artificial Sequence
  Description of Artificial Sequence: Synthetic peptide
IGDKSST

SEQ ID NO: 5742 - protein, 7 aa, Artificial Sequence
  Description of Artificial Sequence: Synthetic peptide
GTGPDQR

SEQ ID NO: 5743 - protein, 7 aa, Artificial Sequence
  Description of Artificial Sequence: Synthetic peptide
NTGEARA

SEQ ID NO: 5744 - protein, 7 aa, Artificial Sequence
  Description of Artificial Sequence: Synthetic peptide
ATKAGSA

SEQ ID NO: 5745 - protein, 7 aa, Artificial Sequence
  Description of Artificial Sequence: Synthetic peptide
TTGSHSS

SEQ ID NO: 5746 - protein, 7 aa, Artificial Sequence
  Description of Artificial Sequence: Synthetic peptide
EPNAPKN

SEQ ID NO: 5747 - protein, 7 aa, Artificial Sequence
  Description of Artificial Sequence: Synthetic peptide
GDSKERL

SEQ ID NO: 5748 - protein, 7 aa, Artificial Sequence
  Description of Artificial Sequence: Synthetic peptide
QSKGTEG

SEQ ID NO: 5749 - protein, 7 aa, Artificial Sequence
  Description of Artificial Sequence: Synthetic peptide
DGGANAR

SEQ ID NO: 5750 - protein, 7 aa, Artificial Sequence
  Description of Artificial Sequence: Synthetic peptide
KSSSQSV

SEQ ID NO: 5751 - protein, 7 aa, Artificial Sequence
  Description of Artificial Sequence: Synthetic peptide
LGGQGSA

SEQ ID NO: 5752 - protein, 7 aa, Artificial Sequence
  Description of Artificial Sequence: Synthetic peptide
GPLKDTG

SEQ ID NO: 5753 - protein, 7 aa, Artificial Sequence
  Description of Artificial Sequence: Synthetic peptide
NQGTSTG

SEQ ID NO: 5754 - protein, 7 aa, Artificial Sequence
  Description of Artificial Sequence: Synthetic peptide
TGQKDLG

SEQ ID NO: 5755 - protein, 7 aa, Artificial Sequence
  Description of Artificial Sequence: Synthetic peptide
LTAGSGG

SEQ ID NO: 5756 - protein, 7 aa, Artificial Sequence
  Description of Artificial Sequence: Synthetic peptide
SGNNGMH

SEQ ID NO: 5757 - protein, 7 aa, Artificial Sequence
  Description of Artificial Sequence: Synthetic peptide
TSGTAST

SEQ ID NO: 5758 - protein, 7 aa, Artificial Sequence
  Description of Artificial Sequence: Synthetic peptide
SNSPTTM

SEQ ID NO: 5759 - protein, 7 aa, Artificial Sequence
  Description of Artificial Sequence: Synthetic peptide
QNASSHA

SEQ ID NO: 5760 - protein, 7 aa, Artificial Sequence
  Description of Artificial Sequence: Synthetic peptide
STSTDNR

SEQ ID NO: 5761 - protein, 7 aa, Artificial Sequence
  Description of Artificial Sequence: Synthetic peptide
EGKSTPI

SEQ ID NO: 5762 - protein, 7 aa, Artificial Sequence
  Description of Artificial Sequence: Synthetic peptide
DSLEPRK

SEQ ID NO: 5763 - protein, 7 aa, Artificial Sequence
  Description of Artificial Sequence: Synthetic peptide
AMTESNR

SEQ ID NO: 5764 - protein, 7 aa, Artificial Sequence
  Description of Artificial Sequence: Synthetic peptide
GETNKGY

SEQ ID NO: 5765 - protein, 7 aa, Artificial Sequence
  Description of Artificial Sequence: Synthetic peptide
GAQSSGK

SEQ ID NO: 5766 - protein, 7 aa, Artificial Sequence
  Description of Artificial Sequence: Synthetic peptide
GGQDKKS

SEQ ID NO: 5767 - protein, 7 aa, Artificial Sequence
  Description of Artificial Sequence: Synthetic peptide
HGQSPGS

SEQ ID NO: 5768 - protein, 7 aa, Artificial Sequence
  Description of Artificial Sequence: Synthetic peptide
LGGAQPK

SEQ ID NO: 5769 - protein, 7 aa, Artificial Sequence
  Description of Artificial Sequence: Synthetic peptide
SGQSPSN

SEQ ID NO: 5770 - protein, 7 aa, Artificial Sequence
  Description of Artificial Sequence: Synthetic peptide
GTSSTKS

SEQ ID NO: 5771 - protein, 7 aa, Artificial Sequence
  Description of Artificial Sequence: Synthetic peptide
LTNTSAA

SEQ ID NO: 5772 - protein, 7 aa, Artificial Sequence
  Description of Artificial Sequence: Synthetic peptide
QNSPTPL

SEQ ID NO: 5773 - protein, 7 aa, Artificial Sequence
  Description of Artificial Sequence: Synthetic peptide
STTGAGT

SEQ ID NO: 5774 - protein, 7 aa, Artificial Sequence
  Description of Artificial Sequence: Synthetic peptide
VVDSSNR

SEQ ID NO: 5775 - protein, 7 aa, Artificial Sequence
  Description of Artificial Sequence: Synthetic peptide
GDTGSRS

SEQ ID NO: 5776 - protein, 7 aa, Artificial Sequence
  Description of Artificial Sequence: Synthetic peptide
TVGSSSS

SEQ ID NO: 5777 - protein, 7 aa, Artificial Sequence
  Description of Artificial Sequence: Synthetic peptide
NTSGTNS

SEQ ID NO: 5778 - protein, 7 aa, Artificial Sequence
  Description of Artificial Sequence: Synthetic peptide
TGSQNLV

SEQ ID NO: 5779 - protein, 7 aa, Artificial Sequence
  Description of Artificial Sequence: Synthetic peptide
SANGPNT

SEQ ID NO: 5780 - protein, 7 aa, Artificial Sequence
  Description of Artificial Sequence: Synthetic peptide
LAGDRTQ

SEQ ID NO: 5781 - protein, 7 aa, Artificial Sequence
  Description of Artificial Sequence: Synthetic peptide
DMANPKR

SEQ ID NO: 5782 - protein, 7 aa, Artificial Sequence
  Description of Artificial Sequence: Synthetic peptide
LGNGKVS

SEQ ID NO: 5783 - protein, 7 aa, Artificial Sequence
  Description of Artificial Sequence: Synthetic peptide
GADSKGL

SEQ ID NO: 5784 - protein, 7 aa, Artificial Sequence
  Description of Artificial Sequence: Synthetic peptide
LGSKDAH

SEQ ID NO: 5785 - protein, 7 aa, Artificial Sequence
  Description of Artificial Sequence: Synthetic peptide
TGSASSS

SEQ ID NO: 5786 - protein, 7 aa, Artificial Sequence
  Description of Artificial Sequence: Synthetic peptide
QSSPSAK

SEQ ID NO: 5787 - protein, 7 aa, Artificial Sequence
  Description of Artificial Sequence: Synthetic peptide
DTGKIGG

SEQ ID NO: 5788 - protein, 7 aa, Artificial Sequence
  Description of Artificial Sequence: Synthetic peptide
GTTGESR

SEQ ID NO: 5789 - protein, 7 aa, Artificial Sequence
  Description of Artificial Sequence: Synthetic peptide
VQGSTSN

SEQ ID NO: 5790 - protein, 7 aa, Artificial Sequence
  Description of Artificial Sequence: Synthetic peptide
SASKDHA

SEQ ID NO: 5791 - protein, 7 aa, Artificial Sequence
  Description of Artificial Sequence: Synthetic peptide
MKQESAV

SEQ ID NO: 5792 - protein, 7 aa, Artificial Sequence
  Description of Artificial Sequence: Synthetic peptide
LASTSST

SEQ ID NO: 5793 - protein, 7 aa, Artificial Sequence
  Description of Artificial Sequence: Synthetic peptide
GGVKTGD

SEQ ID NO: 5794 - protein, 7 aa, Artificial Sequence
  Description of Artificial Sequence: Synthetic peptide
QVHKSAV

SEQ ID NO: 5795 - protein, 7 aa, Artificial Sequence
  Description of Artificial Sequence: Synthetic peptide
GGSKNNT

SEQ ID NO: 5796 - protein, 7 aa, Artificial Sequence
  Description of Artificial Sequence: Synthetic peptide
DGANHTN

SEQ ID NO: 5797 - protein, 7 aa, Artificial Sequence
  Description of Artificial Sequence: Synthetic peptide
QSTSSSA

SEQ ID NO: 5798 - protein, 7 aa, Artificial Sequence
  Description of Artificial Sequence: Synthetic peptide
GTGVGGM

SEQ ID NO: 5799 - protein, 7 aa, Artificial Sequence
  Description of Artificial Sequence: Synthetic peptide
NQGASPV

SEQ ID NO: 5800 - protein, 7 aa, Artificial Sequence
  Description of Artificial Sequence: Synthetic peptide
NTSNKTD

SEQ ID NO: 5801 - protein, 7 aa, Artificial Sequence
  Description of Artificial Sequence: Synthetic peptide
DSKSSAT

SEQ ID NO: 5802 - protein, 7 aa, Artificial Sequence
  Description of Artificial Sequence: Synthetic peptide
GTTPSGP

SEQ ID NO: 5803 - protein, 7 aa, Artificial Sequence
  Description of Artificial Sequence: Synthetic peptide
TTESSMR

SEQ ID NO: 5804 - protein, 7 aa, Artificial Sequence
  Description of Artificial Sequence: Synthetic peptide
NRNSTSS

SEQ ID NO: 5805 - protein, 7 aa, Artificial Sequence
  Description of Artificial Sequence: Synthetic peptide
EPVNGHK

SEQ ID NO: 5806 - protein, 7 aa, Artificial Sequence
  Description of Artificial Sequence: Synthetic peptide
DPTANTK

SEQ ID NO: 5807 - protein, 7 aa, Artificial Sequence
  Description of Artificial Sequence: Synthetic peptide
GQDKSTV

SEQ ID NO: 5808 - protein, 7 aa, Artificial Sequence
  Description of Artificial Sequence: Synthetic peptide
SNAQLAK

SEQ ID NO: 5809 - protein, 7 aa, Artificial Sequence
  Description of Artificial Sequence: Synthetic peptide
ATGTTPG

SEQ ID NO: 5810 - protein, 7 aa, Artificial Sequence
  Description of Artificial Sequence: Synthetic peptide
TMSNSPV

SEQ ID NO: 5811 - protein, 7 aa, Artificial Sequence
  Description of Artificial Sequence: Synthetic peptide
HGHDKAQ

SEQ ID NO: 5812 - protein, 7 aa, Artificial Sequence
  Description of Artificial Sequence: Synthetic peptide
SSGSHSA

SEQ ID NO: 5813 - protein, 7 aa, Artificial Sequence
  Description of Artificial Sequence: Synthetic peptide
EQRSKPM

SEQ ID NO: 5814 - protein, 7 aa, Artificial Sequence
  Description of Artificial Sequence: Synthetic peptide
LTDANRG

SEQ ID NO: 5815 - protein, 7 aa, Artificial Sequence
  Description of Artificial Sequence: Synthetic peptide
VQSQGTP

SEQ ID NO: 5816 - protein, 7 aa, Artificial Sequence
  Description of Artificial Sequence: Synthetic peptide
ISTGGSS

SEQ ID NO: 5817 - protein, 7 aa, Artificial Sequence
  Description of Artificial Sequence: Synthetic peptide
NSNTSSS

SEQ ID NO: 5818 - protein, 7 aa, Artificial Sequence
  Description of Artificial Sequence: Synthetic peptide
TGTNHLA

SEQ ID NO: 5819 - protein, 7 aa, Artificial Sequence
  Description of Artificial Sequence: Synthetic peptide
THGGSTP

SEQ ID NO: 5820 - protein, 7 aa, Artificial Sequence
  Description of Artificial Sequence: Synthetic peptide
QGSSSVM

SEQ ID NO: 5821 - protein, 7 aa, Artificial Sequence
  Description of Artificial Sequence: Synthetic peptide
GEASQSR

SEQ ID NO: 5822 - protein, 7 aa, Artificial Sequence
  Description of Artificial Sequence: Synthetic peptide
GQSSPSS

SEQ ID NO: 5823 - protein, 7 aa, Artificial Sequence
  Description of Artificial Sequence: Synthetic peptide
ASQTPTS

SEQ ID NO: 5824 - protein, 7 aa, Artificial Sequence
  Description of Artificial Sequence: Synthetic peptide
DGTSKKL

SEQ ID NO: 5825 - protein, 7 aa, Artificial Sequence
  Description of Artificial Sequence: Synthetic peptide
EGVSPKT

SEQ ID NO: 5826 - protein, 7 aa, Artificial Sequence
  Description of Artificial Sequence: Synthetic peptide
QSQSSTM

SEQ ID NO: 5827 - protein, 7 aa, Artificial Sequence
  Description of Artificial Sequence: Synthetic peptide
ETSNTGK

SEQ ID NO: 5828 - protein, 7 aa, Artificial Sequence
  Description of Artificial Sequence: Synthetic peptide
SPNQSSG

SEQ ID NO: 5829 - protein, 7 aa, Artificial Sequence
  Description of Artificial Sequence: Synthetic peptide
TPTDNKG

SEQ ID NO: 5830 - protein, 7 aa, Artificial Sequence
  Description of Artificial Sequence: Synthetic peptide
RGDQTLA

SEQ ID NO: 5831 - protein, 7 aa, Artificial Sequence
  Description of Artificial Sequence: Synthetic peptide
ESGQSKG

SEQ ID NO: 5832 - protein, 7 aa, Artificial Sequence
  Description of Artificial Sequence: Synthetic peptide
GVATPSK

SEQ ID NO: 5833 - protein, 7 aa, Artificial Sequence
  Description of Artificial Sequence: Synthetic peptide
SSVSTAS

SEQ ID NO: 5834 - protein, 7 aa, Artificial Sequence
  Description of Artificial Sequence: Synthetic peptide
AQERDAK

SEQ ID NO: 5835 - protein, 7 aa, Artificial Sequence
  Description of Artificial Sequence: Synthetic peptide
GPSNQKM

SEQ ID NO: 5836 - protein, 7 aa, Artificial Sequence
  Description of Artificial Sequence: Synthetic peptide
NNGNATT

SEQ ID NO: 5837 - protein, 7 aa, Artificial Sequence
  Description of Artificial Sequence: Synthetic peptide
TSGGTMS

SEQ ID NO: 5838 - protein, 7 aa, Artificial Sequence
  Description of Artificial Sequence: Synthetic peptide
TGKTSTS

SEQ ID NO: 5839 - protein, 7 aa, Artificial Sequence
  Description of Artificial Sequence: Synthetic peptide
NGNDTAK

SEQ ID NO: 5840 - protein, 7 aa, Artificial Sequence
  Description of Artificial Sequence: Synthetic peptide
ADSKQNA

SEQ ID NO: 5841 - protein, 7 aa, Artificial Sequence
  Description of Artificial Sequence: Synthetic peptide
SPGPATK

SEQ ID NO: 5842 - protein, 7 aa, Artificial Sequence
  Description of Artificial Sequence: Synthetic peptide
SGQKVNS

SEQ ID NO: 5843 - protein, 7 aa, Artificial Sequence
  Description of Artificial Sequence: Synthetic peptide
GSNAQSR

SEQ ID NO: 5844 - protein, 7 aa, Artificial Sequence
  Description of Artificial Sequence: Synthetic peptide
QPSSTPT

SEQ ID NO: 5845 - protein, 7 aa, Artificial Sequence
  Description of Artificial Sequence: Synthetic peptide
GVTSKPD

SEQ ID NO: 5846 - protein, 7 aa, Artificial Sequence
  Description of Artificial Sequence: Synthetic peptide
TNLGSPS

SEQ ID NO: 5847 - protein, 7 aa, Artificial Sequence
  Description of Artificial Sequence: Synthetic peptide
QNSEKGQ

SEQ ID NO: 5848 - protein, 7 aa, Artificial Sequence
  Description of Artificial Sequence: Synthetic peptide
ERTGSSG

SEQ ID NO: 5849 - protein, 7 aa, Artificial Sequence
  Description of Artificial Sequence: Synthetic peptide
NGTQNAQ

SEQ ID NO: 5850 - protein, 7 aa, Artificial Sequence
  Description of Artificial Sequence: Synthetic peptide
LRDKSSG

SEQ ID NO: 5851 - protein, 7 aa, Artificial Sequence
  Description of Artificial Sequence: Synthetic peptide
TPSKTSA

SEQ ID NO: 5852 - protein, 7 aa, Artificial Sequence
  Description of Artificial Sequence: Synthetic peptide
SQVSQGA

SEQ ID NO: 5853 - protein, 7 aa, Artificial Sequence
  Description of Artificial Sequence: Synthetic peptide
STHKDQS

SEQ ID NO: 5854 - protein, 7 aa, Artificial Sequence
  Description of Artificial Sequence: Synthetic peptide
TSAQATS

SEQ ID NO: 5855 - protein, 7 aa, Artificial Sequence
  Description of Artificial Sequence: Synthetic peptide
TPTSSSM

SEQ ID NO: 5856 - protein, 7 aa, Artificial Sequence
  Description of Artificial Sequence: Synthetic peptide
SSTNAPT

SEQ ID NO: 5857 - protein, 7 aa, Artificial Sequence
  Description of Artificial Sequence: Synthetic peptide
ASPAGSG

SEQ ID NO: 5858 - protein, 7 aa, Artificial Sequence
  Description of Artificial Sequence: Synthetic peptide
NGAAPVS

SEQ ID NO: 5859 - protein, 7 aa, Artificial Sequence
  Description of Artificial Sequence: Synthetic peptide
DMGHKGQ

SEQ ID NO: 5860 - protein, 7 aa, Artificial Sequence
  Description of Artificial Sequence: Synthetic peptide
GGETRTS

SEQ ID NO: 5861 - protein, 7 aa, Artificial Sequence
  Description of Artificial Sequence: Synthetic peptide
HTQNTSA

SEQ ID NO: 5862 - protein, 7 aa, Artificial Sequence
  Description of Artificial Sequence: Synthetic peptide
QNAPTSG

SEQ ID NO: 5863 - protein, 7 aa, Artificial Sequence
  Description of Artificial Sequence: Synthetic peptide
TVSSNGA

SEQ ID NO: 5864 - protein, 7 aa, Artificial Sequence
  Description of Artificial Sequence: Synthetic peptide
SVSKSSV

SEQ ID NO: 5865 - protein, 7 aa, Artificial Sequence
  Description of Artificial Sequence: Synthetic peptide
CSDSKSQ

SEQ ID NO: 5866 - protein, 7 aa, Artificial Sequence
  Description of Artificial Sequence: Synthetic peptide
QVADANR

SEQ ID NO: 5867 - protein, 7 aa, Artificial Sequence
  Description of Artificial Sequence: Synthetic peptide
GEPRNNS

SEQ ID NO: 5868 - protein, 7 aa, Artificial Sequence
  Description of Artificial Sequence: Synthetic peptide
ESSGTSR

SEQ ID NO: 5869 - protein, 7 aa, Artificial Sequence
  Description of Artificial Sequence: Synthetic peptide
GRDGASG

SEQ ID NO: 5870 - protein, 7 aa, Artificial Sequence
  Description of Artificial Sequence: Synthetic peptide
NTSKGNS

SEQ ID NO: 5871 - protein, 7 aa, Artificial Sequence
  Description of Artificial Sequence: Synthetic peptide
IPSSSSS

SEQ ID NO: 5872 - protein, 7 aa, Artificial Sequence
  Description of Artificial Sequence: Synthetic peptide
MPGTAAP

SEQ ID NO: 5873 - protein, 7 aa, Artificial Sequence
  Description of Artificial Sequence: Synthetic peptide
NRATATA

SEQ ID NO: 5874 - protein, 7 aa, Artificial Sequence
  Description of Artificial Sequence: Synthetic peptide
GVAQPHG

SEQ ID NO: 5875 - protein, 7 aa, Artificial Sequence
  Description of Artificial Sequence: Synthetic peptide
SSTGKVS

SEQ ID NO: 5876 - protein, 7 aa, Artificial Sequence
  Description of Artificial Sequence: Synthetic peptide
RIDGRKD

SEQ ID NO: 5877 - protein, 7 aa, Artificial Sequence
  Description of Artificial Sequence: Synthetic peptide
STNAGGS

SEQ ID NO: 5878 - protein, 7 aa, Artificial Sequence
  Description of Artificial Sequence: Synthetic peptide
HSGERQG

SEQ ID NO: 5879 - protein, 7 aa, Artificial Sequence
  Description of Artificial Sequence: Synthetic peptide
GPNTSPS

SEQ ID NO: 5880 - protein, 7 aa, Artificial Sequence
  Description of Artificial Sequence: Synthetic peptide
SDDKIRG

SEQ ID NO: 5881 - protein, 7 aa, Artificial Sequence
  Description of Artificial Sequence: Synthetic peptide
NRSESPS

SEQ ID NO: 5882 - protein, 7 aa, Artificial Sequence
  Description of Artificial Sequence: Synthetic peptide
DGKPSSV

SEQ ID NO: 5883 - protein, 7 aa, Artificial Sequence
  Description of Artificial Sequence: Synthetic peptide
QGSSTNS

SEQ ID NO: 5884 - protein, 7 aa, Artificial Sequence
  Description of Artificial Sequence: Synthetic peptide
GKGTPDS

SEQ ID NO: 5885 - protein, 7 aa, Artificial Sequence
  Description of Artificial Sequence: Synthetic peptide
LGTKPNM

SEQ ID NO: 5886 - protein, 7 aa, Artificial Sequence
  Description of Artificial Sequence: Synthetic peptide
HSDPKGL

SEQ ID NO: 5887 - protein, 7 aa, Artificial Sequence
  Description of Artificial Sequence: Synthetic peptide
MEKPSLA

SEQ ID NO: 5888 - protein, 7 aa, Artificial Sequence
  Description of Artificial Sequence: Synthetic peptide
NSTNSSK

SEQ ID NO: 5889 - protein, 7 aa, Artificial Sequence
  Description of Artificial Sequence: Synthetic peptide
MGQGPKD

SEQ ID NO: 5890 - protein, 7 aa, Artificial Sequence
  Description of Artificial Sequence: Synthetic peptide
LSSKETT

SEQ ID NO: 5891 - protein, 7 aa, Artificial Sequence
  Description of Artificial Sequence: Synthetic peptide
ALGSNPG

SEQ ID NO: 5892 - protein, 7 aa, Artificial Sequence
  Description of Artificial Sequence: Synthetic peptide
AGTQSTM

SEQ ID NO: 5893 - protein, 7 aa, Artificial Sequence
  Description of Artificial Sequence: Synthetic peptide
AGTGSSK

SEQ ID NO: 5894 - protein, 7 aa, Artificial Sequence
  Description of Artificial Sequence: Synthetic peptide
GTGRDNL

SEQ ID NO: 5895 - protein, 7 aa, Artificial Sequence
  Description of Artificial Sequence: Synthetic peptide
GTSNSGS

SEQ ID NO: 5896 - protein, 7 aa, Artificial Sequence
  Description of Artificial Sequence: Synthetic peptide
GEKTNMS

SEQ ID NO: 5897 - protein, 7 aa, Artificial Sequence
  Description of Artificial Sequence: Synthetic peptide
VQNTAAG

SEQ ID NO: 5898 - protein, 7 aa, Artificial Sequence
  Description of Artificial Sequence: Synthetic peptide
TDSRDKV

SEQ ID NO: 5899 - protein, 7 aa, Artificial Sequence
  Description of Artificial Sequence: Synthetic peptide
DTHSTSR

SEQ ID NO: 5900 - protein, 7 aa, Artificial Sequence
  Description of Artificial Sequence: Synthetic peptide
SPSTKES

SEQ ID NO: 5901 - protein, 7 aa, Artificial Sequence
  Description of Artificial Sequence: Synthetic peptide
TAGNANS

SEQ ID NO: 5902 - protein, 7 aa, Artificial Sequence
  Description of Artificial Sequence: Synthetic peptide
STLSAKG

SEQ ID NO: 5903 - protein, 7 aa, Artificial Sequence
  Description of Artificial Sequence: Synthetic peptide
TGGQSNV

SEQ ID NO: 5904 - protein, 7 aa, Artificial Sequence
  Description of Artificial Sequence: Synthetic peptide
SQSSPTQ

SEQ ID NO: 5905 - protein, 7 aa, Artificial Sequence
  Description of Artificial Sequence: Synthetic peptide
NGESKPM

SEQ ID NO: 5906 - protein, 7 aa, Artificial Sequence
  Description of Artificial Sequence: Synthetic peptide
TNATNHV

SEQ ID NO: 5907 - protein, 7 aa, Artificial Sequence
  Description of Artificial Sequence: Synthetic peptide
SNGGPSS

SEQ ID NO: 5908 - protein, 7 aa, Artificial Sequence
  Description of Artificial Sequence: Synthetic peptide
DGVREKV

SEQ ID NO: 5909 - protein, 7 aa, Artificial Sequence
  Description of Artificial Sequence: Synthetic peptide
GNSPTLQ

SEQ ID NO: 5910 - protein, 7 aa, Artificial Sequence
  Description of Artificial Sequence: Synthetic peptide
VTGVPTT

SEQ ID NO: 5911 - protein, 7 aa, Artificial Sequence
  Description of Artificial Sequence: Synthetic peptide
SEINPKL

SEQ ID NO: 5912 - protein, 7 aa, Artificial Sequence
  Description of Artificial Sequence: Synthetic peptide
ATGSGSS

SEQ ID NO: 5913 - protein, 7 aa, Artificial Sequence
  Description of Artificial Sequence: Synthetic peptide
EHGKSSV

SEQ ID NO: 5914 - protein, 7 aa, Artificial Sequence
  Description of Artificial Sequence: Synthetic peptide
GVGQSNG

SEQ ID NO: 5915 - protein, 7 aa, Artificial Sequence
  Description of Artificial Sequence: Synthetic peptide
GSATANA

SEQ ID NO: 5916 - protein, 7 aa, Artificial Sequence
  Description of Artificial Sequence: Synthetic peptide
SAEIKGA

SEQ ID NO: 5917 - protein, 7 aa, Artificial Sequence
  Description of Artificial Sequence: Synthetic peptide
LNSPTTG

SEQ ID NO: 5918 - protein, 7 aa, Artificial Sequence
  Description of Artificial Sequence: Synthetic peptide
NHDGAGK

SEQ ID NO: 5919 - protein, 7 aa, Artificial Sequence
  Description of Artificial Sequence: Synthetic peptide
DRASPTT

SEQ ID NO: 5920 - protein, 7 aa, Artificial Sequence
  Description of Artificial Sequence: Synthetic peptide
IGTSSQG

SEQ ID NO: 5921 - protein, 7 aa, Artificial Sequence
  Description of Artificial Sequence: Synthetic peptide
TGADPLK

SEQ ID NO: 5922 - protein, 7 aa, Artificial Sequence
  Description of Artificial Sequence: Synthetic peptide
TLASTNQ

SEQ ID NO: 5923 - protein, 7 aa, Artificial Sequence
  Description of Artificial Sequence: Synthetic peptide
ALETPTR

SEQ ID NO: 5924 - protein, 7 aa, Artificial Sequence
  Description of Artificial Sequence: Synthetic peptide
EGRSSVV

SEQ ID NO: 5925 - protein, 7 aa, Artificial Sequence
  Description of Artificial Sequence: Synthetic peptide
QGTHKQD

SEQ ID NO: 5926 - protein, 7 aa, Artificial Sequence
  Description of Artificial Sequence: Synthetic peptide
TSGDHMK

SEQ ID NO: 5927 - protein, 7 aa, Artificial Sequence
  Description of Artificial Sequence: Synthetic peptide
DSNVTKP

SEQ ID NO: 5928 - protein, 7 aa, Artificial Sequence
  Description of Artificial Sequence: Synthetic peptide
NGGAHVT

SEQ ID NO: 5929 - protein, 7 aa, Artificial Sequence
  Description of Artificial Sequence: Synthetic peptide
NAGGNAI

SEQ ID NO: 5930 - protein, 7 aa, Artificial Sequence
  Description of Artificial Sequence: Synthetic peptide
TGAGSSV

SEQ ID NO: 5931 - protein, 7 aa, Artificial Sequence
  Description of Artificial Sequence: Synthetic peptide
SSPGASS

SEQ ID NO: 5932 - protein, 7 aa, Artificial Sequence
  Description of Artificial Sequence: Synthetic peptide
NTKGTTQ

SEQ ID NO: 5933 - protein, 7 aa, Artificial Sequence
  Description of Artificial Sequence: Synthetic peptide
GSATAST

SEQ ID NO: 5934 - protein, 7 aa, Artificial Sequence
  Description of Artificial Sequence: Synthetic peptide
SLGSQSK

SEQ ID NO: 5935 - protein, 7 aa, Artificial Sequence
  Description of Artificial Sequence: Synthetic peptide
SGKDTMQ

SEQ ID NO: 5936 - protein, 7 aa, Artificial Sequence
  Description of Artificial Sequence: Synthetic peptide
GNVDKVV

SEQ ID NO: 5937 - protein, 7 aa, Artificial Sequence
  Description of Artificial Sequence: Synthetic peptide
SVSKETM

SEQ ID NO: 5938 - protein, 7 aa, Artificial Sequence
  Description of Artificial Sequence: Synthetic peptide
ASDGKTA

SEQ ID NO: 5939 - protein, 7 aa, Artificial Sequence
  Description of Artificial Sequence: Synthetic peptide
GKNGHAG

SEQ ID NO: 5940 - protein, 7 aa, Artificial Sequence
  Description of Artificial Sequence: Synthetic peptide
GGSDNKN

SEQ ID NO: 5941 - protein, 7 aa, Artificial Sequence
  Description of Artificial Sequence: Synthetic peptide
SREGTPL

SEQ ID NO: 5942 - protein, 7 aa, Artificial Sequence
  Description of Artificial Sequence: Synthetic peptide
LVGKSTS

SEQ ID NO: 5943 - protein, 7 aa, Artificial Sequence
  Description of Artificial Sequence: Synthetic peptide
SNDSRKG

SEQ ID NO: 5944 - protein, 7 aa, Artificial Sequence
  Description of Artificial Sequence: Synthetic peptide
NADQPGK

SEQ ID NO: 5945 - protein, 7 aa, Artificial Sequence
  Description of Artificial Sequence: Synthetic peptide
MATNATA

SEQ ID NO: 5946 - protein, 7 aa, Artificial Sequence
  Description of Artificial Sequence: Synthetic peptide
EVSPTSK

SEQ ID NO: 5947 - protein, 7 aa, Artificial Sequence
  Description of Artificial Sequence: Synthetic peptide
GPNTPAV

SEQ ID NO: 5948 - protein, 7 aa, Artificial Sequence
  Description of Artificial Sequence: Synthetic peptide
QQGSNAN

SEQ ID NO: 5949 - protein, 7 aa, Artificial Sequence
  Description of Artificial Sequence: Synthetic peptide
VSGSAAA

SEQ ID NO: 5950 - protein, 7 aa, Artificial Sequence
  Description of Artificial Sequence: Synthetic peptide
AETSGSK

SEQ ID NO: 5951 - protein, 7 aa, Artificial Sequence
  Description of Artificial Sequence: Synthetic peptide
QGTPKPD

SEQ ID NO: 5952 - protein, 7 aa, Artificial Sequence
  Description of Artificial Sequence: Synthetic peptide
EQATKSP

SEQ ID NO: 5953 - protein, 7 aa, Artificial Sequence
  Description of Artificial Sequence: Synthetic peptide
SPVNTKV

SEQ ID NO: 5954 - protein, 7 aa, Artificial Sequence
  Description of Artificial Sequence: Synthetic peptide
TQRGASQ

SEQ ID NO: 5955 - protein, 7 aa, Artificial Sequence
  Description of Artificial Sequence: Synthetic peptide
IRSDSTA

SEQ ID NO: 5956 - protein, 7 aa, Artificial Sequence
  Description of Artificial Sequence: Synthetic peptide
REGSGSA

SEQ ID NO: 5957 - protein, 7 aa, Artificial Sequence
  Description of Artificial Sequence: Synthetic peptide
DRSSAQA

SEQ ID NO: 5958 - protein, 7 aa, Artificial Sequence
  Description of Artificial Sequence: Synthetic peptide
DQAGERS

SEQ ID NO: 5959 - protein, 7 aa, Artificial Sequence
  Description of Artificial Sequence: Synthetic peptide
ASSEKDR

SEQ ID NO: 5960 - protein, 7 aa, Artificial Sequence
  Description of Artificial Sequence: Synthetic peptide
GISASTG

SEQ ID NO: 5961 - protein, 7 aa, Artificial Sequence
  Description of Artificial Sequence: Synthetic peptide
VSQGTSV

SEQ ID NO: 5962 - protein, 7 aa, Artificial Sequence
  Description of Artificial Sequence: Synthetic peptide
SDVGNGK

SEQ ID NO: 5963 - protein, 7 aa, Artificial Sequence
  Description of Artificial Sequence: Synthetic peptide
GSPGTSS

SEQ ID NO: 5964 - protein, 7 aa, Artificial Sequence
  Description of Artificial Sequence: Synthetic peptide
ARGKTSE

SEQ ID NO: 5965 - protein, 7 aa, Artificial Sequence
  Description of Artificial Sequence: Synthetic peptide
QTVTSSQ

SEQ ID NO: 5966 - protein, 7 aa, Artificial Sequence
  Description of Artificial Sequence: Synthetic peptide
RSNSATS

SEQ ID NO: 5967 - protein, 7 aa, Artificial Sequence
  Description of Artificial Sequence: Synthetic peptide
SNNSAQG

SEQ ID NO: 5968 - protein, 7 aa, Artificial Sequence
  Description of Artificial Sequence: Synthetic peptide
NTTDKGS

SEQ ID NO: 5969 - protein, 7 aa, Artificial Sequence
  Description of Artificial Sequence: Synthetic peptide
SSDTQKN

SEQ ID NO: 5970 - protein, 7 aa, Artificial Sequence
  Description of Artificial Sequence: Synthetic peptide
LSSSGGG

SEQ ID NO: 5971 - protein, 7 aa, Artificial Sequence
  Description of Artificial Sequence: Synthetic peptide
LANSNTS

SEQ ID NO: 5972 - protein, 7 aa, Artificial Sequence
  Description of Artificial Sequence: Synthetic peptide
GSHSQSG

SEQ ID NO: 5973 - protein, 7 aa, Artificial Sequence
  Description of Artificial Sequence: Synthetic peptide
SAPDRGG

SEQ ID NO: 5974 - protein, 7 aa, Artificial Sequence
  Description of Artificial Sequence: Synthetic peptide
DTSKSAL

SEQ ID NO: 5975 - protein, 7 aa, Artificial Sequence
  Description of Artificial Sequence: Synthetic peptide
GENGKSV

SEQ ID NO: 5976 - protein, 7 aa, Artificial Sequence
  Description of Artificial Sequence: Synthetic peptide
LGETKAG

SEQ ID NO: 5977 - protein, 7 aa, Artificial Sequence
  Description of Artificial Sequence: Synthetic peptide
LGDNTQK

SEQ ID NO: 5978 - protein, 7 aa, Artificial Sequence
  Description of Artificial Sequence: Synthetic peptide
QSTGTLS

SEQ ID NO: 5979 - protein, 7 aa, Artificial Sequence
  Description of Artificial Sequence: Synthetic peptide
DSASKHG

SEQ ID NO: 5980 - protein, 7 aa, Artificial Sequence
  Description of Artificial Sequence: Synthetic peptide
SGVEARS

SEQ ID NO: 5981 - protein, 7 aa, Artificial Sequence
  Description of Artificial Sequence: Synthetic peptide
NNSDTNK

SEQ ID NO: 5982 - protein, 7 aa, Artificial Sequence
  Description of Artificial Sequence: Synthetic peptide
HVSGTPA

SEQ ID NO: 5983 - protein, 7 aa, Artificial Sequence
  Description of Artificial Sequence: Synthetic peptide
SNGGTKT

SEQ ID NO: 5984 - protein, 7 aa, Artificial Sequence
  Description of Artificial Sequence: Synthetic peptide
NGGKTNV

SEQ ID NO: 5985 - protein, 7 aa, Artificial Sequence
  Description of Artificial Sequence: Synthetic peptide
NGSTSLK

SEQ ID NO: 5986 - protein, 7 aa, Artificial Sequence
  Description of Artificial Sequence: Synthetic peptide
NSNEKSG

SEQ ID NO: 5987 - protein, 7 aa, Artificial Sequence
  Description of Artificial Sequence: Synthetic peptide
RTSGPNT

SEQ ID NO: 5988 - protein, 7 aa, Artificial Sequence
  Description of Artificial Sequence: Synthetic peptide
ESPSHNK

SEQ ID NO: 5989 - protein, 7 aa, Artificial Sequence
  Description of Artificial Sequence: Synthetic peptide
AGGELQK

SEQ ID NO: 5990 - protein, 7 aa, Artificial Sequence
  Description of Artificial Sequence: Synthetic peptide
LTSGKGS

SEQ ID NO: 5991 - protein, 7 aa, Artificial Sequence
  Description of Artificial Sequence: Synthetic peptide
KATSTSS

SEQ ID NO: 5992 - protein, 7 aa, Artificial Sequence
  Description of Artificial Sequence: Synthetic peptide
DGSNGKM

SEQ ID NO: 5993 - protein, 7 aa, Artificial Sequence
  Description of Artificial Sequence: Synthetic peptide
SVDKTAG

SEQ ID NO: 5994 - protein, 7 aa, Artificial Sequence
  Description of Artificial Sequence: Synthetic peptide
QGITNSN

SEQ ID NO: 5995 - protein, 7 aa, Artificial Sequence
  Description of Artificial Sequence: Synthetic peptide
HQSGSPT

SEQ ID NO: 5996 - protein, 7 aa, Artificial Sequence
  Description of Artificial Sequence: Synthetic peptide
ETVKSSQ

SEQ ID NO: 5997 - protein, 7 aa, Artificial Sequence
  Description of Artificial Sequence: Synthetic peptide
ESGDRGK

SEQ ID NO: 5998 - protein, 7 aa, Artificial Sequence
  Description of Artificial Sequence: Synthetic peptide
TSKPSSE

SEQ ID NO: 5999 - protein, 7 aa, Artificial Sequence
  Description of Artificial Sequence: Synthetic peptide
GATSPTQ

SEQ ID NO: 6000 - protein, 7 aa, Artificial Sequence
  Description of Artificial Sequence: Synthetic peptide
QANDRSA

SEQ ID NO: 6001 - protein, 7 aa, Artificial Sequence
  Description of Artificial Sequence: Synthetic peptide
NNNAHAS

SEQ ID NO: 6002 - protein, 7 aa, Artificial Sequence
  Description of Artificial Sequence: Synthetic peptide
QAQSASK

SEQ ID NO: 6003 - protein, 7 aa, Artificial Sequence
  Description of Artificial Sequence: Synthetic peptide
SSYEPNK

SEQ ID NO: 6004 - protein, 7 aa, Artificial Sequence
  Description of Artificial Sequence: Synthetic peptide
SKTGGTS

SEQ ID NO: 6005 - protein, 7 aa, Artificial Sequence
  Description of Artificial Sequence: Synthetic peptide
SSSDKHG

SEQ ID NO: 6006 - protein, 7 aa, Artificial Sequence
  Description of Artificial Sequence: Synthetic peptide
SMPGEKR

SEQ ID NO: 6007 - protein, 7 aa, Artificial Sequence
  Description of Artificial Sequence: Synthetic peptide
IEGSGHS

SEQ ID NO: 6008 - protein, 7 aa, Artificial Sequence
  Description of Artificial Sequence: Synthetic peptide
GSTAAPG

SEQ ID NO: 6009 - protein, 7 aa, Artificial Sequence
  Description of Artificial Sequence: Synthetic peptide
GTTATVG

SEQ ID NO: 6010 - protein, 7 aa, Artificial Sequence
  Description of Artificial Sequence: Synthetic peptide
GQTTGTH

SEQ ID NO: 6011 - protein, 7 aa, Artificial Sequence
  Description of Artificial Sequence: Synthetic peptide
TNSSPTL

SEQ ID NO: 6012 - protein, 7 aa, Artificial Sequence
  Description of Artificial Sequence: Synthetic peptide
STSRQEG

SEQ ID NO: 6013 - protein, 7 aa, Artificial Sequence
  Description of Artificial Sequence: Synthetic peptide
TTVGPNH

SEQ ID NO: 6014 - protein, 7 aa, Artificial Sequence
  Description of Artificial Sequence: Synthetic peptide
ENSSAIK

SEQ ID NO: 6015 - protein, 7 aa, Artificial Sequence
  Description of Artificial Sequence: Synthetic peptide
VATTSSS

SEQ ID NO: 6016 - protein, 7 aa, Artificial Sequence
  Description of Artificial Sequence: Synthetic peptide
RDHTPTT

SEQ ID NO: 6017 - protein, 7 aa, Artificial Sequence
  Description of Artificial Sequence: Synthetic peptide
ISSRGSE

SEQ ID NO: 6018 - protein, 7 aa, Artificial Sequence
  Description of Artificial Sequence: Synthetic peptide
GGGTPVT

SEQ ID NO: 6019 - protein, 7 aa, Artificial Sequence
  Description of Artificial Sequence: Synthetic peptide
TSTTQPH

SEQ ID NO: 6020 - protein, 7 aa, Artificial Sequence
  Description of Artificial Sequence: Synthetic peptide
ARTQSSS

SEQ ID NO: 6021 - protein, 7 aa, Artificial Sequence
  Description of Artificial Sequence: Synthetic peptide
GKVNTTT

SEQ ID NO: 6022 - protein, 7 aa, Artificial Sequence
  Description of Artificial Sequence: Synthetic peptide
TGGEKKS

SEQ ID NO: 6023 - protein, 7 aa, Artificial Sequence
  Description of Artificial Sequence: Synthetic peptide
GSGSSSV

SEQ ID NO: 6024 - protein, 7 aa, Artificial Sequence
  Description of Artificial Sequence: Synthetic peptide
QVTGNPP

SEQ ID NO: 6025 - protein, 7 aa, Artificial Sequence
  Description of Artificial Sequence: Synthetic peptide
VTGGASQ

SEQ ID NO: 6026 - protein, 7 aa, Artificial Sequence
  Description of Artificial Sequence: Synthetic peptide
NASPSAG

SEQ ID NO: 6027 - protein, 7 aa, Artificial Sequence
  Description of Artificial Sequence: Synthetic peptide
GHGDGPR

SEQ ID NO: 6028 - protein, 7 aa, Artificial Sequence
  Description of Artificial Sequence: Synthetic peptide
STTGDTK

SEQ ID NO: 6029 - protein, 7 aa, Artificial Sequence
  Description of Artificial Sequence: Synthetic peptide
TGTKSDN

SEQ ID NO: 6030 - protein, 7 aa, Artificial Sequence
  Description of Artificial Sequence: Synthetic peptide
SGINAPT

SEQ ID NO: 6031 - protein, 7 aa, Artificial Sequence
  Description of Artificial Sequence: Synthetic peptide
GLGSSST

SEQ ID NO: 6032 - protein, 7 aa, Artificial Sequence
  Description of Artificial Sequence: Synthetic peptide
SAGNTPL

SEQ ID NO: 6033 - protein, 7 aa, Artificial Sequence
  Description of Artificial Sequence: Synthetic peptide
TKDHTPS

SEQ ID NO: 6034 - protein, 7 aa, Artificial Sequence
  Description of Artificial Sequence: Synthetic peptide
RGSDTAN

SEQ ID NO: 6035 - protein, 7 aa, Artificial Sequence
  Description of Artificial Sequence: Synthetic peptide
DSTAKDS

SEQ ID NO: 6036 - protein, 7 aa, Artificial Sequence
  Description of Artificial Sequence: Synthetic peptide
GKSNATF

SEQ ID NO: 6037 - protein, 7 aa, Artificial Sequence
  Description of Artificial Sequence: Synthetic peptide
SVGRDPS

SEQ ID NO: 6038 - protein, 7 aa, Artificial Sequence
  Description of Artificial Sequence: Synthetic peptide
LTGHQGG

SEQ ID NO: 6039 - protein, 7 aa, Artificial Sequence
  Description of Artificial Sequence: Synthetic peptide
QRGNQNV

SEQ ID NO: 6040 - protein, 7 aa, Artificial Sequence
  Description of Artificial Sequence: Synthetic peptide
STNSGGS

SEQ ID NO: 6041 - protein, 7 aa, Artificial Sequence
  Description of Artificial Sequence: Synthetic peptide
HGGGSVT

SEQ ID NO: 6042 - protein, 7 aa, Artificial Sequence
  Description of Artificial Sequence: Synthetic peptide
MSGQTSV

SEQ ID NO: 6043 - protein, 7 aa, Artificial Sequence
  Description of Artificial Sequence: Synthetic peptide
DNVSPKS

SEQ ID NO: 6044 - protein, 7 aa, Artificial Sequence
  Description of Artificial Sequence: Synthetic peptide
SGNAGPS

SEQ ID NO: 6045 - protein, 7 aa, Artificial Sequence
  Description of Artificial Sequence: Synthetic peptide
ERGSGTN

SEQ ID NO: 6046 - protein, 7 aa, Artificial Sequence
  Description of Artificial Sequence: Synthetic peptide
GNDHQKT

SEQ ID NO: 6047 - protein, 7 aa, Artificial Sequence
  Description of Artificial Sequence: Synthetic peptide
KPLDKHE

SEQ ID NO: 6048 - protein, 7 aa, Artificial Sequence
  Description of Artificial Sequence: Synthetic peptide
HQTSSST

SEQ ID NO: 6049 - protein, 7 aa, Artificial Sequence
  Description of Artificial Sequence: Synthetic peptide
SQPTGQT

SEQ ID NO: 6050 - protein, 7 aa, Artificial Sequence
  Description of Artificial Sequence: Synthetic peptide
NAASDLK

SEQ ID NO: 6051 - protein, 7 aa, Artificial Sequence
  Description of Artificial Sequence: Synthetic peptide
LVGTTPA

SEQ ID NO: 6052 - protein, 7 aa, Artificial Sequence
  Description of Artificial Sequence: Synthetic peptide
VATGSTT

SEQ ID NO: 6053 - protein, 7 aa, Artificial Sequence
  Description of Artificial Sequence: Synthetic peptide
DVAKGKD

SEQ ID NO: 6054 - protein, 7 aa, Artificial Sequence
  Description of Artificial Sequence: Synthetic peptide
AEVQKSG

SEQ ID NO: 6055 - protein, 7 aa, Artificial Sequence
  Description of Artificial Sequence: Synthetic peptide
GLGVHAA

SEQ ID NO: 6056 - protein, 7 aa, Artificial Sequence
  Description of Artificial Sequence: Synthetic peptide
GPQTSSG

SEQ ID NO: 6057 - protein, 7 aa, Artificial Sequence
  Description of Artificial Sequence: Synthetic peptide
KNASGAT

SEQ ID NO: 6058 - protein, 7 aa, Artificial Sequence
  Description of Artificial Sequence: Synthetic peptide
TGNGAGQ

SEQ ID NO: 6059 - protein, 7 aa, Artificial Sequence
  Description of Artificial Sequence: Synthetic peptide
MNSGQSS

SEQ ID NO: 6060 - protein, 7 aa, Artificial Sequence
  Description of Artificial Sequence: Synthetic peptide
ISTDKAN

SEQ ID NO: 6061 - protein, 7 aa, Artificial Sequence
  Description of Artificial Sequence: Synthetic peptide
EPSNNRV

SEQ ID NO: 6062 - protein, 7 aa, Artificial Sequence
  Description of Artificial Sequence: Synthetic peptide
GQGTGPI

SEQ ID NO: 6063 - protein, 7 aa, Artificial Sequence
  Description of Artificial Sequence: Synthetic peptide
DSRPSSN

SEQ ID NO: 6064 - protein, 7 aa, Artificial Sequence
  Description of Artificial Sequence: Synthetic peptide
EQRTKDS

SEQ ID NO: 6065 - protein, 7 aa, Artificial Sequence
  Description of Artificial Sequence: Synthetic peptide
ELSSKAS

SEQ ID NO: 6066 - protein, 7 aa, Artificial Sequence
  Description of Artificial Sequence: Synthetic peptide
SADRNNA

SEQ ID NO: 6067 - protein, 7 aa, Artificial Sequence
  Description of Artificial Sequence: Synthetic peptide
QKPGNLG

SEQ ID NO: 6068 - protein, 7 aa, Artificial Sequence
  Description of Artificial Sequence: Synthetic peptide
HTTDKIQ

SEQ ID NO: 6069 - protein, 7 aa, Artificial Sequence
  Description of Artificial Sequence: Synthetic peptide
NSNSRNE

SEQ ID NO: 6070 - protein, 7 aa, Artificial Sequence
  Description of Artificial Sequence: Synthetic peptide
DSLAVTK

SEQ ID NO: 6071 - protein, 7 aa, Artificial Sequence
  Description of Artificial Sequence: Synthetic peptide
DGQNTAS

SEQ ID NO: 6072 - protein, 7 aa, Artificial Sequence
  Description of Artificial Sequence: Synthetic peptide
VQNTHSS

SEQ ID NO: 6073 - protein, 7 aa, Artificial Sequence
  Description of Artificial Sequence: Synthetic peptide
STVGSPS

SEQ ID NO: 6074 - protein, 7 aa, Artificial Sequence
  Description of Artificial Sequence: Synthetic peptide
NNTTSSA

SEQ ID NO: 6075 - protein, 7 aa, Artificial Sequence
  Description of Artificial Sequence: Synthetic peptide
TGSTPAL

SEQ ID NO: 6076 - protein, 7 aa, Artificial Sequence
  Description of Artificial Sequence: Synthetic peptide
VSSSSSG

SEQ ID NO: 6077 - protein, 7 aa, Artificial Sequence
  Description of Artificial Sequence: Synthetic peptide
HNTEKPS

SEQ ID NO: 6078 - protein, 7 aa, Artificial Sequence
  Description of Artificial Sequence: Synthetic peptide
QTGGTAG

SEQ ID NO: 6079 - protein, 7 aa, Artificial Sequence
  Description of Artificial Sequence: Synthetic peptide
STTQSQA

SEQ ID NO: 6080 - protein, 7 aa, Artificial Sequence
  Description of Artificial Sequence: Synthetic peptide
TTGSGNQ

SEQ ID NO: 6081 - protein, 7 aa, Artificial Sequence
  Description of Artificial Sequence: Synthetic peptide
HGVNSPS

SEQ ID NO: 6082 - protein, 7 aa, Artificial Sequence
  Description of Artificial Sequence: Synthetic peptide
ARSTSNS

SEQ ID NO: 6083 - protein, 7 aa, Artificial Sequence
  Description of Artificial Sequence: Synthetic peptide
ESTGSLK

SEQ ID NO: 6084 - protein, 7 aa, Artificial Sequence
  Description of Artificial Sequence: Synthetic peptide
TPDAKSV

SEQ ID NO: 6085 - protein, 7 aa, Artificial Sequence
  Description of Artificial Sequence: Synthetic peptide
GSSTSPV

SEQ ID NO: 6086 - protein, 7 aa, Artificial Sequence
  Description of Artificial Sequence: Synthetic peptide
SGQQVNV

SEQ ID NO: 6087 - protein, 7 aa, Artificial Sequence
  Description of Artificial Sequence: Synthetic peptide
DNTGKGS

SEQ ID NO: 6088 - protein, 7 aa, Artificial Sequence
  Description of Artificial Sequence: Synthetic peptide
TDDRSKS

SEQ ID NO: 6089 - protein, 7 aa, Artificial Sequence
  Description of Artificial Sequence: Synthetic peptide
GNDGRSA

SEQ ID NO: 6090 - protein, 7 aa, Artificial Sequence
  Description of Artificial Sequence: Synthetic peptide
TTQTPSL

SEQ ID NO: 6091 - protein, 7 aa, Artificial Sequence
  Description of Artificial Sequence: Synthetic peptide
RNGKEIV

SEQ ID NO: 6092 - protein, 7 aa, Artificial Sequence
  Description of Artificial Sequence: Synthetic peptide
GDSRQSV

SEQ ID NO: 6093 - protein, 7 aa, Artificial Sequence
  Description of Artificial Sequence: Synthetic peptide
QTQKGNG

SEQ ID NO: 6094 - protein, 7 aa, Artificial Sequence
  Description of Artificial Sequence: Synthetic peptide
GNISGSK

SEQ ID NO: 6095 - protein, 7 aa, Artificial Sequence
  Description of Artificial Sequence: Synthetic peptide
SKATSNG

SEQ ID NO: 6096 - protein, 7 aa, Artificial Sequence
  Description of Artificial Sequence: Synthetic peptide
HKGQHTE

SEQ ID NO: 6097 - protein, 7 aa, Artificial Sequence
  Description of Artificial Sequence: Synthetic peptide
HNSEIAK

SEQ ID NO: 6098 - protein, 7 aa, Artificial Sequence
  Description of Artificial Sequence: Synthetic peptide
QNPPPAK

SEQ ID NO: 6099 - protein, 7 aa, Artificial Sequence
  Description of Artificial Sequence: Synthetic peptide
RSGEDTK

SEQ ID NO: 6100 - protein, 7 aa, Artificial Sequence
  Description of Artificial Sequence: Synthetic peptide
AQGSSAT

SEQ ID NO: 6101 - protein, 7 aa, Artificial Sequence
  Description of Artificial Sequence: Synthetic peptide
GTMTDRS

SEQ ID NO: 6102 - protein, 7 aa, Artificial Sequence
  Description of Artificial Sequence: Synthetic peptide
GLAANSL

SEQ ID NO: 6103 - protein, 7 aa, Artificial Sequence
  Description of Artificial Sequence: Synthetic peptide
STTKGGS

SEQ ID NO: 6104 - protein, 7 aa, Artificial Sequence
  Description of Artificial Sequence: Synthetic peptide
LSSNAGK

SEQ ID NO: 6105 - protein, 7 aa, Artificial Sequence
  Description of Artificial Sequence: Synthetic peptide
DTGSRTS

SEQ ID NO: 6106 - protein, 7 aa, Artificial Sequence
  Description of Artificial Sequence: Synthetic peptide
GKSTNNM

SEQ ID NO: 6107 - protein, 7 aa, Artificial Sequence
  Description of Artificial Sequence: Synthetic peptide
RQDAAGS

SEQ ID NO: 6108 - protein, 7 aa, Artificial Sequence
  Description of Artificial Sequence: Synthetic peptide
SGQPVPS

SEQ ID NO: 6109 - protein, 7 aa, Artificial Sequence
  Description of Artificial Sequence: Synthetic peptide
IPEAKLG

SEQ ID NO: 6110 - protein, 7 aa, Artificial Sequence
  Description of Artificial Sequence: Synthetic peptide
STGGNLK

SEQ ID NO: 6111 - protein, 7 aa, Artificial Sequence
  Description of Artificial Sequence: Synthetic peptide
TSMDKTS

SEQ ID NO: 6112 - protein, 7 aa, Artificial Sequence
  Description of Artificial Sequence: Synthetic peptide
ITGTTSQ

SEQ ID NO: 6113 - protein, 7 aa, Artificial Sequence
  Description of Artificial Sequence: Synthetic peptide
AVGPSSQ

SEQ ID NO: 6114 - protein, 7 aa, Artificial Sequence
  Description of Artificial Sequence: Synthetic peptide
GNMPPNK

SEQ ID NO: 6115 - protein, 7 aa, Artificial Sequence
  Description of Artificial Sequence: Synthetic peptide
NASGTDR

SEQ ID NO: 6116 - protein, 7 aa, Artificial Sequence
  Description of Artificial Sequence: Synthetic peptide
DTTATPR

SEQ ID NO: 6117 - protein, 7 aa, Artificial Sequence
  Description of Artificial Sequence: Synthetic peptide
GLDMKST

SEQ ID NO: 6118 - protein, 7 aa, Artificial Sequence
  Description of Artificial Sequence: Synthetic peptide
VATAATK

SEQ ID NO: 6119 - protein, 7 aa, Artificial Sequence
  Description of Artificial Sequence: Synthetic peptide
GSIPSPK

SEQ ID NO: 6120 - protein, 7 aa, Artificial Sequence
  Description of Artificial Sequence: Synthetic peptide
NKVSADG

SEQ ID NO: 6121 - protein, 7 aa, Artificial Sequence
  Description of Artificial Sequence: Synthetic peptide
STSNVNR

SEQ ID NO: 6122 - protein, 7 aa, Artificial Sequence
  Description of Artificial Sequence: Synthetic peptide
SSTQSSN

SEQ ID NO: 6123 - protein, 7 aa, Artificial Sequence
  Description of Artificial Sequence: Synthetic peptide
STKSASS

SEQ ID NO: 6124 - protein, 7 aa, Artificial Sequence
  Description of Artificial Sequence: Synthetic peptide
ASTNHAT

SEQ ID NO: 6125 - protein, 7 aa, Artificial Sequence
  Description of Artificial Sequence: Synthetic peptide
ESANRNS

SEQ ID NO: 6126 - protein, 7 aa, Artificial Sequence
  Description of Artificial Sequence: Synthetic peptide
TIGKSSS

SEQ ID NO: 6127 - protein, 7 aa, Artificial Sequence
  Description of Artificial Sequence: Synthetic peptide
TPVEHKG

SEQ ID NO: 6128 - protein, 7 aa, Artificial Sequence
  Description of Artificial Sequence: Synthetic peptide
QDSSSVK

SEQ ID NO: 6129 - protein, 7 aa, Artificial Sequence
  Description of Artificial Sequence: Synthetic peptide
ESGSSRE

SEQ ID NO: 6130 - protein, 7 aa, Artificial Sequence
  Description of Artificial Sequence: Synthetic peptide
GTSKAVG

SEQ ID NO: 6131 - protein, 7 aa, Artificial Sequence
  Description of Artificial Sequence: Synthetic peptide
GQSNKVG

SEQ ID NO: 6132 - protein, 7 aa, Artificial Sequence
  Description of Artificial Sequence: Synthetic peptide
SAPTGNV

SEQ ID NO: 6133 - protein, 7 aa, Artificial Sequence
  Description of Artificial Sequence: Synthetic peptide
GHNSPSV

SEQ ID NO: 6134 - protein, 7 aa, Artificial Sequence
  Description of Artificial Sequence: Synthetic peptide
VGSPAST

SEQ ID NO: 6135 - protein, 7 aa, Artificial Sequence
  Description of Artificial Sequence: Synthetic peptide
QSKAAMV

SEQ ID NO: 6136 - protein, 7 aa, Artificial Sequence
  Description of Artificial Sequence: Synthetic peptide
AGSTAPR

SEQ ID NO: 6137 - protein, 7 aa, Artificial Sequence
  Description of Artificial Sequence: Synthetic peptide
NATKDQV

SEQ ID NO: 6138 - protein, 7 aa, Artificial Sequence
  Description of Artificial Sequence: Synthetic peptide
DAERTKS

SEQ ID NO: 6139 - protein, 7 aa, Artificial Sequence
  Description of Artificial Sequence: Synthetic peptide
HPSPTTA

SEQ ID NO: 6140 - protein, 7 aa, Artificial Sequence
  Description of Artificial Sequence: Synthetic peptide
GKQTVSQ

SEQ ID NO: 6141 - protein, 7 aa, Artificial Sequence
  Description of Artificial Sequence: Synthetic peptide
GGKDSVN

SEQ ID NO: 6142 - protein, 7 aa, Artificial Sequence
  Description of Artificial Sequence: Synthetic peptide
GKESHPV

SEQ ID NO: 6143 - protein, 7 aa, Artificial Sequence
  Description of Artificial Sequence: Synthetic peptide
SLHAPTS

SEQ ID NO: 6144 - protein, 7 aa, Artificial Sequence
  Description of Artificial Sequence: Synthetic peptide
NSDKNAK

SEQ ID NO: 6145 - protein, 7 aa, Artificial Sequence
  Description of Artificial Sequence: Synthetic peptide
TTNAQSK

SEQ ID NO: 6146 - protein, 7 aa, Artificial Sequence
  Description of Artificial Sequence: Synthetic peptide
ETKNSLG

SEQ ID NO: 6147 - protein, 7 aa, Artificial Sequence
  Description of Artificial Sequence: Synthetic peptide
RGSDTTS

SEQ ID NO: 6148 - protein, 7 aa, Artificial Sequence
  Description of Artificial Sequence: Synthetic peptide
GSQKIAT

SEQ ID NO: 6149 - protein, 7 aa, Artificial Sequence
  Description of Artificial Sequence: Synthetic peptide
VQDKTNT

SEQ ID NO: 6150 - protein, 7 aa, Artificial Sequence
  Description of Artificial Sequence: Synthetic peptide
MHDKPAS

SEQ ID NO: 6151 - protein, 7 aa, Artificial Sequence
  Description of Artificial Sequence: Synthetic peptide
DNPAGIR

SEQ ID NO: 6152 - protein, 7 aa, Artificial Sequence
  Description of Artificial Sequence: Synthetic peptide
TTVSAAS

SEQ ID NO: 6153 - protein, 7 aa, Artificial Sequence
  Description of Artificial Sequence: Synthetic peptide
RSNGQLS

SEQ ID NO: 6154 - protein, 7 aa, Artificial Sequence
  Description of Artificial Sequence: Synthetic peptide
HGTQEPR

SEQ ID NO: 6155 - protein, 7 aa, Artificial Sequence
  Description of Artificial Sequence: Synthetic peptide
DTSKETR

SEQ ID NO: 6156 - protein, 7 aa, Artificial Sequence
  Description of Artificial Sequence: Synthetic peptide
ADGAGRA

SEQ ID NO: 6157 - protein, 7 aa, Artificial Sequence
  Description of Artificial Sequence: Synthetic peptide
DGNNSHR

SEQ ID NO: 6158 - protein, 7 aa, Artificial Sequence
  Description of Artificial Sequence: Synthetic peptide
MAQSTNT

SEQ ID NO: 6159 - protein, 7 aa, Artificial Sequence
  Description of Artificial Sequence: Synthetic peptide
DSQASPH

SEQ ID NO: 6160 - protein, 7 aa, Artificial Sequence
  Description of Artificial Sequence: Synthetic peptide
TGGSKIS

SEQ ID NO: 6161 - protein, 7 aa, Artificial Sequence
  Description of Artificial Sequence: Synthetic peptide
NGLDKIR

SEQ ID NO: 6162 - protein, 7 aa, Artificial Sequence
  Description of Artificial Sequence: Synthetic peptide
SESTGTR

SEQ ID NO: 6163 - protein, 7 aa, Artificial Sequence
  Description of Artificial Sequence: Synthetic peptide
SKGSPSS

SEQ ID NO: 6164 - protein, 7 aa, Artificial Sequence
  Description of Artificial Sequence: Synthetic peptide
GLSGASG

SEQ ID NO: 6165 - protein, 7 aa, Artificial Sequence
  Description of Artificial Sequence: Synthetic peptide
SMGKDSH

SEQ ID NO: 6166 - protein, 7 aa, Artificial Sequence
  Description of Artificial Sequence: Synthetic peptide
QGSPSAH

SEQ ID NO: 6167 - protein, 7 aa, Artificial Sequence
  Description of Artificial Sequence: Synthetic peptide
SPSKSAE

SEQ ID NO: 6168 - protein, 7 aa, Artificial Sequence
  Description of Artificial Sequence: Synthetic peptide
SKGDGAS

SEQ ID NO: 6169 - protein, 7 aa, Artificial Sequence
  Description of Artificial Sequence: Synthetic peptide
MGNSSQG

SEQ ID NO: 6170 - protein, 7 aa, Artificial Sequence
  Description of Artificial Sequence: Synthetic peptide
GESNSAH

SEQ ID NO: 6171 - protein, 7 aa, Artificial Sequence
  Description of Artificial Sequence: Synthetic peptide
VTGTTVG

SEQ ID NO: 6172 - protein, 7 aa, Artificial Sequence
  Description of Artificial Sequence: Synthetic peptide
KMTASQG

SEQ ID NO: 6173 - protein, 7 aa, Artificial Sequence
  Description of Artificial Sequence: Synthetic peptide
MPSSPAS

SEQ ID NO: 6174 - protein, 7 aa, Artificial Sequence
  Description of Artificial Sequence: Synthetic peptide
ETSDPRT

SEQ ID NO: 6175 - protein, 7 aa, Artificial Sequence
  Description of Artificial Sequence: Synthetic peptide
NSTNSGA

SEQ ID NO: 6176 - protein, 7 aa, Artificial Sequence
  Description of Artificial Sequence: Synthetic peptide
SPKGNGN

SEQ ID NO: 6177 - protein, 7 aa, Artificial Sequence
  Description of Artificial Sequence: Synthetic peptide
SGASPSA

SEQ ID NO: 6178 - protein, 7 aa, Artificial Sequence
  Description of Artificial Sequence: Synthetic peptide
GTDKSKP

SEQ ID NO: 6179 - protein, 7 aa, Artificial Sequence
  Description of Artificial Sequence: Synthetic peptide
VNGGAAA

SEQ ID NO: 6180 - protein, 7 aa, Artificial Sequence
  Description of Artificial Sequence: Synthetic peptide
ARDVGSG

SEQ ID NO: 6181 - protein, 7 aa, Artificial Sequence
  Description of Artificial Sequence: Synthetic peptide
QMGATGT

SEQ ID NO: 6182 - protein, 7 aa, Artificial Sequence
  Description of Artificial Sequence: Synthetic peptide
AGQGKTL

SEQ ID NO: 6183 - protein, 7 aa, Artificial Sequence
  Description of Artificial Sequence: Synthetic peptide
TPSNTTL

SEQ ID NO: 6184 - protein, 7 aa, Artificial Sequence
  Description of Artificial Sequence: Synthetic peptide
GSEAPSR

SEQ ID NO: 6185 - protein, 7 aa, Artificial Sequence
  Description of Artificial Sequence: Synthetic peptide
RSGDSIS

SEQ ID NO: 6186 - protein, 7 aa, Artificial Sequence
  Description of Artificial Sequence: Synthetic peptide
LGTNSSH

SEQ ID NO: 6187 - protein, 7 aa, Artificial Sequence
  Description of Artificial Sequence: Synthetic peptide
ESKTGSG

SEQ ID NO: 6188 - protein, 7 aa, Artificial Sequence
  Description of Artificial Sequence: Synthetic peptide
ESAKQNF

SEQ ID NO: 6189 - protein, 7 aa, Artificial Sequence
  Description of Artificial Sequence: Synthetic peptide
GPESPRS

SEQ ID NO: 6190 - protein, 7 aa, Artificial Sequence
  Description of Artificial Sequence: Synthetic peptide
VNGQSTA

SEQ ID NO: 6191 - protein, 7 aa, Artificial Sequence
  Description of Artificial Sequence: Synthetic peptide
LPSSDQR

SEQ ID NO: 6192 - protein, 7 aa, Artificial Sequence
  Description of Artificial Sequence: Synthetic peptide
STGSATS

SEQ ID NO: 6193 - protein, 7 aa, Artificial Sequence
  Description of Artificial Sequence: Synthetic peptide
NRNTTAS

SEQ ID NO: 6194 - protein, 7 aa, Artificial Sequence
  Description of Artificial Sequence: Synthetic peptide
GSSSDHR

SEQ ID NO: 6195 - protein, 7 aa, Artificial Sequence
  Description of Artificial Sequence: Synthetic peptide
EQGASSR

SEQ ID NO: 6196 - protein, 7 aa, Artificial Sequence
  Description of Artificial Sequence: Synthetic peptide
KSTGSQG

SEQ ID NO: 6197 - protein, 7 aa, Artificial Sequence
  Description of Artificial Sequence: Synthetic peptide
SGSERSL

SEQ ID NO: 6198 - protein, 7 aa, Artificial Sequence
  Description of Artificial Sequence: Synthetic peptide
GGASTTH

SEQ ID NO: 6199 - protein, 7 aa, Artificial Sequence
  Description of Artificial Sequence: Synthetic peptide
KGSPASS

SEQ ID NO: 6200 - protein, 7 aa, Artificial Sequence
  Description of Artificial Sequence: Synthetic peptide
EVSGQRQ

SEQ ID NO: 6201 - protein, 7 aa, Artificial Sequence
  Description of Artificial Sequence: Synthetic peptide
AHVGDKS

SEQ ID NO: 6202 - protein, 7 aa, Artificial Sequence
  Description of Artificial Sequence: Synthetic peptide
TPSDKGA

SEQ ID NO: 6203 - protein, 7 aa, Artificial Sequence
  Description of Artificial Sequence: Synthetic peptide
TQSSNPS

SEQ ID NO: 6204 - protein, 7 aa, Artificial Sequence
  Description of Artificial Sequence: Synthetic peptide
GSTERHS

SEQ ID NO: 6205 - protein, 7 aa, Artificial Sequence
  Description of Artificial Sequence: Synthetic peptide
GTAAPAH

SEQ ID NO: 6206 - protein, 7 aa, Artificial Sequence
  Description of Artificial Sequence: Synthetic peptide
TMAGTNQ

SEQ ID NO: 6207 - protein, 7 aa, Artificial Sequence
  Description of Artificial Sequence: Synthetic peptide
STQNPKD

SEQ ID NO: 6208 - protein, 7 aa, Artificial Sequence
  Description of Artificial Sequence: Synthetic peptide
EGQTTSL

SEQ ID NO: 6209 - protein, 7 aa, Artificial Sequence
  Description of Artificial Sequence: Synthetic peptide
DRAKESS

SEQ ID NO: 6210 - protein, 7 aa, Artificial Sequence
  Description of Artificial Sequence: Synthetic peptide
VTTTNSK

SEQ ID NO: 6211 - protein, 7 aa, Artificial Sequence
  Description of Artificial Sequence: Synthetic peptide
SSQTNNV

SEQ ID NO: 6212 - protein, 7 aa, Artificial Sequence
  Description of Artificial Sequence: Synthetic peptide
SSTKSSP

SEQ ID NO: 6213 - protein, 7 aa, Artificial Sequence
  Description of Artificial Sequence: Synthetic peptide
SSGPQPS

SEQ ID NO: 6214 - protein, 7 aa, Artificial Sequence
  Description of Artificial Sequence: Synthetic peptide
QTDAKSL

SEQ ID NO: 6215 - protein, 7 aa, Artificial Sequence
  Description of Artificial Sequence: Synthetic peptide
VPAGSGG

SEQ ID NO: 6216 - protein, 7 aa, Artificial Sequence
  Description of Artificial Sequence: Synthetic peptide
MQAQKES

SEQ ID NO: 6217 - protein, 7 aa, Artificial Sequence
  Description of Artificial Sequence: Synthetic peptide
HVNMKEG

SEQ ID NO: 6218 - protein, 7 aa, Artificial Sequence
  Description of Artificial Sequence: Synthetic peptide
DTVSKSN

SEQ ID NO: 6219 - protein, 7 aa, Artificial Sequence
  Description of Artificial Sequence: Synthetic peptide
DSNKSPH

SEQ ID NO: 6220 - protein, 7 aa, Artificial Sequence
  Description of Artificial Sequence: Synthetic peptide
NGVPQPK

SEQ ID NO: 6221 - protein, 7 aa, Artificial Sequence
  Description of Artificial Sequence: Synthetic peptide
NSSGSGG

SEQ ID NO: 6222 - protein, 7 aa, Artificial Sequence
  Description of Artificial Sequence: Synthetic peptide
TSAQTPH

SEQ ID NO: 6223 - protein, 7 aa, Artificial Sequence
  Description of Artificial Sequence: Synthetic peptide
SSGDGYQ

SEQ ID NO: 6224 - protein, 7 aa, Artificial Sequence
  Description of Artificial Sequence: Synthetic peptide
DARGSVS

SEQ ID NO: 6225 - protein, 7 aa, Artificial Sequence
  Description of Artificial Sequence: Synthetic peptide
SAGDRNL

SEQ ID NO: 6226 - protein, 7 aa, Artificial Sequence
  Description of Artificial Sequence: Synthetic peptide
TDASQRS

SEQ ID NO: 6227 - protein, 7 aa, Artificial Sequence
  Description of Artificial Sequence: Synthetic peptide
SSGDKSL

SEQ ID NO: 6228 - protein, 7 aa, Artificial Sequence
  Description of Artificial Sequence: Synthetic peptide
SHAKSSE

SEQ ID NO: 6229 - protein, 7 aa, Artificial Sequence
  Description of Artificial Sequence: Synthetic peptide
VRSESTA

SEQ ID NO: 6230 - protein, 7 aa, Artificial Sequence
  Description of Artificial Sequence: Synthetic peptide
SAGSTPT

SEQ ID NO: 6231 - protein, 7 aa, Artificial Sequence
  Description of Artificial Sequence: Synthetic peptide
SKSTTPS

SEQ ID NO: 6232 - protein, 7 aa, Artificial Sequence
  Description of Artificial Sequence: Synthetic peptide
SSAGVGA

SEQ ID NO: 6233 - protein, 7 aa, Artificial Sequence
  Description of Artificial Sequence: Synthetic peptide
HPLKDGG

SEQ ID NO: 6234 - protein, 7 aa, Artificial Sequence
  Description of Artificial Sequence: Synthetic peptide
TDSSPSK

SEQ ID NO: 6235 - protein, 7 aa, Artificial Sequence
  Description of Artificial Sequence: Synthetic peptide
NGDVGRG

SEQ ID NO: 6236 - protein, 7 aa, Artificial Sequence
  Description of Artificial Sequence: Synthetic peptide
NGSGQKE

SEQ ID NO: 6237 - protein, 7 aa, Artificial Sequence
  Description of Artificial Sequence: Synthetic peptide
GEPSVNK

SEQ ID NO: 6238 - protein, 7 aa, Artificial Sequence
  Description of Artificial Sequence: Synthetic peptide
NTKEGSG

SEQ ID NO: 6239 - protein, 7 aa, Artificial Sequence
  Description of Artificial Sequence: Synthetic peptide
NPDASGK

SEQ ID NO: 6240 - protein, 7 aa, Artificial Sequence
  Description of Artificial Sequence: Synthetic peptide
SSMAKTQ

SEQ ID NO: 6241 - protein, 7 aa, Artificial Sequence
  Description of Artificial Sequence: Synthetic peptide
MPGTKVI

SEQ ID NO: 6242 - protein, 7 aa, Artificial Sequence
  Description of Artificial Sequence: Synthetic peptide
QASSSSV

SEQ ID NO: 6243 - protein, 7 aa, Artificial Sequence
  Description of Artificial Sequence: Synthetic peptide
EGRQGGS

SEQ ID NO: 6244 - protein, 7 aa, Artificial Sequence
  Description of Artificial Sequence: Synthetic peptide
STAGANA

SEQ ID NO: 6245 - protein, 7 aa, Artificial Sequence
  Description of Artificial Sequence: Synthetic peptide
SGNPGGA

SEQ ID NO: 6246 - protein, 7 aa, Artificial Sequence
  Description of Artificial Sequence: Synthetic peptide
TIETGKG

SEQ ID NO: 6247 - protein, 7 aa, Artificial Sequence
  Description of Artificial Sequence: Synthetic peptide
SQGDASR

SEQ ID NO: 6248 - protein, 7 aa, Artificial Sequence
  Description of Artificial Sequence: Synthetic peptide
GERGEKS

SEQ ID NO: 6249 - protein, 7 aa, Artificial Sequence
  Description of Artificial Sequence: Synthetic peptide
NGSSTAS

SEQ ID NO: 6250 - protein, 7 aa, Artificial Sequence
  Description of Artificial Sequence: Synthetic peptide
TGNSGST

SEQ ID NO: 6251 - protein, 7 aa, Artificial Sequence
  Description of Artificial Sequence: Synthetic peptide
SRGSDAS

SEQ ID NO: 6252 - protein, 7 aa, Artificial Sequence
  Description of Artificial Sequence: Synthetic peptide
HNSSGIH

SEQ ID NO: 6253 - protein, 7 aa, Artificial Sequence
  Description of Artificial Sequence: Synthetic peptide
TPDANRR

SEQ ID NO: 6254 - protein, 7 aa, Artificial Sequence
  Description of Artificial Sequence: Synthetic peptide
VNGASVS

SEQ ID NO: 6255 - protein, 7 aa, Artificial Sequence
  Description of Artificial Sequence: Synthetic peptide
LNSSKSG

SEQ ID NO: 6256 - protein, 7 aa, Artificial Sequence
  Description of Artificial Sequence: Synthetic peptide
LASGNGQ

SEQ ID NO: 6257 - protein, 7 aa, Artificial Sequence
  Description of Artificial Sequence: Synthetic peptide
ATSDKNP

SEQ ID NO: 6258 - protein, 7 aa, Artificial Sequence
  Description of Artificial Sequence: Synthetic peptide
EASRSSS

SEQ ID NO: 6259 - protein, 7 aa, Artificial Sequence
  Description of Artificial Sequence: Synthetic peptide
VGSGSPR

SEQ ID NO: 6260 - protein, 7 aa, Artificial Sequence
  Description of Artificial Sequence: Synthetic peptide
QGQGTAT

SEQ ID NO: 6261 - protein, 7 aa, Artificial Sequence
  Description of Artificial Sequence: Synthetic peptide
KANDPKA

SEQ ID NO: 6262 - protein, 7 aa, Artificial Sequence
  Description of Artificial Sequence: Synthetic peptide
DTSRKSE

SEQ ID NO: 6263 - protein, 7 aa, Artificial Sequence
  Description of Artificial Sequence: Synthetic peptide
GKVSSEK

SEQ ID NO: 6264 - protein, 7 aa, Artificial Sequence
  Description of Artificial Sequence: Synthetic peptide
TRERETV

SEQ ID NO: 6265 - protein, 7 aa, Artificial Sequence
  Description of Artificial Sequence: Synthetic peptide
SSSVPKV

SEQ ID NO: 6266 - protein, 7 aa, Artificial Sequence
  Description of Artificial Sequence: Synthetic peptide
QATGKLQ

SEQ ID NO: 6267 - protein, 7 aa, Artificial Sequence
  Description of Artificial Sequence: Synthetic peptide
ENTGSNS

SEQ ID NO: 6268 - protein, 7 aa, Artificial Sequence
  Description of Artificial Sequence: Synthetic peptide
ASSPAVA

SEQ ID NO: 6269 - protein, 7 aa, Artificial Sequence
  Description of Artificial Sequence: Synthetic peptide
ARQEATH

SEQ ID NO: 6270 - protein, 7 aa, Artificial Sequence
  Description of Artificial Sequence: Synthetic peptide
SGTVSKP

SEQ ID NO: 6271 - protein, 7 aa, Artificial Sequence
  Description of Artificial Sequence: Synthetic peptide
QISNPAH

SEQ ID NO: 6272 - protein, 7 aa, Artificial Sequence
  Description of Artificial Sequence: Synthetic peptide
DTAAVKS

SEQ ID NO: 6273 - protein, 7 aa, Artificial Sequence
  Description of Artificial Sequence: Synthetic peptide
DGSNSPN

SEQ ID NO: 6274 - protein, 7 aa, Artificial Sequence
  Description of Artificial Sequence: Synthetic peptide
GTGHNST

SEQ ID NO: 6275 - protein, 7 aa, Artificial Sequence
  Description of Artificial Sequence: Synthetic peptide
SAGNQGS

SEQ ID NO: 6276 - protein, 7 aa, Artificial Sequence
  Description of Artificial Sequence: Synthetic peptide
TKDGRNT

SEQ ID NO: 6277 - protein, 7 aa, Artificial Sequence
  Description of Artificial Sequence: Synthetic peptide
SGPTKPV

SEQ ID NO: 6278 - protein, 7 aa, Artificial Sequence
  Description of Artificial Sequence: Synthetic peptide
DKSGSIA

SEQ ID NO: 6279 - protein, 7 aa, Artificial Sequence
  Description of Artificial Sequence: Synthetic peptide
AQGQNNL

SEQ ID NO: 6280 - protein, 7 aa, Artificial Sequence
  Description of Artificial Sequence: Synthetic peptide
DSAPSLK

SEQ ID NO: 6281 - protein, 7 aa, Artificial Sequence
  Description of Artificial Sequence: Synthetic peptide
MAGAAST

SEQ ID NO: 6282 - protein, 7 aa, Artificial Sequence
  Description of Artificial Sequence: Synthetic peptide
DSSKTSA

SEQ ID NO: 6283 - protein, 7 aa, Artificial Sequence
  Description of Artificial Sequence: Synthetic peptide
TAQGSHS

SEQ ID NO: 6284 - protein, 7 aa, Artificial Sequence
  Description of Artificial Sequence: Synthetic peptide
SGVTSGG

SEQ ID NO: 6285 - protein, 7 aa, Artificial Sequence
  Description of Artificial Sequence: Synthetic peptide
TASPTPL

SEQ ID NO: 6286 - protein, 7 aa, Artificial Sequence
  Description of Artificial Sequence: Synthetic peptide
LTGKAPA

SEQ ID NO: 6287 - protein, 7 aa, Artificial Sequence
  Description of Artificial Sequence: Synthetic peptide
SDSHSAK

SEQ ID NO: 6288 - protein, 7 aa, Artificial Sequence
  Description of Artificial Sequence: Synthetic peptide
STGSNPA

SEQ ID NO: 6289 - protein, 7 aa, Artificial Sequence
  Description of Artificial Sequence: Synthetic peptide
ATHGAST

SEQ ID NO: 6290 - protein, 7 aa, Artificial Sequence
  Description of Artificial Sequence: Synthetic peptide
GSDTKPL

SEQ ID NO: 6291 - protein, 7 aa, Artificial Sequence
  Description of Artificial Sequence: Synthetic peptide
ANNKGNV

SEQ ID NO: 6292 - protein, 7 aa, Artificial Sequence
  Description of Artificial Sequence: Synthetic peptide
TGASAKT

SEQ ID NO: 6293 - protein, 7 aa, Artificial Sequence
  Description of Artificial Sequence: Synthetic peptide
LSNSKSL

SEQ ID NO: 6294 - protein, 7 aa, Artificial Sequence
  Description of Artificial Sequence: Synthetic peptide
LQASGSL

SEQ ID NO: 6295 - protein, 7 aa, Artificial Sequence
  Description of Artificial Sequence: Synthetic peptide
SSSSDKS

SEQ ID NO: 6296 - protein, 7 aa, Artificial Sequence
  Description of Artificial Sequence: Synthetic peptide
GGGDARS

SEQ ID NO: 6297 - protein, 7 aa, Artificial Sequence
  Description of Artificial Sequence: Synthetic peptide
VPSSTAK

SEQ ID NO: 6298 - protein, 7 aa, Artificial Sequence
  Description of Artificial Sequence: Synthetic peptide
TTSTGSA

SEQ ID NO: 6299 - protein, 7 aa, Artificial Sequence
  Description of Artificial Sequence: Synthetic peptide
QSSGNSV

SEQ ID NO: 6300 - protein, 7 aa, Artificial Sequence
  Description of Artificial Sequence: Synthetic peptide
DTTPKPG

SEQ ID NO: 6301 - protein, 7 aa, Artificial Sequence
  Description of Artificial Sequence: Synthetic peptide
TGESSKS

SEQ ID NO: 6302 - protein, 7 aa, Artificial Sequence
  Description of Artificial Sequence: Synthetic peptide
GSDQPVR

SEQ ID NO: 6303 - protein, 7 aa, Artificial Sequence
  Description of Artificial Sequence: Synthetic peptide
DGVKQTP

SEQ ID NO: 6304 - protein, 7 aa, Artificial Sequence
  Description of Artificial Sequence: Synthetic peptide
GSDKLKL

SEQ ID NO: 6305 - protein, 7 aa, Artificial Sequence
  Description of Artificial Sequence: Synthetic peptide
DSVSSIK

SEQ ID NO: 6306 - protein, 7 aa, Artificial Sequence
  Description of Artificial Sequence: Synthetic peptide
QTGPSPT

SEQ ID NO: 6307 - protein, 7 aa, Artificial Sequence
  Description of Artificial Sequence: Synthetic peptide
QGRDAQP

SEQ ID NO: 6308 - protein, 7 aa, Artificial Sequence
  Description of Artificial Sequence: Synthetic peptide
NSSTTSR

SEQ ID NO: 6309 - protein, 7 aa, Artificial Sequence
  Description of Artificial Sequence: Synthetic peptide
NQLVGAG

SEQ ID NO: 6310 - protein, 7 aa, Artificial Sequence
  Description of Artificial Sequence: Synthetic peptide
NEKTSSS

SEQ ID NO: 6311 - protein, 7 aa, Artificial Sequence
  Description of Artificial Sequence: Synthetic peptide
NPDSQAR

SEQ ID NO: 6312 - protein, 7 aa, Artificial Sequence
  Description of Artificial Sequence: Synthetic peptide
TTNSPNK

SEQ ID NO: 6313 - protein, 7 aa, Artificial Sequence
  Description of Artificial Sequence: Synthetic peptide
TSSQGPG

SEQ ID NO: 6314 - protein, 7 aa, Artificial Sequence
  Description of Artificial Sequence: Synthetic peptide
TADNKVR

SEQ ID NO: 6315 - protein, 7 aa, Artificial Sequence
  Description of Artificial Sequence: Synthetic peptide
TNSQGSS

SEQ ID NO: 6316 - protein, 7 aa, Artificial Sequence
  Description of Artificial Sequence: Synthetic peptide
TTDNNRI

SEQ ID NO: 6317 - protein, 7 aa, Artificial Sequence
  Description of Artificial Sequence: Synthetic peptide
TSGPSSG

SEQ ID NO: 6318 - protein, 7 aa, Artificial Sequence
  Description of Artificial Sequence: Synthetic peptide
RGGGSAA

SEQ ID NO: 6319 - protein, 7 aa, Artificial Sequence
  Description of Artificial Sequence: Synthetic peptide
SSNPSLG

SEQ ID NO: 6320 - protein, 7 aa, Artificial Sequence
  Description of Artificial Sequence: Synthetic peptide
SVGSDRI

SEQ ID NO: 6321 - protein, 7 aa, Artificial Sequence
  Description of Artificial Sequence: Synthetic peptide
MGSKKDS

SEQ ID NO: 6322 - protein, 7 aa, Artificial Sequence
  Description of Artificial Sequence: Synthetic peptide
MGGTGSS

SEQ ID NO: 6323 - protein, 7 aa, Artificial Sequence
  Description of Artificial Sequence: Synthetic peptide
QNNTGHN

SEQ ID NO: 6324 - protein, 7 aa, Artificial Sequence
  Description of Artificial Sequence: Synthetic peptide
QVASSNN

SEQ ID NO: 6325 - protein, 7 aa, Artificial Sequence
  Description of Artificial Sequence: Synthetic peptide
HGQSASS

SEQ ID NO: 6326 - protein, 7 aa, Artificial Sequence
  Description of Artificial Sequence: Synthetic peptide
HGSSKAG

SEQ ID NO: 6327 - protein, 7 aa, Artificial Sequence
  Description of Artificial Sequence: Synthetic peptide
LSAPTSA

SEQ ID NO: 6328 - protein, 7 aa, Artificial Sequence
  Description of Artificial Sequence: Synthetic peptide
LGANAAG

SEQ ID NO: 6329 - protein, 7 aa, Artificial Sequence
  Description of Artificial Sequence: Synthetic peptide
EQRSTTG

SEQ ID NO: 6330 - protein, 7 aa, Artificial Sequence
  Description of Artificial Sequence: Synthetic peptide
DNRTVNK

SEQ ID NO: 6331 - protein, 7 aa, Artificial Sequence
  Description of Artificial Sequence: Synthetic peptide
DQNIKPN

SEQ ID NO: 6332 - protein, 7 aa, Artificial Sequence
  Description of Artificial Sequence: Synthetic peptide
DSASKLS

SEQ ID NO: 6333 - protein, 7 aa, Artificial Sequence
  Description of Artificial Sequence: Synthetic peptide
ASDSKNV

SEQ ID NO: 6334 - protein, 7 aa, Artificial Sequence
  Description of Artificial Sequence: Synthetic peptide
AMNDSKL

SEQ ID NO: 6335 - protein, 7 aa, Artificial Sequence
  Description of Artificial Sequence: Synthetic peptide
ALTDQRG

SEQ ID NO: 6336 - protein, 7 aa, Artificial Sequence
  Description of Artificial Sequence: Synthetic peptide
AATLPAG

SEQ ID NO: 6337 - protein, 7 aa, Artificial Sequence
  Description of Artificial Sequence: Synthetic peptide
AASSNNK

SEQ ID NO: 6338 - protein, 7 aa, Artificial Sequence
  Description of Artificial Sequence: Synthetic peptide
AESREKG

SEQ ID NO: 6339 - protein, 7 aa, Artificial Sequence
  Description of Artificial Sequence: Synthetic peptide
GIAENHK

SEQ ID NO: 6340 - protein, 7 aa, Artificial Sequence
  Description of Artificial Sequence: Synthetic peptide
GGKSSVS

SEQ ID NO: 6341 - protein, 7 aa, Artificial Sequence
  Description of Artificial Sequence: Synthetic peptide
GVNGVSN

SEQ ID NO: 6342 - protein, 7 aa, Artificial Sequence
  Description of Artificial Sequence: Synthetic peptide
GNSTSNG

SEQ ID NO: 6343 - protein, 7 aa, Artificial Sequence
  Description of Artificial Sequence: Synthetic peptide
GSGGGIA

SEQ ID NO: 6344 - protein, 7 aa, Artificial Sequence
  Description of Artificial Sequence: Synthetic peptide
GKNSDVH

SEQ ID NO: 6345 - protein, 7 aa, Artificial Sequence
  Description of Artificial Sequence: Synthetic peptide
GSADSSK

SEQ ID NO: 6346 - protein, 7 aa, Artificial Sequence
  Description of Artificial Sequence: Synthetic peptide
VNSTGVH

SEQ ID NO: 6347 - protein, 7 aa, Artificial Sequence
  Description of Artificial Sequence: Synthetic peptide
VATSGPK

SEQ ID NO: 6348 - protein, 7 aa, Artificial Sequence
  Description of Artificial Sequence: Synthetic peptide
VSNGTSG

SEQ ID NO: 6349 - protein, 7 aa, Artificial Sequence
  Description of Artificial Sequence: Synthetic peptide
VGNSSLR

SEQ ID NO: 6350 - protein, 7 aa, Artificial Sequence
  Description of Artificial Sequence: Synthetic peptide
SQERSLA

SEQ ID NO: 6351 - protein, 7 aa, Artificial Sequence
  Description of Artificial Sequence: Synthetic peptide
SVSGERS

SEQ ID NO: 6352 - protein, 7 aa, Artificial Sequence
  Description of Artificial Sequence: Synthetic peptide
SNSSSAS

SEQ ID NO: 6353 - protein, 7 aa, Artificial Sequence
  Description of Artificial Sequence: Synthetic peptide
LPTGSKS

SEQ ID NO: 6354 - protein, 7 aa, Artificial Sequence
  Description of Artificial Sequence: Synthetic peptide
SNGKSPQ

SEQ ID NO: 6355 - protein, 7 aa, Artificial Sequence
  Description of Artificial Sequence: Synthetic peptide
AGEGSSR

SEQ ID NO: 6356 - protein, 7 aa, Artificial Sequence
  Description of Artificial Sequence: Synthetic peptide
KDAGTSS

SEQ ID NO: 6357 - protein, 7 aa, Artificial Sequence
  Description of Artificial Sequence: Synthetic peptide
SGDQKGA

SEQ ID NO: 6358 - protein, 7 aa, Artificial Sequence
  Description of Artificial Sequence: Synthetic peptide
MSGNTGN

SEQ ID NO: 6359 - protein, 7 aa, Artificial Sequence
  Description of Artificial Sequence: Synthetic peptide
LQEKPSA

SEQ ID NO: 6360 - protein, 7 aa, Artificial Sequence
  Description of Artificial Sequence: Synthetic peptide
AQNNNAG

SEQ ID NO: 6361 - protein, 7 aa, Artificial Sequence
  Description of Artificial Sequence: Synthetic peptide
GTGERHL

SEQ ID NO: 6362 - protein, 7 aa, Artificial Sequence
  Description of Artificial Sequence: Synthetic peptide
GSQSSTR

SEQ ID NO: 6363 - protein, 7 aa, Artificial Sequence
  Description of Artificial Sequence: Synthetic peptide
GLNTASG

SEQ ID NO: 6364 - protein, 7 aa, Artificial Sequence
  Description of Artificial Sequence: Synthetic peptide
SRESANH

SEQ ID NO: 6365 - protein, 7 aa, Artificial Sequence
  Description of Artificial Sequence: Synthetic peptide
RTTANSG

SEQ ID NO: 6366 - protein, 7 aa, Artificial Sequence
  Description of Artificial Sequence: Synthetic peptide
VTDKPNM

SEQ ID NO: 6367 - protein, 7 aa, Artificial Sequence
  Description of Artificial Sequence: Synthetic peptide
SLTNSNS

SEQ ID NO: 6368 - protein, 7 aa, Artificial Sequence
  Description of Artificial Sequence: Synthetic peptide
TGAGHTS

SEQ ID NO: 6369 - protein, 7 aa, Artificial Sequence
  Description of Artificial Sequence: Synthetic peptide
TLASTNA

SEQ ID NO: 6370 - protein, 7 aa, Artificial Sequence
  Description of Artificial Sequence: Synthetic peptide
GDVNVKQ

SEQ ID NO: 6371 - protein, 7 aa, Artificial Sequence
  Description of Artificial Sequence: Synthetic peptide
ASHDKSS

SEQ ID NO: 6372 - protein, 7 aa, Artificial Sequence
  Description of Artificial Sequence: Synthetic peptide
VGSSKDG

SEQ ID NO: 6373 - protein, 7 aa, Artificial Sequence
  Description of Artificial Sequence: Synthetic peptide
HDGSKSM

SEQ ID NO: 6374 - protein, 7 aa, Artificial Sequence
  Description of Artificial Sequence: Synthetic peptide
DSTHGNT

SEQ ID NO: 6375 - protein, 7 aa, Artificial Sequence
  Description of Artificial Sequence: Synthetic peptide
GLKQAPT

SEQ ID NO: 6376 - protein, 7 aa, Artificial Sequence
  Description of Artificial Sequence: Synthetic peptide
GDSKKPP

SEQ ID NO: 6377 - protein, 7 aa, Artificial Sequence
  Description of Artificial Sequence: Synthetic peptide
TPGGSAP

SEQ ID NO: 6378 - protein, 7 aa, Artificial Sequence
  Description of Artificial Sequence: Synthetic peptide
RGGSDSA

SEQ ID NO: 6379 - protein, 7 aa, Artificial Sequence
  Description of Artificial Sequence: Synthetic peptide
GTSGGGT

SEQ ID NO: 6380 - protein, 7 aa, Artificial Sequence
  Description of Artificial Sequence: Synthetic peptide
SVGTPSA

SEQ ID NO: 6381 - protein, 7 aa, Artificial Sequence
  Description of Artificial Sequence: Synthetic peptide
ETGASSL

SEQ ID NO: 6382 - protein, 7 aa, Artificial Sequence
  Description of Artificial Sequence: Synthetic peptide
TGPTEKS

SEQ ID NO: 6383 - protein, 7 aa, Artificial Sequence
  Description of Artificial Sequence: Synthetic peptide
SPKPGSI

SEQ ID NO: 6384 - protein, 7 aa, Artificial Sequence
  Description of Artificial Sequence: Synthetic peptide
SDSTRSQ

SEQ ID NO: 6385 - protein, 7 aa, Artificial Sequence
  Description of Artificial Sequence: Synthetic peptide
TGNSSAP

SEQ ID NO: 6386 - protein, 7 aa, Artificial Sequence
  Description of Artificial Sequence: Synthetic peptide
DARERNQ

SEQ ID NO: 6387 - protein, 7 aa, Artificial Sequence
  Description of Artificial Sequence: Synthetic peptide
TNTTSAT

SEQ ID NO: 6388 - protein, 7 aa, Artificial Sequence
  Description of Artificial Sequence: Synthetic peptide
LGTSSSV

SEQ ID NO: 6389 - protein, 7 aa, Artificial Sequence
  Description of Artificial Sequence: Synthetic peptide
QGQNHPN

SEQ ID NO: 6390 - protein, 7 aa, Artificial Sequence
  Description of Artificial Sequence: Synthetic peptide
GGTGTLG

SEQ ID NO: 6391 - protein, 7 aa, Artificial Sequence
  Description of Artificial Sequence: Synthetic peptide
LGTGTST

SEQ ID NO: 6392 - protein, 7 aa, Artificial Sequence
  Description of Artificial Sequence: Synthetic peptide
EGSQPLQ

SEQ ID NO: 6393 - protein, 7 aa, Artificial Sequence
  Description of Artificial Sequence: Synthetic peptide
ESGMQNS

SEQ ID NO: 6394 - protein, 7 aa, Artificial Sequence
  Description of Artificial Sequence: Synthetic peptide
GVDHAKT

SEQ ID NO: 6395 - protein, 7 aa, Artificial Sequence
  Description of Artificial Sequence: Synthetic peptide
SPITNGH

SEQ ID NO: 6396 - protein, 7 aa, Artificial Sequence
  Description of Artificial Sequence: Synthetic peptide
MSGSAKD

SEQ ID NO: 6397 - protein, 7 aa, Artificial Sequence
  Description of Artificial Sequence: Synthetic peptide
QSGEAPR

SEQ ID NO: 6398 - protein, 7 aa, Artificial Sequence
  Description of Artificial Sequence: Synthetic peptide
GETSRTS

SEQ ID NO: 6399 - protein, 7 aa, Artificial Sequence
  Description of Artificial Sequence: Synthetic peptide
GDSRPLN

SEQ ID NO: 6400 - protein, 7 aa, Artificial Sequence
  Description of Artificial Sequence: Synthetic peptide
NNGSQLK

SEQ ID NO: 6401 - protein, 7 aa, Artificial Sequence
  Description of Artificial Sequence: Synthetic peptide
STANASS

SEQ ID NO: 6402 - protein, 7 aa, Artificial Sequence
  Description of Artificial Sequence: Synthetic peptide
GPNSNKS

SEQ ID NO: 6403 - protein, 7 aa, Artificial Sequence
  Description of Artificial Sequence: Synthetic peptide
SGDNLRG

SEQ ID NO: 6404 - protein, 7 aa, Artificial Sequence
  Description of Artificial Sequence: Synthetic peptide
GGSKPNL

SEQ ID NO: 6405 - protein, 7 aa, Artificial Sequence
  Description of Artificial Sequence: Synthetic peptide
GSSGSHS

SEQ ID NO: 6406 - protein, 7 aa, Artificial Sequence
  Description of Artificial Sequence: Synthetic peptide
SGMNGQN

SEQ ID NO: 6407 - protein, 7 aa, Artificial Sequence
  Description of Artificial Sequence: Synthetic peptide
QTNSGST

SEQ ID NO: 6408 - protein, 7 aa, Artificial Sequence
  Description of Artificial Sequence: Synthetic peptide
ASGSHSS

SEQ ID NO: 6409 - protein, 7 aa, Artificial Sequence
  Description of Artificial Sequence: Synthetic peptide
ALSEKTL

SEQ ID NO: 6410 - protein, 7 aa, Artificial Sequence
  Description of Artificial Sequence: Synthetic peptide
ESSKPSL

SEQ ID NO: 6411 - protein, 7 aa, Artificial Sequence
  Description of Artificial Sequence: Synthetic peptide
GGGTTQA

SEQ ID NO: 6412 - protein, 7 aa, Artificial Sequence
  Description of Artificial Sequence: Synthetic peptide
SKANTPN

SEQ ID NO: 6413 - protein, 7 aa, Artificial Sequence
  Description of Artificial Sequence: Synthetic peptide
STQPSSG

SEQ ID NO: 6414 - protein, 7 aa, Artificial Sequence
  Description of Artificial Sequence: Synthetic peptide
VADQKQG

SEQ ID NO: 6415 - protein, 7 aa, Artificial Sequence
  Description of Artificial Sequence: Synthetic peptide
HGSNGSS

SEQ ID NO: 6416 - protein, 7 aa, Artificial Sequence
  Description of Artificial Sequence: Synthetic peptide
DTGKSPV

SEQ ID NO: 6417 - protein, 7 aa, Artificial Sequence
  Description of Artificial Sequence: Synthetic peptide
NMTSAKD

SEQ ID NO: 6418 - protein, 7 aa, Artificial Sequence
  Description of Artificial Sequence: Synthetic peptide
STTGEAK

SEQ ID NO: 6419 - protein, 7 aa, Artificial Sequence
  Description of Artificial Sequence: Synthetic peptide
ENSTSHS

SEQ ID NO: 6420 - protein, 7 aa, Artificial Sequence
  Description of Artificial Sequence: Synthetic peptide
VSNSPTK

SEQ ID NO: 6421 - protein, 7 aa, Artificial Sequence
  Description of Artificial Sequence: Synthetic peptide
NAGASTL

SEQ ID NO: 6422 - protein, 7 aa, Artificial Sequence
  Description of Artificial Sequence: Synthetic peptide
SSATNNT

SEQ ID NO: 6423 - protein, 7 aa, Artificial Sequence
  Description of Artificial Sequence: Synthetic peptide
TTGVGGT

SEQ ID NO: 6424 - protein, 7 aa, Artificial Sequence
  Description of Artificial Sequence: Synthetic peptide
ANTTGLS

SEQ ID NO: 6425 - protein, 7 aa, Artificial Sequence
  Description of Artificial Sequence: Synthetic peptide
SNGTAKS

SEQ ID NO: 6426 - protein, 7 aa, Artificial Sequence
  Description of Artificial Sequence: Synthetic peptide
AHKDKDG

SEQ ID NO: 6427 - protein, 7 aa, Artificial Sequence
  Description of Artificial Sequence: Synthetic peptide
SSGTSTA

SEQ ID NO: 6428 - protein, 7 aa, Artificial Sequence
  Description of Artificial Sequence: Synthetic peptide
TNENSNR

SEQ ID NO: 6429 - protein, 7 aa, Artificial Sequence
  Description of Artificial Sequence: Synthetic peptide
QIAKDSS

SEQ ID NO: 6430 - protein, 7 aa, Artificial Sequence
  Description of Artificial Sequence: Synthetic peptide
LSTSQVS

SEQ ID NO: 6431 - protein, 7 aa, Artificial Sequence
  Description of Artificial Sequence: Synthetic peptide
QSEAKGA

SEQ ID NO: 6432 - protein, 7 aa, Artificial Sequence
  Description of Artificial Sequence: Synthetic peptide
VGVKASQ

SEQ ID NO: 6433 - protein, 7 aa, Artificial Sequence
  Description of Artificial Sequence: Synthetic peptide
DPSKASV

SEQ ID NO: 6434 - protein, 7 aa, Artificial Sequence
  Description of Artificial Sequence: Synthetic peptide
NPSSGDK

SEQ ID NO: 6435 - protein, 7 aa, Artificial Sequence
  Description of Artificial Sequence: Synthetic peptide
MGSTANG

SEQ ID NO: 6436 - protein, 7 aa, Artificial Sequence
  Description of Artificial Sequence: Synthetic peptide
GASGDNH

SEQ ID NO: 6437 - protein, 7 aa, Artificial Sequence
  Description of Artificial Sequence: Synthetic peptide
WRESETK

SEQ ID NO: 6438 - protein, 7 aa, Artificial Sequence
  Description of Artificial Sequence: Synthetic peptide
NTGAPAS

SEQ ID NO: 6439 - protein, 7 aa, Artificial Sequence
  Description of Artificial Sequence: Synthetic peptide
DANSGKM

SEQ ID NO: 6440 - protein, 7 aa, Artificial Sequence
  Description of Artificial Sequence: Synthetic peptide
ASKSGAA

SEQ ID NO: 6441 - protein, 7 aa, Artificial Sequence
  Description of Artificial Sequence: Synthetic peptide
GLGSSTS

SEQ ID NO: 6442 - protein, 7 aa, Artificial Sequence
  Description of Artificial Sequence: Synthetic peptide
DSSKSAY

SEQ ID NO: 6443 - protein, 7 aa, Artificial Sequence
  Description of Artificial Sequence: Synthetic peptide
SGKQSPA

SEQ ID NO: 6444 - protein, 7 aa, Artificial Sequence
  Description of Artificial Sequence: Synthetic peptide
TVTNTSG

SEQ ID NO: 6445 - protein, 7 aa, Artificial Sequence
  Description of Artificial Sequence: Synthetic peptide
IAGPGTQ

SEQ ID NO: 6446 - protein, 7 aa, Artificial Sequence
  Description of Artificial Sequence: Synthetic peptide
GLDKAGK

SEQ ID NO: 6447 - protein, 7 aa, Artificial Sequence
  Description of Artificial Sequence: Synthetic peptide
VDGKTSN

SEQ ID NO: 6448 - protein, 7 aa, Artificial Sequence
  Description of Artificial Sequence: Synthetic peptide
TAGGSHL

SEQ ID NO: 6449 - protein, 7 aa, Artificial Sequence
  Description of Artificial Sequence: Synthetic peptide
ASQSPSL

SEQ ID NO: 6450 - protein, 7 aa, Artificial Sequence
  Description of Artificial Sequence: Synthetic peptide
SVGSSSN

SEQ ID NO: 6451 - protein, 7 aa, Artificial Sequence
  Description of Artificial Sequence: Synthetic peptide
NTAAPTA

SEQ ID NO: 6452 - protein, 7 aa, Artificial Sequence
  Description of Artificial Sequence: Synthetic peptide
NTHTKST

SEQ ID NO: 6453 - protein, 7 aa, Artificial Sequence
  Description of Artificial Sequence: Synthetic peptide
GNSQPNA

SEQ ID NO: 6454 - protein, 7 aa, Artificial Sequence
  Description of Artificial Sequence: Synthetic peptide
SLSDKQG

SEQ ID NO: 6455 - protein, 7 aa, Artificial Sequence
  Description of Artificial Sequence: Synthetic peptide
TTGSSMM

SEQ ID NO: 6456 - protein, 7 aa, Artificial Sequence
  Description of Artificial Sequence: Synthetic peptide
TTVSSPH

SEQ ID NO: 6457 - protein, 7 aa, Artificial Sequence
  Description of Artificial Sequence: Synthetic peptide
SQTGQNQ

SEQ ID NO: 6458 - protein, 7 aa, Artificial Sequence
  Description of Artificial Sequence: Synthetic peptide
MGSSKVG

SEQ ID NO: 6459 - protein, 7 aa, Artificial Sequence
  Description of Artificial Sequence: Synthetic peptide
VGAPTNR

SEQ ID NO: 6460 - protein, 7 aa, Artificial Sequence
  Description of Artificial Sequence: Synthetic peptide
SGMPAGT

SEQ ID NO: 6461 - protein, 7 aa, Artificial Sequence
  Description of Artificial Sequence: Synthetic peptide
GSTKEAN

SEQ ID NO: 6462 - protein, 7 aa, Artificial Sequence
  Description of Artificial Sequence: Synthetic peptide
QTNATLG

SEQ ID NO: 6463 - protein, 7 aa, Artificial Sequence
  Description of Artificial Sequence: Synthetic peptide
DSGGSPR

SEQ ID NO: 6464 - protein, 7 aa, Artificial Sequence
  Description of Artificial Sequence: Synthetic peptide
GSVKPGL

SEQ ID NO: 6465 - protein, 7 aa, Artificial Sequence
  Description of Artificial Sequence: Synthetic peptide
GSSSKST

SEQ ID NO: 6466 - protein, 7 aa, Artificial Sequence
  Description of Artificial Sequence: Synthetic peptide
VKSQANN

SEQ ID NO: 6467 - protein, 7 aa, Artificial Sequence
  Description of Artificial Sequence: Synthetic peptide
SQTTQSG

SEQ ID NO: 6468 - protein, 7 aa, Artificial Sequence
  Description of Artificial Sequence: Synthetic peptide
GTPSSST

SEQ ID NO: 6469 - protein, 7 aa, Artificial Sequence
  Description of Artificial Sequence: Synthetic peptide
RSSDKSG

SEQ ID NO: 6470 - protein, 7 aa, Artificial Sequence
  Description of Artificial Sequence: Synthetic peptide
NSSRSNE

SEQ ID NO: 6471 - protein, 7 aa, Artificial Sequence
  Description of Artificial Sequence: Synthetic peptide
TGPTPQV

SEQ ID NO: 6472 - protein, 7 aa, Artificial Sequence
  Description of Artificial Sequence: Synthetic peptide
TTGTTPS

SEQ ID NO: 6473 - protein, 7 aa, Artificial Sequence
  Description of Artificial Sequence: Synthetic peptide
SDGSAAA

SEQ ID NO: 6474 - protein, 7 aa, Artificial Sequence
  Description of Artificial Sequence: Synthetic peptide
IGTTSQS

SEQ ID NO: 6475 - protein, 7 aa, Artificial Sequence
  Description of Artificial Sequence: Synthetic peptide
STGAPNA

SEQ ID NO: 6476 - protein, 7 aa, Artificial Sequence
  Description of Artificial Sequence: Synthetic peptide
ESKKPAL

SEQ ID NO: 6477 - protein, 7 aa, Artificial Sequence
  Description of Artificial Sequence: Synthetic peptide
GHQTTPT

SEQ ID NO: 6478 - protein, 7 aa, Artificial Sequence
  Description of Artificial Sequence: Synthetic peptide
GNLAKAE

SEQ ID NO: 6479 - protein, 7 aa, Artificial Sequence
  Description of Artificial Sequence: Synthetic peptide
EPTSRNA

SEQ ID NO: 6480 - protein, 7 aa, Artificial Sequence
  Description of Artificial Sequence: Synthetic peptide
SATNAAT

SEQ ID NO: 6481 - protein, 7 aa, Artificial Sequence
  Description of Artificial Sequence: Synthetic peptide
GNSQSMT

SEQ ID NO: 6482 - protein, 7 aa, Artificial Sequence
  Description of Artificial Sequence: Synthetic peptide
VGGSGPQ

SEQ ID NO: 6483 - protein, 7 aa, Artificial Sequence
  Description of Artificial Sequence: Synthetic peptide
TPTKPNT

SEQ ID NO: 6484 - protein, 7 aa, Artificial Sequence
  Description of Artificial Sequence: Synthetic peptide
GTARNNG

SEQ ID NO: 6485 - protein, 7 aa, Artificial Sequence
  Description of Artificial Sequence: Synthetic peptide
NVSTNNG

SEQ ID NO: 6486 - protein, 7 aa, Artificial Sequence
  Description of Artificial Sequence: Synthetic peptide
NTTSGLA

SEQ ID NO: 6487 - protein, 7 aa, Artificial Sequence
  Description of Artificial Sequence: Synthetic peptide
NQAAQGV

SEQ ID NO: 6488 - protein, 7 aa, Artificial Sequence
  Description of Artificial Sequence: Synthetic peptide
TNASPSS

SEQ ID NO: 6489 - protein, 7 aa, Artificial Sequence
  Description of Artificial Sequence: Synthetic peptide
TGKDQSS

SEQ ID NO: 6490 - protein, 7 aa, Artificial Sequence
  Description of Artificial Sequence: Synthetic peptide
TSSPTGV

SEQ ID NO: 6491 - protein, 7 aa, Artificial Sequence
  Description of Artificial Sequence: Synthetic peptide
SGGKPSN

SEQ ID NO: 6492 - protein, 7 aa, Artificial Sequence
  Description of Artificial Sequence: Synthetic peptide
ESSSRSI

SEQ ID NO: 6493 - protein, 7 aa, Artificial Sequence
  Description of Artificial Sequence: Synthetic peptide
ASDKPAL

SEQ ID NO: 6494 - protein, 7 aa, Artificial Sequence
  Description of Artificial Sequence: Synthetic peptide
VKTQATI

SEQ ID NO: 6495 - protein, 7 aa, Artificial Sequence
  Description of Artificial Sequence: Synthetic peptide
THSPNGN

SEQ ID NO: 6496 - protein, 7 aa, Artificial Sequence
  Description of Artificial Sequence: Synthetic peptide
QTSQAPV

SEQ ID NO: 6497 - protein, 7 aa, Artificial Sequence
  Description of Artificial Sequence: Synthetic peptide
TDGTKVN

SEQ ID NO: 6498 - protein, 7 aa, Artificial Sequence
  Description of Artificial Sequence: Synthetic peptide
IMESKSM

SEQ ID NO: 6499 - protein, 7 aa, Artificial Sequence
  Description of Artificial Sequence: Synthetic peptide
SSERSSN

SEQ ID NO: 6500 - protein, 7 aa, Artificial Sequence
  Description of Artificial Sequence: Synthetic peptide
QTKSNPS

SEQ ID NO: 6501 - protein, 7 aa, Artificial Sequence
  Description of Artificial Sequence: Synthetic peptide
DGVDKRG

SEQ ID NO: 6502 - protein, 7 aa, Artificial Sequence
  Description of Artificial Sequence: Synthetic peptide
GAAVKST

SEQ ID NO: 6503 - protein, 7 aa, Artificial Sequence
  Description of Artificial Sequence: Synthetic peptide
GDGNSHV

SEQ ID NO: 6504 - protein, 7 aa, Artificial Sequence
  Description of Artificial Sequence: Synthetic peptide
SGSEQIK

SEQ ID NO: 6505 - protein, 7 aa, Artificial Sequence
  Description of Artificial Sequence: Synthetic peptide
NTTPASA

SEQ ID NO: 6506 - protein, 7 aa, Artificial Sequence
  Description of Artificial Sequence: Synthetic peptide
DNTGSTN

SEQ ID NO: 6507 - protein, 7 aa, Artificial Sequence
  Description of Artificial Sequence: Synthetic peptide
DGPSPAR

SEQ ID NO: 6508 - protein, 7 aa, Artificial Sequence
  Description of Artificial Sequence: Synthetic peptide
GGTATPL

SEQ ID NO: 6509 - protein, 7 aa, Artificial Sequence
  Description of Artificial Sequence: Synthetic peptide
TSGDRIS

SEQ ID NO: 6510 - protein, 7 aa, Artificial Sequence
  Description of Artificial Sequence: Synthetic peptide
GPSEGQR

SEQ ID NO: 6511 - protein, 7 aa, Artificial Sequence
  Description of Artificial Sequence: Synthetic peptide
TTDHKSV

SEQ ID NO: 6512 - protein, 7 aa, Artificial Sequence
  Description of Artificial Sequence: Synthetic peptide
NGEKIGN

SEQ ID NO: 6513 - protein, 7 aa, Artificial Sequence
  Description of Artificial Sequence: Synthetic peptide
SKSVQPS

SEQ ID NO: 6514 - protein, 7 aa, Artificial Sequence
  Description of Artificial Sequence: Synthetic peptide
RADQNRG

SEQ ID NO: 6515 - protein, 7 aa, Artificial Sequence
  Description of Artificial Sequence: Synthetic peptide
NQHKPSA

SEQ ID NO: 6516 - protein, 7 aa, Artificial Sequence
  Description of Artificial Sequence: Synthetic peptide
SKATSAA

SEQ ID NO: 6517 - protein, 7 aa, Artificial Sequence
  Description of Artificial Sequence: Synthetic peptide
SVSSAKD

SEQ ID NO: 6518 - protein, 7 aa, Artificial Sequence
  Description of Artificial Sequence: Synthetic peptide
STGISNV

SEQ ID NO: 6519 - protein, 7 aa, Artificial Sequence
  Description of Artificial Sequence: Synthetic peptide
DPPDNKV

SEQ ID NO: 6520 - protein, 7 aa, Artificial Sequence
  Description of Artificial Sequence: Synthetic peptide
NSASAQS

SEQ ID NO: 6521 - protein, 7 aa, Artificial Sequence
  Description of Artificial Sequence: Synthetic peptide
NPSGRNE

SEQ ID NO: 6522 - protein, 7 aa, Artificial Sequence
  Description of Artificial Sequence: Synthetic peptide
TAGDSRA

SEQ ID NO: 6523 - protein, 7 aa, Artificial Sequence
  Description of Artificial Sequence: Synthetic peptide
RVSADRG

SEQ ID NO: 6524 - protein, 7 aa, Artificial Sequence
  Description of Artificial Sequence: Synthetic peptide
SRDKEVA

SEQ ID NO: 6525 - protein, 7 aa, Artificial Sequence
  Description of Artificial Sequence: Synthetic peptide
NTPNQST

SEQ ID NO: 6526 - protein, 7 aa, Artificial Sequence
  Description of Artificial Sequence: Synthetic peptide
SNGGSNS

SEQ ID NO: 6527 - protein, 7 aa, Artificial Sequence
  Description of Artificial Sequence: Synthetic peptide
QTNHTNS

SEQ ID NO: 6528 - protein, 7 aa, Artificial Sequence
  Description of Artificial Sequence: Synthetic peptide
GAAANLA

SEQ ID NO: 6529 - protein, 7 aa, Artificial Sequence
  Description of Artificial Sequence: Synthetic peptide
TGSSSAT

SEQ ID NO: 6530 - protein, 7 aa, Artificial Sequence
  Description of Artificial Sequence: Synthetic peptide
NGHSGIS

SEQ ID NO: 6531 - protein, 7 aa, Artificial Sequence
  Description of Artificial Sequence: Synthetic peptide
TTTAGLT

SEQ ID NO: 6532 - protein, 7 aa, Artificial Sequence
  Description of Artificial Sequence: Synthetic peptide
SSGTVGK

SEQ ID NO: 6533 - protein, 7 aa, Artificial Sequence
  Description of Artificial Sequence: Synthetic peptide
SVGHDHR

SEQ ID NO: 6534 - protein, 7 aa, Artificial Sequence
  Description of Artificial Sequence: Synthetic peptide
SGKSEQT

SEQ ID NO: 6535 - protein, 7 aa, Artificial Sequence
  Description of Artificial Sequence: Synthetic peptide
GGNSAAT

SEQ ID NO: 6536 - protein, 7 aa, Artificial Sequence
  Description of Artificial Sequence: Synthetic peptide
LGSGARE

SEQ ID NO: 6537 - protein, 7 aa, Artificial Sequence
  Description of Artificial Sequence: Synthetic peptide
LVPEAKG

SEQ ID NO: 6538 - protein, 7 aa, Artificial Sequence
  Description of Artificial Sequence: Synthetic peptide
IQSPSSG

SEQ ID NO: 6539 - protein, 7 aa, Artificial Sequence
  Description of Artificial Sequence: Synthetic peptide
NLGSDSK

SEQ ID NO: 6540 - protein, 7 aa, Artificial Sequence
  Description of Artificial Sequence: Synthetic peptide
EPAPGTK

SEQ ID NO: 6541 - protein, 7 aa, Artificial Sequence
  Description of Artificial Sequence: Synthetic peptide
SPTAGGG

SEQ ID NO: 6542 - protein, 7 aa, Artificial Sequence
  Description of Artificial Sequence: Synthetic peptide
LASKVGQ

SEQ ID NO: 6543 - protein, 7 aa, Artificial Sequence
  Description of Artificial Sequence: Synthetic peptide
ESLGGNK

SEQ ID NO: 6544 - protein, 7 aa, Artificial Sequence
  Description of Artificial Sequence: Synthetic peptide
VTGASMN

SEQ ID NO: 6545 - protein, 7 aa, Artificial Sequence
  Description of Artificial Sequence: Synthetic peptide
TSSQATV

SEQ ID NO: 6546 - protein, 7 aa, Artificial Sequence
  Description of Artificial Sequence: Synthetic peptide
HHADKGS

SEQ ID NO: 6547 - protein, 7 aa, Artificial Sequence
  Description of Artificial Sequence: Synthetic peptide
RPDSKST

SEQ ID NO: 6548 - protein, 7 aa, Artificial Sequence
  Description of Artificial Sequence: Synthetic peptide
GVPESKQ

SEQ ID NO: 6549 - protein, 7 aa, Artificial Sequence
  Description of Artificial Sequence: Synthetic peptide
DSSSRAS

SEQ ID NO: 6550 - protein, 7 aa, Artificial Sequence
  Description of Artificial Sequence: Synthetic peptide
SKSPSQA

SEQ ID NO: 6551 - protein, 7 aa, Artificial Sequence
  Description of Artificial Sequence: Synthetic peptide
DPGKLTH

SEQ ID NO: 6552 - protein, 7 aa, Artificial Sequence
  Description of Artificial Sequence: Synthetic peptide
SLDNQRQ

SEQ ID NO: 6553 - protein, 7 aa, Artificial Sequence
  Description of Artificial Sequence: Synthetic peptide
GASNGSA

SEQ ID NO: 6554 - protein, 7 aa, Artificial Sequence
  Description of Artificial Sequence: Synthetic peptide
HRNSTSS

SEQ ID NO: 6555 - protein, 7 aa, Artificial Sequence
  Description of Artificial Sequence: Synthetic peptide
HTSTKDS

SEQ ID NO: 6556 - protein, 7 aa, Artificial Sequence
  Description of Artificial Sequence: Synthetic peptide
VQHGSST

SEQ ID NO: 6557 - protein, 7 aa, Artificial Sequence
  Description of Artificial Sequence: Synthetic peptide
DGAGANV

SEQ ID NO: 6558 - protein, 7 aa, Artificial Sequence
  Description of Artificial Sequence: Synthetic peptide
GGPPSNT

SEQ ID NO: 6559 - protein, 7 aa, Artificial Sequence
  Description of Artificial Sequence: Synthetic peptide
ASNSGAV

SEQ ID NO: 6560 - protein, 7 aa, Artificial Sequence
  Description of Artificial Sequence: Synthetic peptide
NRDSSLH

SEQ ID NO: 6561 - protein, 7 aa, Artificial Sequence
  Description of Artificial Sequence: Synthetic peptide
NDTRTTS

SEQ ID NO: 6562 - protein, 7 aa, Artificial Sequence
  Description of Artificial Sequence: Synthetic peptide
TGSATMV

SEQ ID NO: 6563 - protein, 7 aa, Artificial Sequence
  Description of Artificial Sequence: Synthetic peptide
TGMTSTS

SEQ ID NO: 6564 - protein, 7 aa, Artificial Sequence
  Description of Artificial Sequence: Synthetic peptide
RQAGQLA

SEQ ID NO: 6565 - protein, 7 aa, Artificial Sequence
  Description of Artificial Sequence: Synthetic peptide
QTVSSSG

SEQ ID NO: 6566 - protein, 7 aa, Artificial Sequence
  Description of Artificial Sequence: Synthetic peptide
GTTPGKN

SEQ ID NO: 6567 - protein, 7 aa, Artificial Sequence
  Description of Artificial Sequence: Synthetic peptide
SSTATGL

SEQ ID NO: 6568 - protein, 7 aa, Artificial Sequence
  Description of Artificial Sequence: Synthetic peptide
RNASSSQ

SEQ ID NO: 6569 - protein, 7 aa, Artificial Sequence
  Description of Artificial Sequence: Synthetic peptide
HVGKSST

SEQ ID NO: 6570 - protein, 7 aa, Artificial Sequence
  Description of Artificial Sequence: Synthetic peptide
SSERAGH

SEQ ID NO: 6571 - protein, 7 aa, Artificial Sequence
  Description of Artificial Sequence: Synthetic peptide
DRTGAKN

SEQ ID NO: 6572 - protein, 7 aa, Artificial Sequence
  Description of Artificial Sequence: Synthetic peptide
DHSHKNA

SEQ ID NO: 6573 - protein, 7 aa, Artificial Sequence
  Description of Artificial Sequence: Synthetic peptide
HVERSHG

SEQ ID NO: 6574 - protein, 7 aa, Artificial Sequence
  Description of Artificial Sequence: Synthetic peptide
SNPGRDG

SEQ ID NO: 6575 - protein, 7 aa, Artificial Sequence
  Description of Artificial Sequence: Synthetic peptide
GDSGRQA

SEQ ID NO: 6576 - protein, 7 aa, Artificial Sequence
  Description of Artificial Sequence: Synthetic peptide
MQDSRAQ

SEQ ID NO: 6577 - protein, 7 aa, Artificial Sequence
  Description of Artificial Sequence: Synthetic peptide
LGGPSNS

SEQ ID NO: 6578 - protein, 7 aa, Artificial Sequence
  Description of Artificial Sequence: Synthetic peptide
DSKAAPQ

SEQ ID NO: 6579 - protein, 7 aa, Artificial Sequence
  Description of Artificial Sequence: Synthetic peptide
VDAKERS

SEQ ID NO: 6580 - protein, 7 aa, Artificial Sequence
  Description of Artificial Sequence: Synthetic peptide
TTSSASA

SEQ ID NO: 6581 - protein, 7 aa, Artificial Sequence
  Description of Artificial Sequence: Synthetic peptide
SSDRDSK

SEQ ID NO: 6582 - protein, 7 aa, Artificial Sequence
  Description of Artificial Sequence: Synthetic peptide
SGTGRSD

SEQ ID NO: 6583 - protein, 7 aa, Artificial Sequence
  Description of Artificial Sequence: Synthetic peptide
GNGASAS

SEQ ID NO: 6584 - protein, 7 aa, Artificial Sequence
  Description of Artificial Sequence: Synthetic peptide
GTHGSSN

SEQ ID NO: 6585 - protein, 7 aa, Artificial Sequence
  Description of Artificial Sequence: Synthetic peptide
NRAEGSG

SEQ ID NO: 6586 - protein, 7 aa, Artificial Sequence
  Description of Artificial Sequence: Synthetic peptide
TGNPASH

SEQ ID NO: 6587 - protein, 7 aa, Artificial Sequence
  Description of Artificial Sequence: Synthetic peptide
SGVNSVG

SEQ ID NO: 6588 - protein, 7 aa, Artificial Sequence
  Description of Artificial Sequence: Synthetic peptide
RNTSSVQ

SEQ ID NO: 6589 - protein, 7 aa, Artificial Sequence
  Description of Artificial Sequence: Synthetic peptide
VKSNGAS

SEQ ID NO: 6590 - protein, 7 aa, Artificial Sequence
  Description of Artificial Sequence: Synthetic peptide
SNNKPTN

SEQ ID NO: 6591 - protein, 7 aa, Artificial Sequence
  Description of Artificial Sequence: Synthetic peptide
TGQDVMR

SEQ ID NO: 6592 - protein, 7 aa, Artificial Sequence
  Description of Artificial Sequence: Synthetic peptide
SVGKPTS

SEQ ID NO: 6593 - protein, 7 aa, Artificial Sequence
  Description of Artificial Sequence: Synthetic peptide
TTGNSVP

SEQ ID NO: 6594 - protein, 7 aa, Artificial Sequence
  Description of Artificial Sequence: Synthetic peptide
QAKQNSI

SEQ ID NO: 6595 - protein, 7 aa, Artificial Sequence
  Description of Artificial Sequence: Synthetic peptide
SREDKIH

SEQ ID NO: 6596 - protein, 7 aa, Artificial Sequence
  Description of Artificial Sequence: Synthetic peptide
GSTQPSS

SEQ ID NO: 6597 - protein, 7 aa, Artificial Sequence
  Description of Artificial Sequence: Synthetic peptide
TRDATVR

SEQ ID NO: 6598 - protein, 7 aa, Artificial Sequence
  Description of Artificial Sequence: Synthetic peptide
HSGTPTG

SEQ ID NO: 6599 - protein, 7 aa, Artificial Sequence
  Description of Artificial Sequence: Synthetic peptide
DKPGGMS

SEQ ID NO: 6600 - protein, 7 aa, Artificial Sequence
  Description of Artificial Sequence: Synthetic peptide
SHTSGSA

SEQ ID NO: 6601 - protein, 7 aa, Artificial Sequence
  Description of Artificial Sequence: Synthetic peptide
IGAGTSS

SEQ ID NO: 6602 - protein, 7 aa, Artificial Sequence
  Description of Artificial Sequence: Synthetic peptide
IGSNTTT

SEQ ID NO: 6603 - protein, 7 aa, Artificial Sequence
  Description of Artificial Sequence: Synthetic peptide
TQDHNRS

SEQ ID NO: 6604 - protein, 7 aa, Artificial Sequence
  Description of Artificial Sequence: Synthetic peptide
NPGAHAS

SEQ ID NO: 6605 - protein, 7 aa, Artificial Sequence
  Description of Artificial Sequence: Synthetic peptide
NAQTHAS

SEQ ID NO: 6606 - protein, 7 aa, Artificial Sequence
  Description of Artificial Sequence: Synthetic peptide
TSTSGLA

SEQ ID NO: 6607 - protein, 7 aa, Artificial Sequence
  Description of Artificial Sequence: Synthetic peptide
DLNSTSK

SEQ ID NO: 6608 - protein, 7 aa, Artificial Sequence
  Description of Artificial Sequence: Synthetic peptide
TNASSPM

SEQ ID NO: 6609 - protein, 7 aa, Artificial Sequence
  Description of Artificial Sequence: Synthetic peptide
NTNQAAG

SEQ ID NO: 6610 - protein, 7 aa, Artificial Sequence
  Description of Artificial Sequence: Synthetic peptide
SQSSPSM

SEQ ID NO: 6611 - protein, 7 aa, Artificial Sequence
  Description of Artificial Sequence: Synthetic peptide
EKGQHNQ

SEQ ID NO: 6612 - protein, 7 aa, Artificial Sequence
  Description of Artificial Sequence: Synthetic peptide
DSKPSTS

SEQ ID NO: 6613 - protein, 7 aa, Artificial Sequence
  Description of Artificial Sequence: Synthetic peptide
DPSSASK

SEQ ID NO: 6614 - protein, 7 aa, Artificial Sequence
  Description of Artificial Sequence: Synthetic peptide
GTEPTRG

SEQ ID NO: 6615 - protein, 7 aa, Artificial Sequence
  Description of Artificial Sequence: Synthetic peptide
GDTTRNN

SEQ ID NO: 6616 - protein, 7 aa, Artificial Sequence
  Description of Artificial Sequence: Synthetic peptide
VGVGSAA

SEQ ID NO: 6617 - protein, 7 aa, Artificial Sequence
  Description of Artificial Sequence: Synthetic peptide
SVTDKGK

SEQ ID NO: 6618 - protein, 7 aa, Artificial Sequence
  Description of Artificial Sequence: Synthetic peptide
SSTMKEG

SEQ ID NO: 6619 - protein, 7 aa, Artificial Sequence
  Description of Artificial Sequence: Synthetic peptide
LDQAKPN

SEQ ID NO: 6620 - protein, 7 aa, Artificial Sequence
  Description of Artificial Sequence: Synthetic peptide
ATANTGG

SEQ ID NO: 6621 - protein, 7 aa, Artificial Sequence
  Description of Artificial Sequence: Synthetic peptide
STGKSLG

SEQ ID NO: 6622 - protein, 7 aa, Artificial Sequence
  Description of Artificial Sequence: Synthetic peptide
HGVSTPT

SEQ ID NO: 6623 - protein, 7 aa, Artificial Sequence
  Description of Artificial Sequence: Synthetic peptide
SKGASPQ

SEQ ID NO: 6624 - protein, 7 aa, Artificial Sequence
  Description of Artificial Sequence: Synthetic peptide
DPTERAR

SEQ ID NO: 6625 - protein, 7 aa, Artificial Sequence
  Description of Artificial Sequence: Synthetic peptide
TPNSSGG

SEQ ID NO: 6626 - protein, 7 aa, Artificial Sequence
  Description of Artificial Sequence: Synthetic peptide
TSNSKVN

SEQ ID NO: 6627 - protein, 7 aa, Artificial Sequence
  Description of Artificial Sequence: Synthetic peptide
SPGASTA

SEQ ID NO: 6628 - protein, 7 aa, Artificial Sequence
  Description of Artificial Sequence: Synthetic peptide
DKAQGVN

SEQ ID NO: 6629 - protein, 7 aa, Artificial Sequence
  Description of Artificial Sequence: Synthetic peptide
SRTKEGM

SEQ ID NO: 6630 - protein, 7 aa, Artificial Sequence
  Description of Artificial Sequence: Synthetic peptide
SPSNGGQ

SEQ ID NO: 6631 - protein, 7 aa, Artificial Sequence
  Description of Artificial Sequence: Synthetic peptide
AVSGASG

SEQ ID NO: 6632 - protein, 7 aa, Artificial Sequence
  Description of Artificial Sequence: Synthetic peptide
GKESDKS

SEQ ID NO: 6633 - protein, 7 aa, Artificial Sequence
  Description of Artificial Sequence: Synthetic peptide
SSNKTSQ

SEQ ID NO: 6634 - protein, 7 aa, Artificial Sequence
  Description of Artificial Sequence: Synthetic peptide
GKQEARV

SEQ ID NO: 6635 - protein, 7 aa, Artificial Sequence
  Description of Artificial Sequence: Synthetic peptide
TGDPKLG

SEQ ID NO: 6636 - protein, 7 aa, Artificial Sequence
  Description of Artificial Sequence: Synthetic peptide
SRVSSDK

SEQ ID NO: 6637 - protein, 7 aa, Artificial Sequence
  Description of Artificial Sequence: Synthetic peptide
SLNTSSA

SEQ ID NO: 6638 - protein, 7 aa, Artificial Sequence
  Description of Artificial Sequence: Synthetic peptide
KTTSGSQ

SEQ ID NO: 6639 - protein, 7 aa, Artificial Sequence
  Description of Artificial Sequence: Synthetic peptide
SNGAPTG

SEQ ID NO: 6640 - protein, 7 aa, Artificial Sequence
  Description of Artificial Sequence: Synthetic peptide
GLDQQRS

SEQ ID NO: 6641 - protein, 7 aa, Artificial Sequence
  Description of Artificial Sequence: Synthetic peptide
SLTSVNK

SEQ ID NO: 6642 - protein, 7 aa, Artificial Sequence
  Description of Artificial Sequence: Synthetic peptide
STATNNN

SEQ ID NO: 6643 - protein, 7 aa, Artificial Sequence
  Description of Artificial Sequence: Synthetic peptide
SGQTATT

SEQ ID NO: 6644 - protein, 7 aa, Artificial Sequence
  Description of Artificial Sequence: Synthetic peptide
SAAQSRE

SEQ ID NO: 6645 - protein, 7 aa, Artificial Sequence
  Description of Artificial Sequence: Synthetic peptide
SSGPPVA

SEQ ID NO: 6646 - protein, 7 aa, Artificial Sequence
  Description of Artificial Sequence: Synthetic peptide
SEGNPSR

SEQ ID NO: 6647 - protein, 7 aa, Artificial Sequence
  Description of Artificial Sequence: Synthetic peptide
SGASGSM

SEQ ID NO: 6648 - protein, 7 aa, Artificial Sequence
  Description of Artificial Sequence: Synthetic peptide
ESAGKAL

SEQ ID NO: 6649 - protein, 7 aa, Artificial Sequence
  Description of Artificial Sequence: Synthetic peptide
AGDGHVK

SEQ ID NO: 6650 - protein, 7 aa, Artificial Sequence
  Description of Artificial Sequence: Synthetic peptide
GSKEGNG

SEQ ID NO: 6651 - protein, 7 aa, Artificial Sequence
  Description of Artificial Sequence: Synthetic peptide
VSESGTT

SEQ ID NO: 6652 - protein, 7 aa, Artificial Sequence
  Description of Artificial Sequence: Synthetic peptide
ASDKVSA

SEQ ID NO: 6653 - protein, 7 aa, Artificial Sequence
  Description of Artificial Sequence: Synthetic peptide
MSGTGGS

SEQ ID NO: 6654 - protein, 7 aa, Artificial Sequence
  Description of Artificial Sequence: Synthetic peptide
NSVPHTS

SEQ ID NO: 6655 - protein, 7 aa, Artificial Sequence
  Description of Artificial Sequence: Synthetic peptide
SISKPGT

SEQ ID NO: 6656 - protein, 7 aa, Artificial Sequence
  Description of Artificial Sequence: Synthetic peptide
DTLNSKN

SEQ ID NO: 6657 - protein, 7 aa, Artificial Sequence
  Description of Artificial Sequence: Synthetic peptide
AAAGPNG

SEQ ID NO: 6658 - protein, 7 aa, Artificial Sequence
  Description of Artificial Sequence: Synthetic peptide
TGSPAPS

SEQ ID NO: 6659 - protein, 7 aa, Artificial Sequence
  Description of Artificial Sequence: Synthetic peptide
TRNPTST

SEQ ID NO: 6660 - protein, 7 aa, Artificial Sequence
  Description of Artificial Sequence: Synthetic peptide
TSGTAAM

SEQ ID NO: 6661 - protein, 7 aa, Artificial Sequence
  Description of Artificial Sequence: Synthetic peptide
STSSSSK

SEQ ID NO: 6662 - protein, 7 aa, Artificial Sequence
  Description of Artificial Sequence: Synthetic peptide
SSGTPRT

SEQ ID NO: 6663 - protein, 7 aa, Artificial Sequence
  Description of Artificial Sequence: Synthetic peptide
EMQTSNK

SEQ ID NO: 6664 - protein, 7 aa, Artificial Sequence
  Description of Artificial Sequence: Synthetic peptide
SAGHASS

SEQ ID NO: 6665 - protein, 7 aa, Artificial Sequence
  Description of Artificial Sequence: Synthetic peptide
QAGVSNV

SEQ ID NO: 6666 - protein, 7 aa, Artificial Sequence
  Description of Artificial Sequence: Synthetic peptide
HGSGQAT

SEQ ID NO: 6667 - protein, 7 aa, Artificial Sequence
  Description of Artificial Sequence: Synthetic peptide
QQSNSGT

SEQ ID NO: 6668 - protein, 7 aa, Artificial Sequence
  Description of Artificial Sequence: Synthetic peptide
GVVSKSV

SEQ ID NO: 6669 - protein, 7 aa, Artificial Sequence
  Description of Artificial Sequence: Synthetic peptide
VPSGSPH

SEQ ID NO: 6670 - protein, 7 aa, Artificial Sequence
  Description of Artificial Sequence: Synthetic peptide
ETVNKGT

SEQ ID NO: 6671 - protein, 7 aa, Artificial Sequence
  Description of Artificial Sequence: Synthetic peptide
TPSGSGQ

SEQ ID NO: 6672 - protein, 7 aa, Artificial Sequence
  Description of Artificial Sequence: Synthetic peptide
SGGDSFK

SEQ ID NO: 6673 - protein, 7 aa, Artificial Sequence
  Description of Artificial Sequence: Synthetic peptide
NGVSKVV

SEQ ID NO: 6674 - protein, 7 aa, Artificial Sequence
  Description of Artificial Sequence: Synthetic peptide
HGDSQRT

SEQ ID NO: 6675 - protein, 7 aa, Artificial Sequence
  Description of Artificial Sequence: Synthetic peptide
SSSKSTL

SEQ ID NO: 6676 - protein, 7 aa, Artificial Sequence
  Description of Artificial Sequence: Synthetic peptide
TRNGSVG

SEQ ID NO: 6677 - protein, 7 aa, Artificial Sequence
  Description of Artificial Sequence: Synthetic peptide
GSAVPAA

SEQ ID NO: 6678 - protein, 7 aa, Artificial Sequence
  Description of Artificial Sequence: Synthetic peptide
SANSKST

SEQ ID NO: 6679 - protein, 7 aa, Artificial Sequence
  Description of Artificial Sequence: Synthetic peptide
EQNAGPK

SEQ ID NO: 6680 - protein, 7 aa, Artificial Sequence
  Description of Artificial Sequence: Synthetic peptide
TSTASTG

SEQ ID NO: 6681 - protein, 7 aa, Artificial Sequence
  Description of Artificial Sequence: Synthetic peptide
TSGSHGA

SEQ ID NO: 6682 - protein, 7 aa, Artificial Sequence
  Description of Artificial Sequence: Synthetic peptide
LAAGKAG

SEQ ID NO: 6683 - protein, 7 aa, Artificial Sequence
  Description of Artificial Sequence: Synthetic peptide
DGSGSVQ

SEQ ID NO: 6684 - protein, 7 aa, Artificial Sequence
  Description of Artificial Sequence: Synthetic peptide
AAKDGKA

SEQ ID NO: 6685 - protein, 7 aa, Artificial Sequence
  Description of Artificial Sequence: Synthetic peptide
AGTSNEK

SEQ ID NO: 6686 - protein, 7 aa, Artificial Sequence
  Description of Artificial Sequence: Synthetic peptide
AGNSGLS

SEQ ID NO: 6687 - protein, 7 aa, Artificial Sequence
  Description of Artificial Sequence: Synthetic peptide
GNAEKPS

SEQ ID NO: 6688 - protein, 7 aa, Artificial Sequence
  Description of Artificial Sequence: Synthetic peptide
GRQGSTN

SEQ ID NO: 6689 - protein, 7 aa, Artificial Sequence
  Description of Artificial Sequence: Synthetic peptide
FTSGTPT

SEQ ID NO: 6690 - protein, 7 aa, Artificial Sequence
  Description of Artificial Sequence: Synthetic peptide
MQPSQKG

SEQ ID NO: 6691 - protein, 7 aa, Artificial Sequence
  Description of Artificial Sequence: Synthetic peptide
SGTKTQN

SEQ ID NO: 6692 - protein, 7 aa, Artificial Sequence
  Description of Artificial Sequence: Synthetic peptide
EVHQGKG

SEQ ID NO: 6693 - protein, 7 aa, Artificial Sequence
  Description of Artificial Sequence: Synthetic peptide
ANASHST

SEQ ID NO: 6694 - protein, 7 aa, Artificial Sequence
  Description of Artificial Sequence: Synthetic peptide
GKSDTRS

SEQ ID NO: 6695 - protein, 7 aa, Artificial Sequence
  Description of Artificial Sequence: Synthetic peptide
LSASSTG

SEQ ID NO: 6696 - protein, 7 aa, Artificial Sequence
  Description of Artificial Sequence: Synthetic peptide
TGSSHLV

SEQ ID NO: 6697 - protein, 7 aa, Artificial Sequence
  Description of Artificial Sequence: Synthetic peptide
SPNGNHQ

SEQ ID NO: 6698 - protein, 7 aa, Artificial Sequence
  Description of Artificial Sequence: Synthetic peptide
EQINSKA

SEQ ID NO: 6699 - protein, 7 aa, Artificial Sequence
  Description of Artificial Sequence: Synthetic peptide
QGTPTNG

SEQ ID NO: 6700 - protein, 7 aa, Artificial Sequence
  Description of Artificial Sequence: Synthetic peptide
QGVSSHN

SEQ ID NO: 6701 - protein, 7 aa, Artificial Sequence
  Description of Artificial Sequence: Synthetic peptide
LSGERAA

SEQ ID NO: 6702 - protein, 7 aa, Artificial Sequence
  Description of Artificial Sequence: Synthetic peptide
GAVDRSG

SEQ ID NO: 6703 - protein, 7 aa, Artificial Sequence
  Description of Artificial Sequence: Synthetic peptide
SRDPAGG

SEQ ID NO: 6704 - protein, 7 aa, Artificial Sequence
  Description of Artificial Sequence: Synthetic peptide
SQSNTSV

SEQ ID NO: 6705 - protein, 7 aa, Artificial Sequence
  Description of Artificial Sequence: Synthetic peptide
SGRDKLN

SEQ ID NO: 6706 - protein, 7 aa, Artificial Sequence
  Description of Artificial Sequence: Synthetic peptide
HVDKSGM

SEQ ID NO: 6707 - protein, 7 aa, Artificial Sequence
  Description of Artificial Sequence: Synthetic peptide
EGSTSKH

SEQ ID NO: 6708 - protein, 7 aa, Artificial Sequence
  Description of Artificial Sequence: Synthetic peptide
NPSPSVK

SEQ ID NO: 6709 - protein, 7 aa, Artificial Sequence
  Description of Artificial Sequence: Synthetic peptide
QPSNAAS

SEQ ID NO: 6710 - protein, 7 aa, Artificial Sequence
  Description of Artificial Sequence: Synthetic peptide
MSNSPSS

SEQ ID NO: 6711 - protein, 7 aa, Artificial Sequence
  Description of Artificial Sequence: Synthetic peptide
LGGNEAR

SEQ ID NO: 6712 - protein, 7 aa, Artificial Sequence
  Description of Artificial Sequence: Synthetic peptide
EQSKHAS

SEQ ID NO: 6713 - protein, 7 aa, Artificial Sequence
  Description of Artificial Sequence: Synthetic peptide
TSSATSI

SEQ ID NO: 6714 - protein, 7 aa, Artificial Sequence
  Description of Artificial Sequence: Synthetic peptide
DEGRSHT

SEQ ID NO: 6715 - protein, 7 aa, Artificial Sequence
  Description of Artificial Sequence: Synthetic peptide
DGTRTSG

SEQ ID NO: 6716 - protein, 7 aa, Artificial Sequence
  Description of Artificial Sequence: Synthetic peptide
AADRSSS

SEQ ID NO: 6717 - protein, 7 aa, Artificial Sequence
  Description of Artificial Sequence: Synthetic peptide
SQPSGGG

SEQ ID NO: 6718 - protein, 7 aa, Artificial Sequence
  Description of Artificial Sequence: Synthetic peptide
LRSSEKG

SEQ ID NO: 6719 - protein, 7 aa, Artificial Sequence
  Description of Artificial Sequence: Synthetic peptide
EGGANSR

SEQ ID NO: 6720 - protein, 7 aa, Artificial Sequence
  Description of Artificial Sequence: Synthetic peptide
SSAQGSG

SEQ ID NO: 6721 - protein, 7 aa, Artificial Sequence
  Description of Artificial Sequence: Synthetic peptide
TEVSKVQ

SEQ ID NO: 6722 - protein, 7 aa, Artificial Sequence
  Description of Artificial Sequence: Synthetic peptide
NTGKDNP

SEQ ID NO: 6723 - protein, 7 aa, Artificial Sequence
  Description of Artificial Sequence: Synthetic peptide
KAQNAPQ

SEQ ID NO: 6724 - protein, 7 aa, Artificial Sequence
  Description of Artificial Sequence: Synthetic peptide
MGPERPQ

SEQ ID NO: 6725 - protein, 7 aa, Artificial Sequence
  Description of Artificial Sequence: Synthetic peptide
ESGKTSS

SEQ ID NO: 6726 - protein, 7 aa, Artificial Sequence
  Description of Artificial Sequence: Synthetic peptide
QPTKEHH

SEQ ID NO: 6727 - protein, 7 aa, Artificial Sequence
  Description of Artificial Sequence: Synthetic peptide
SPPNGGV

SEQ ID NO: 6728 - protein, 7 aa, Artificial Sequence
  Description of Artificial Sequence: Synthetic peptide
DSATRSG

SEQ ID NO: 6729 - protein, 7 aa, Artificial Sequence
  Description of Artificial Sequence: Synthetic peptide
TDGPRSN

SEQ ID NO: 6730 - protein, 7 aa, Artificial Sequence
  Description of Artificial Sequence: Synthetic peptide
NRLEKES

SEQ ID NO: 6731 - protein, 7 aa, Artificial Sequence
  Description of Artificial Sequence: Synthetic peptide
EATSSGT

SEQ ID NO: 6732 - protein, 7 aa, Artificial Sequence
  Description of Artificial Sequence: Synthetic peptide
GKDPNSA

SEQ ID NO: 6733 - protein, 7 aa, Artificial Sequence
  Description of Artificial Sequence: Synthetic peptide
NRDKSMA

SEQ ID NO: 6734 - protein, 7 aa, Artificial Sequence
  Description of Artificial Sequence: Synthetic peptide
TPSNSTS

SEQ ID NO: 6735 - protein, 7 aa, Artificial Sequence
  Description of Artificial Sequence: Synthetic peptide
GRVAEEK

SEQ ID NO: 6736 - protein, 7 aa, Artificial Sequence
  Description of Artificial Sequence: Synthetic peptide
GSTDAKV

SEQ ID NO: 6737 - protein, 7 aa, Artificial Sequence
  Description of Artificial Sequence: Synthetic peptide
CGSSSCS

SEQ ID NO: 6738 - protein, 7 aa, Artificial Sequence
  Description of Artificial Sequence: Synthetic peptide
FKQAQTA

SEQ ID NO: 6739 - protein, 7 aa, Artificial Sequence
  Description of Artificial Sequence: Synthetic peptide
DRPPSKD

SEQ ID NO: 6740 - protein, 7 aa, Artificial Sequence
  Description of Artificial Sequence: Synthetic peptide
VGGTTTA

SEQ ID NO: 6741 - protein, 7 aa, Artificial Sequence
  Description of Artificial Sequence: Synthetic peptide
SGESRPK

SEQ ID NO: 6742 - protein, 7 aa, Artificial Sequence
  Description of Artificial Sequence: Synthetic peptide
SSGPSSS

SEQ ID NO: 6743 - protein, 7 aa, Artificial Sequence
  Description of Artificial Sequence: Synthetic peptide
SHTNSPS

SEQ ID NO: 6744 - protein, 7 aa, Artificial Sequence
  Description of Artificial Sequence: Synthetic peptide
TVGHSNQ

SEQ ID NO: 6745 - protein, 7 aa, Artificial Sequence
  Description of Artificial Sequence: Synthetic peptide
KGTSTSL

SEQ ID NO: 6746 - protein, 7 aa, Artificial Sequence
  Description of Artificial Sequence: Synthetic peptide
THTSAPV

SEQ ID NO: 6747 - protein, 7 aa, Artificial Sequence
  Description of Artificial Sequence: Synthetic peptide
SKDNATL

SEQ ID NO: 6748 - protein, 7 aa, Artificial Sequence
  Description of Artificial Sequence: Synthetic peptide
ISESPNR

SEQ ID NO: 6749 - protein, 7 aa, Artificial Sequence
  Description of Artificial Sequence: Synthetic peptide
QRATNSI

SEQ ID NO: 6750 - protein, 7 aa, Artificial Sequence
  Description of Artificial Sequence: Synthetic peptide
LKSSPTV

SEQ ID NO: 6751 - protein, 7 aa, Artificial Sequence
  Description of Artificial Sequence: Synthetic peptide
DGHGAVS

SEQ ID NO: 6752 - protein, 7 aa, Artificial Sequence
  Description of Artificial Sequence: Synthetic peptide
GGTQSAK

SEQ ID NO: 6753 - protein, 7 aa, Artificial Sequence
  Description of Artificial Sequence: Synthetic peptide
VRTANNN

SEQ ID NO: 6754 - protein, 7 aa, Artificial Sequence
  Description of Artificial Sequence: Synthetic peptide
TPTVSPG

SEQ ID NO: 6755 - protein, 7 aa, Artificial Sequence
  Description of Artificial Sequence: Synthetic peptide
SIGTSSG

SEQ ID NO: 6756 - protein, 7 aa, Artificial Sequence
  Description of Artificial Sequence: Synthetic peptide
HGTTTTT

SEQ ID NO: 6757 - protein, 7 aa, Artificial Sequence
  Description of Artificial Sequence: Synthetic peptide
APTESSK

SEQ ID NO: 6758 - protein, 7 aa, Artificial Sequence
  Description of Artificial Sequence: Synthetic peptide
KLSDKSL

SEQ ID NO: 6759 - protein, 7 aa, Artificial Sequence
  Description of Artificial Sequence: Synthetic peptide
ANGEANR

SEQ ID NO: 6760 - protein, 7 aa, Artificial Sequence
  Description of Artificial Sequence: Synthetic peptide
DNVNPAR

SEQ ID NO: 6761 - protein, 7 aa, Artificial Sequence
  Description of Artificial Sequence: Synthetic peptide
GRERPSE

SEQ ID NO: 6762 - protein, 7 aa, Artificial Sequence
  Description of Artificial Sequence: Synthetic peptide
GNSDKSS

SEQ ID NO: 6763 - protein, 7 aa, Artificial Sequence
  Description of Artificial Sequence: Synthetic peptide
VTTGGTS

SEQ ID NO: 6764 - protein, 7 aa, Artificial Sequence
  Description of Artificial Sequence: Synthetic peptide
ESTGSRA

SEQ ID NO: 6765 - protein, 7 aa, Artificial Sequence
  Description of Artificial Sequence: Synthetic peptide
GPSTNEK

SEQ ID NO: 6766 - protein, 7 aa, Artificial Sequence
  Description of Artificial Sequence: Synthetic peptide
QDTKTAN

SEQ ID NO: 6767 - protein, 7 aa, Artificial Sequence
  Description of Artificial Sequence: Synthetic peptide
RENGKSI

SEQ ID NO: 6768 - protein, 7 aa, Artificial Sequence
  Description of Artificial Sequence: Synthetic peptide
DGNRPNG

SEQ ID NO: 6769 - protein, 7 aa, Artificial Sequence
  Description of Artificial Sequence: Synthetic peptide
AGDNTRA

SEQ ID NO: 6770 - protein, 7 aa, Artificial Sequence
  Description of Artificial Sequence: Synthetic peptide
STSATSS

SEQ ID NO: 6771 - protein, 7 aa, Artificial Sequence
  Description of Artificial Sequence: Synthetic peptide
QQASSTS

SEQ ID NO: 6772 - protein, 7 aa, Artificial Sequence
  Description of Artificial Sequence: Synthetic peptide
SGNQSLN

SEQ ID NO: 6773 - protein, 7 aa, Artificial Sequence
  Description of Artificial Sequence: Synthetic peptide
TVHDKGN

SEQ ID NO: 6774 - protein, 7 aa, Artificial Sequence
  Description of Artificial Sequence: Synthetic peptide
SDGRGSG

SEQ ID NO: 6775 - protein, 7 aa, Artificial Sequence
  Description of Artificial Sequence: Synthetic peptide
SGSTTPM

SEQ ID NO: 6776 - protein, 7 aa, Artificial Sequence
  Description of Artificial Sequence: Synthetic peptide
DTQGRKD

SEQ ID NO: 6777 - protein, 7 aa, Artificial Sequence
  Description of Artificial Sequence: Synthetic peptide
GSDKGRD

SEQ ID NO: 6778 - protein, 7 aa, Artificial Sequence
  Description of Artificial Sequence: Synthetic peptide
QGSTPQL

SEQ ID NO: 6779 - protein, 7 aa, Artificial Sequence
  Description of Artificial Sequence: Synthetic peptide
SSDKTGR

SEQ ID NO: 6780 - protein, 7 aa, Artificial Sequence
  Description of Artificial Sequence: Synthetic peptide
NTSSTSG

SEQ ID NO: 6781 - protein, 7 aa, Artificial Sequence
  Description of Artificial Sequence: Synthetic peptide
HAKGAGD

SEQ ID NO: 6782 - protein, 7 aa, Artificial Sequence
  Description of Artificial Sequence: Synthetic peptide
GRDDKVG

SEQ ID NO: 6783 - protein, 7 aa, Artificial Sequence
  Description of Artificial Sequence: Synthetic peptide
SLGAGSG

SEQ ID NO: 6784 - protein, 7 aa, Artificial Sequence
  Description of Artificial Sequence: Synthetic peptide
TRQGAPV

SEQ ID NO: 6785 - protein, 7 aa, Artificial Sequence
  Description of Artificial Sequence: Synthetic peptide
DRNPSSH

SEQ ID NO: 6786 - protein, 7 aa, Artificial Sequence
  Description of Artificial Sequence: Synthetic peptide
HTDKNAG

SEQ ID NO: 6787 - protein, 7 aa, Artificial Sequence
  Description of Artificial Sequence: Synthetic peptide
SGTNTMT

SEQ ID NO: 6788 - protein, 7 aa, Artificial Sequence
  Description of Artificial Sequence: Synthetic peptide
HQTGAGS

SEQ ID NO: 6789 - protein, 7 aa, Artificial Sequence
  Description of Artificial Sequence: Synthetic peptide
SGSANTR

SEQ ID NO: 6790 - protein, 7 aa, Artificial Sequence
  Description of Artificial Sequence: Synthetic peptide
GDRSKAN

SEQ ID NO: 6791 - protein, 7 aa, Artificial Sequence
  Description of Artificial Sequence: Synthetic peptide
GKGNASA

SEQ ID NO: 6792 - protein, 7 aa, Artificial Sequence
  Description of Artificial Sequence: Synthetic peptide
SGSSSVV

SEQ ID NO: 6793 - protein, 7 aa, Artificial Sequence
  Description of Artificial Sequence: Synthetic peptide
EPSRSSV

SEQ ID NO: 6794 - protein, 7 aa, Artificial Sequence
  Description of Artificial Sequence: Synthetic peptide
RDKGQSS

SEQ ID NO: 6795 - protein, 7 aa, Artificial Sequence
  Description of Artificial Sequence: Synthetic peptide
VGGSSPT

SEQ ID NO: 6796 - protein, 7 aa, Artificial Sequence
  Description of Artificial Sequence: Synthetic peptide
NGTGSAQ

SEQ ID NO: 6797 - protein, 7 aa, Artificial Sequence
  Description of Artificial Sequence: Synthetic peptide
GTGPSHV

SEQ ID NO: 6798 - protein, 7 aa, Artificial Sequence
  Description of Artificial Sequence: Synthetic peptide
AGSPSPR

SEQ ID NO: 6799 - protein, 7 aa, Artificial Sequence
  Description of Artificial Sequence: Synthetic peptide
NGAAKQV

SEQ ID NO: 6800 - protein, 7 aa, Artificial Sequence
  Description of Artificial Sequence: Synthetic peptide
TPNATPN

SEQ ID NO: 6801 - protein, 7 aa, Artificial Sequence
  Description of Artificial Sequence: Synthetic peptide
TATRSAG

SEQ ID NO: 6802 - protein, 7 aa, Artificial Sequence
  Description of Artificial Sequence: Synthetic peptide
TAGQTSL

SEQ ID NO: 6803 - protein, 7 aa, Artificial Sequence
  Description of Artificial Sequence: Synthetic peptide
TTNPSSS

SEQ ID NO: 6804 - protein, 7 aa, Artificial Sequence
  Description of Artificial Sequence: Synthetic peptide
SMNNPGK

SEQ ID NO: 6805 - protein, 7 aa, Artificial Sequence
  Description of Artificial Sequence: Synthetic peptide
MVSNPSS

SEQ ID NO: 6806 - protein, 7 aa, Artificial Sequence
  Description of Artificial Sequence: Synthetic peptide
QQGGAIA

SEQ ID NO: 6807 - protein, 7 aa, Artificial Sequence
  Description of Artificial Sequence: Synthetic peptide
QSDGTHR

SEQ ID NO: 6808 - protein, 7 aa, Artificial Sequence
  Description of Artificial Sequence: Synthetic peptide
LQGENSK

SEQ ID NO: 6809 - protein, 7 aa, Artificial Sequence
  Description of Artificial Sequence: Synthetic peptide
LGERSSG

SEQ ID NO: 6810 - protein, 7 aa, Artificial Sequence
  Description of Artificial Sequence: Synthetic peptide
EGSGERR

SEQ ID NO: 6811 - protein, 7 aa, Artificial Sequence
  Description of Artificial Sequence: Synthetic peptide
GTSNASA

SEQ ID NO: 6812 - protein, 7 aa, Artificial Sequence
  Description of Artificial Sequence: Synthetic peptide
GHTKISG

SEQ ID NO: 6813 - protein, 7 aa, Artificial Sequence
  Description of Artificial Sequence: Synthetic peptide
GALGTAG

SEQ ID NO: 6814 - protein, 7 aa, Artificial Sequence
  Description of Artificial Sequence: Synthetic peptide
VASKGPT

SEQ ID NO: 6815 - protein, 7 aa, Artificial Sequence
  Description of Artificial Sequence: Synthetic peptide
TGAQTVA

SEQ ID NO: 6816 - protein, 7 aa, Artificial Sequence
  Description of Artificial Sequence: Synthetic peptide
WGTTSPS

SEQ ID NO: 6817 - protein, 7 aa, Artificial Sequence
  Description of Artificial Sequence: Synthetic peptide
SIAGSTA

SEQ ID NO: 6818 - protein, 7 aa, Artificial Sequence
  Description of Artificial Sequence: Synthetic peptide
DVTEKSR

SEQ ID NO: 6819 - protein, 7 aa, Artificial Sequence
  Description of Artificial Sequence: Synthetic peptide
TIHQKSD

SEQ ID NO: 6820 - protein, 7 aa, Artificial Sequence
  Description of Artificial Sequence: Synthetic peptide
STDGRNT

SEQ ID NO: 6821 - protein, 7 aa, Artificial Sequence
  Description of Artificial Sequence: Synthetic peptide
GTERPNG

SEQ ID NO: 6822 - protein, 7 aa, Artificial Sequence
  Description of Artificial Sequence: Synthetic peptide
TNGNVPV

SEQ ID NO: 6823 - protein, 7 aa, Artificial Sequence
  Description of Artificial Sequence: Synthetic peptide
GGGSSQA

SEQ ID NO: 6824 - protein, 7 aa, Artificial Sequence
  Description of Artificial Sequence: Synthetic peptide
TGSGVNV

SEQ ID NO: 6825 - protein, 7 aa, Artificial Sequence
  Description of Artificial Sequence: Synthetic peptide
ALSKGSG

SEQ ID NO: 6826 - protein, 7 aa, Artificial Sequence
  Description of Artificial Sequence: Synthetic peptide
GKTDSMR

SEQ ID NO: 6827 - protein, 7 aa, Artificial Sequence
  Description of Artificial Sequence: Synthetic peptide
GVEGTRI

SEQ ID NO: 6828 - protein, 7 aa, Artificial Sequence
  Description of Artificial Sequence: Synthetic peptide
SGSDKAR

SEQ ID NO: 6829 - protein, 7 aa, Artificial Sequence
  Description of Artificial Sequence: Synthetic peptide
NVSSSNV

SEQ ID NO: 6830 - protein, 7 aa, Artificial Sequence
  Description of Artificial Sequence: Synthetic peptide
GLSSSTG

SEQ ID NO: 6831 - protein, 7 aa, Artificial Sequence
  Description of Artificial Sequence: Synthetic peptide
KESKESM

SEQ ID NO: 6832 - protein, 7 aa, Artificial Sequence
  Description of Artificial Sequence: Synthetic peptide
SGGSVNG

SEQ ID NO: 6833 - protein, 7 aa, Artificial Sequence
  Description of Artificial Sequence: Synthetic peptide
HASSSNT

SEQ ID NO: 6834 - protein, 7 aa, Artificial Sequence
  Description of Artificial Sequence: Synthetic peptide
EGGSTAT

SEQ ID NO: 6835 - protein, 7 aa, Artificial Sequence
  Description of Artificial Sequence: Synthetic peptide
ATSNNSV

SEQ ID NO: 6836 - protein, 7 aa, Artificial Sequence
  Description of Artificial Sequence: Synthetic peptide
NGKPNAS

SEQ ID NO: 6837 - protein, 7 aa, Artificial Sequence
  Description of Artificial Sequence: Synthetic peptide
VSGTNSA

SEQ ID NO: 6838 - protein, 7 aa, Artificial Sequence
  Description of Artificial Sequence: Synthetic peptide
AGTAKGV

SEQ ID NO: 6839 - protein, 7 aa, Artificial Sequence
  Description of Artificial Sequence: Synthetic peptide
LASQSQG

SEQ ID NO: 6840 - protein, 7 aa, Artificial Sequence
  Description of Artificial Sequence: Synthetic peptide
ASTGKVS

SEQ ID NO: 6841 - protein, 7 aa, Artificial Sequence
  Description of Artificial Sequence: Synthetic peptide
GQGGSGP

SEQ ID NO: 6842 - protein, 7 aa, Artificial Sequence
  Description of Artificial Sequence: Synthetic peptide
TKNTNVM

SEQ ID NO: 6843 - protein, 7 aa, Artificial Sequence
  Description of Artificial Sequence: Synthetic peptide
TSASAVT

SEQ ID NO: 6844 - protein, 7 aa, Artificial Sequence
  Description of Artificial Sequence: Synthetic peptide
GTTAQSS

SEQ ID NO: 6845 - protein, 7 aa, Artificial Sequence
  Description of Artificial Sequence: Synthetic peptide
TGDGKLH

SEQ ID NO: 6846 - protein, 7 aa, Artificial Sequence
  Description of Artificial Sequence: Synthetic peptide
NLNDTKG

SEQ ID NO: 6847 - protein, 7 aa, Artificial Sequence
  Description of Artificial Sequence: Synthetic peptide
DRNNEAR

SEQ ID NO: 6848 - protein, 7 aa, Artificial Sequence
  Description of Artificial Sequence: Synthetic peptide
HGNSSSH

SEQ ID NO: 6849 - protein, 7 aa, Artificial Sequence
  Description of Artificial Sequence: Synthetic peptide
GSLKAES

SEQ ID NO: 6850 - protein, 7 aa, Artificial Sequence
  Description of Artificial Sequence: Synthetic peptide
GATDKVN

SEQ ID NO: 6851 - protein, 7 aa, Artificial Sequence
  Description of Artificial Sequence: Synthetic peptide
VKSTASQ

SEQ ID NO: 6852 - protein, 7 aa, Artificial Sequence
  Description of Artificial Sequence: Synthetic peptide
SNQNSPT

SEQ ID NO: 6853 - protein, 7 aa, Artificial Sequence
  Description of Artificial Sequence: Synthetic peptide
STKGSNY

SEQ ID NO: 6854 - protein, 7 aa, Artificial Sequence
  Description of Artificial Sequence: Synthetic peptide
TTVSTSS

SEQ ID NO: 6855 - protein, 7 aa, Artificial Sequence
  Description of Artificial Sequence: Synthetic peptide
TSATSPV

SEQ ID NO: 6856 - protein, 7 aa, Artificial Sequence
  Description of Artificial Sequence: Synthetic peptide
QQEREVK

SEQ ID NO: 6857 - protein, 7 aa, Artificial Sequence
  Description of Artificial Sequence: Synthetic peptide
AVAKQSI

SEQ ID NO: 6858 - protein, 7 aa, Artificial Sequence
  Description of Artificial Sequence: Synthetic peptide
GDSRLNS

SEQ ID NO: 6859 - protein, 7 aa, Artificial Sequence
  Description of Artificial Sequence: Synthetic peptide
TDGSKVS

SEQ ID NO: 6860 - protein, 7 aa, Artificial Sequence
  Description of Artificial Sequence: Synthetic peptide
DRVGTSQ

SEQ ID NO: 6861 - protein, 7 aa, Artificial Sequence
  Description of Artificial Sequence: Synthetic peptide
GADTKLT

SEQ ID NO: 6862 - protein, 7 aa, Artificial Sequence
  Description of Artificial Sequence: Synthetic peptide
VQRTEQQ

SEQ ID NO: 6863 - protein, 7 aa, Artificial Sequence
  Description of Artificial Sequence: Synthetic peptide
NANSSPN

SEQ ID NO: 6864 - protein, 7 aa, Artificial Sequence
  Description of Artificial Sequence: Synthetic peptide
SSGSSSL

SEQ ID NO: 6865 - protein, 7 aa, Artificial Sequence
  Description of Artificial Sequence: Synthetic peptide
TGSTSNV

SEQ ID NO: 6866 - protein, 7 aa, Artificial Sequence
  Description of Artificial Sequence: Synthetic peptide
GLGEKSK

SEQ ID NO: 6867 - protein, 7 aa, Artificial Sequence
  Description of Artificial Sequence: Synthetic peptide
HAGKQNA

SEQ ID NO: 6868 - protein, 7 aa, Artificial Sequence
  Description of Artificial Sequence: Synthetic peptide
DRVSAPT

SEQ ID NO: 6869 - protein, 7 aa, Artificial Sequence
  Description of Artificial Sequence: Synthetic peptide
GGNGGSS

SEQ ID NO: 6870 - protein, 7 aa, Artificial Sequence
  Description of Artificial Sequence: Synthetic peptide
SDNRGTQ

SEQ ID NO: 6871 - protein, 7 aa, Artificial Sequence
  Description of Artificial Sequence: Synthetic peptide
NSGSPSQ

SEQ ID NO: 6872 - protein, 7 aa, Artificial Sequence
  Description of Artificial Sequence: Synthetic peptide
NSNERTQ

SEQ ID NO: 6873 - protein, 7 aa, Artificial Sequence
  Description of Artificial Sequence: Synthetic peptide
TGGSTGL

SEQ ID NO: 6874 - protein, 7 aa, Artificial Sequence
  Description of Artificial Sequence: Synthetic peptide
FSGNTAK

SEQ ID NO: 6875 - protein, 7 aa, Artificial Sequence
  Description of Artificial Sequence: Synthetic peptide
SGDTARS

SEQ ID NO: 6876 - protein, 7 aa, Artificial Sequence
  Description of Artificial Sequence: Synthetic peptide
ENGVSTR

SEQ ID NO: 6877 - protein, 7 aa, Artificial Sequence
  Description of Artificial Sequence: Synthetic peptide
SSSDSRA

SEQ ID NO: 6878 - protein, 7 aa, Artificial Sequence
  Description of Artificial Sequence: Synthetic peptide
NGGNAPG

SEQ ID NO: 6879 - protein, 7 aa, Artificial Sequence
  Description of Artificial Sequence: Synthetic peptide
TNGGTSR

SEQ ID NO: 6880 - protein, 7 aa, Artificial Sequence
  Description of Artificial Sequence: Synthetic peptide
ENGQPKT

SEQ ID NO: 6881 - protein, 7 aa, Artificial Sequence
  Description of Artificial Sequence: Synthetic peptide
APDLKGG

SEQ ID NO: 6882 - protein, 7 aa, Artificial Sequence
  Description of Artificial Sequence: Synthetic peptide
VVASANS

SEQ ID NO: 6883 - protein, 7 aa, Artificial Sequence
  Description of Artificial Sequence: Synthetic peptide
GANKSIG

SEQ ID NO: 6884 - protein, 7 aa, Artificial Sequence
  Description of Artificial Sequence: Synthetic peptide
TSGGGAP

SEQ ID NO: 6885 - protein, 7 aa, Artificial Sequence
  Description of Artificial Sequence: Synthetic peptide
VSSPASV

SEQ ID NO: 6886 - protein, 7 aa, Artificial Sequence
  Description of Artificial Sequence: Synthetic peptide
EGTNKVG

SEQ ID NO: 6887 - protein, 7 aa, Artificial Sequence
  Description of Artificial Sequence: Synthetic peptide
VASDKAH

SEQ ID NO: 6888 - protein, 7 aa, Artificial Sequence
  Description of Artificial Sequence: Synthetic peptide
SPSANGI

SEQ ID NO: 6889 - protein, 7 aa, Artificial Sequence
  Description of Artificial Sequence: Synthetic peptide
TSGTTPR

SEQ ID NO: 6890 - protein, 7 aa, Artificial Sequence
  Description of Artificial Sequence: Synthetic peptide
DAPARSV

SEQ ID NO: 6891 - protein, 7 aa, Artificial Sequence
  Description of Artificial Sequence: Synthetic peptide
SGSTSFS

SEQ ID NO: 6892 - protein, 7 aa, Artificial Sequence
  Description of Artificial Sequence: Synthetic peptide
QTETKGT

SEQ ID NO: 6893 - protein, 7 aa, Artificial Sequence
  Description of Artificial Sequence: Synthetic peptide
QQTNGKP

SEQ ID NO: 6894 - protein, 7 aa, Artificial Sequence
  Description of Artificial Sequence: Synthetic peptide
AQSNSHA

SEQ ID NO: 6895 - protein, 7 aa, Artificial Sequence
  Description of Artificial Sequence: Synthetic peptide
GAGSAAA

SEQ ID NO: 6896 - protein, 7 aa, Artificial Sequence
  Description of Artificial Sequence: Synthetic peptide
LQKSTPV

SEQ ID NO: 6897 - protein, 7 aa, Artificial Sequence
  Description of Artificial Sequence: Synthetic peptide
STNSKDR

SEQ ID NO: 6898 - protein, 7 aa, Artificial Sequence
  Description of Artificial Sequence: Synthetic peptide
SNGPPNT

SEQ ID NO: 6899 - protein, 7 aa, Artificial Sequence
  Description of Artificial Sequence: Synthetic peptide
GTQTDIR

SEQ ID NO: 6900 - protein, 7 aa, Artificial Sequence
  Description of Artificial Sequence: Synthetic peptide
GPTQSAT

SEQ ID NO: 6901 - protein, 7 aa, Artificial Sequence
  Description of Artificial Sequence: Synthetic peptide
ESSSRVA

SEQ ID NO: 6902 - protein, 7 aa, Artificial Sequence
  Description of Artificial Sequence: Synthetic peptide
APAESKS

SEQ ID NO: 6903 - protein, 7 aa, Artificial Sequence
  Description of Artificial Sequence: Synthetic peptide
SGSTHSV

SEQ ID NO: 6904 - protein, 7 aa, Artificial Sequence
  Description of Artificial Sequence: Synthetic peptide
ATGSSAN

SEQ ID NO: 6905 - protein, 7 aa, Artificial Sequence
  Description of Artificial Sequence: Synthetic peptide
STGKDNS

SEQ ID NO: 6906 - protein, 7 aa, Artificial Sequence
  Description of Artificial Sequence: Synthetic peptide
QRNESTV

SEQ ID NO: 6907 - protein, 7 aa, Artificial Sequence
  Description of Artificial Sequence: Synthetic peptide
EPQANRG

SEQ ID NO: 6908 - protein, 7 aa, Artificial Sequence
  Description of Artificial Sequence: Synthetic peptide
TVATPGT

SEQ ID NO: 6909 - protein, 7 aa, Artificial Sequence
  Description of Artificial Sequence: Synthetic peptide
TGGSGNS

SEQ ID NO: 6910 - protein, 7 aa, Artificial Sequence
  Description of Artificial Sequence: Synthetic peptide
MSGQNPS

SEQ ID NO: 6911 - protein, 7 aa, Artificial Sequence
  Description of Artificial Sequence: Synthetic peptide
QNQPNRG

SEQ ID NO: 6912 - protein, 7 aa, Artificial Sequence
  Description of Artificial Sequence: Synthetic peptide
HGSSTML

SEQ ID NO: 6913 - protein, 7 aa, Artificial Sequence
  Description of Artificial Sequence: Synthetic peptide
ESVSRNN

SEQ ID NO: 6914 - protein, 7 aa, Artificial Sequence
  Description of Artificial Sequence: Synthetic peptide
NSSSKAE

SEQ ID NO: 6915 - protein, 7 aa, Artificial Sequence
  Description of Artificial Sequence: Synthetic peptide
LTTNTSA

SEQ ID NO: 6916 - protein, 7 aa, Artificial Sequence
  Description of Artificial Sequence: Synthetic peptide
GHLPTSA

SEQ ID NO: 6917 - protein, 7 aa, Artificial Sequence
  Description of Artificial Sequence: Synthetic peptide
LGNQGVN

SEQ ID NO: 6918 - protein, 7 aa, Artificial Sequence
  Description of Artificial Sequence: Synthetic peptide
ASKNTPT

SEQ ID NO: 6919 - protein, 7 aa, Artificial Sequence
  Description of Artificial Sequence: Synthetic peptide
STANKSQ

SEQ ID NO: 6920 - protein, 7 aa, Artificial Sequence
  Description of Artificial Sequence: Synthetic peptide
GATKGQA

SEQ ID NO: 6921 - protein, 7 aa, Artificial Sequence
  Description of Artificial Sequence: Synthetic peptide
TANQSNL

SEQ ID NO: 6922 - protein, 7 aa, Artificial Sequence
  Description of Artificial Sequence: Synthetic peptide
ANLDPKT

SEQ ID NO: 6923 - protein, 7 aa, Artificial Sequence
  Description of Artificial Sequence: Synthetic peptide
HPASKPP

SEQ ID NO: 6924 - protein, 7 aa, Artificial Sequence
  Description of Artificial Sequence: Synthetic peptide
IPSDGSK

SEQ ID NO: 6925 - protein, 7 aa, Artificial Sequence
  Description of Artificial Sequence: Synthetic peptide
DGGSRDS

SEQ ID NO: 6926 - protein, 7 aa, Artificial Sequence
  Description of Artificial Sequence: Synthetic peptide
AATNKNQ

SEQ ID NO: 6927 - protein, 7 aa, Artificial Sequence
  Description of Artificial Sequence: Synthetic peptide
GNAASHA

SEQ ID NO: 6928 - protein, 7 aa, Artificial Sequence
  Description of Artificial Sequence: Synthetic peptide
GLSGPGK

SEQ ID NO: 6929 - protein, 7 aa, Artificial Sequence
  Description of Artificial Sequence: Synthetic peptide
DTGTSNR

SEQ ID NO: 6930 - protein, 7 aa, Artificial Sequence
  Description of Artificial Sequence: Synthetic peptide
DSGSQSR

SEQ ID NO: 6931 - protein, 7 aa, Artificial Sequence
  Description of Artificial Sequence: Synthetic peptide
GEPRANS

SEQ ID NO: 6932 - protein, 7 aa, Artificial Sequence
  Description of Artificial Sequence: Synthetic peptide
LTKSNSS

SEQ ID NO: 6933 - protein, 7 aa, Artificial Sequence
  Description of Artificial Sequence: Synthetic peptide
TRNKEVN

SEQ ID NO: 6934 - protein, 7 aa, Artificial Sequence
  Description of Artificial Sequence: Synthetic peptide
WGNSDKS

SEQ ID NO: 6935 - protein, 7 aa, Artificial Sequence
  Description of Artificial Sequence: Synthetic peptide
FGSNSGS

SEQ ID NO: 6936 - protein, 7 aa, Artificial Sequence
  Description of Artificial Sequence: Synthetic peptide
NGSDTQR

SEQ ID NO: 6937 - protein, 7 aa, Artificial Sequence
  Description of Artificial Sequence: Synthetic peptide
STATVPQ

SEQ ID NO: 6938 - protein, 7 aa, Artificial Sequence
  Description of Artificial Sequence: Synthetic peptide
SLGRSEG

SEQ ID NO: 6939 - protein, 7 aa, Artificial Sequence
  Description of Artificial Sequence: Synthetic peptide
ENHKPMI

SEQ ID NO: 6940 - protein, 7 aa, Artificial Sequence
  Description of Artificial Sequence: Synthetic peptide
AIDRQNG

SEQ ID NO: 6941 - protein, 7 aa, Artificial Sequence
  Description of Artificial Sequence: Synthetic peptide
GPEVALK

SEQ ID NO: 6942 - protein, 7 aa, Artificial Sequence
  Description of Artificial Sequence: Synthetic peptide
LGTTTTL

SEQ ID NO: 6943 - protein, 7 aa, Artificial Sequence
  Description of Artificial Sequence: Synthetic peptide
SRAAATV

SEQ ID NO: 6944 - protein, 7 aa, Artificial Sequence
  Description of Artificial Sequence: Synthetic peptide
SLGSHGS

SEQ ID NO: 6945 - protein, 7 aa, Artificial Sequence
  Description of Artificial Sequence: Synthetic peptide
HSTGSHG

SEQ ID NO: 6946 - protein, 7 aa, Artificial Sequence
  Description of Artificial Sequence: Synthetic peptide
LLKGASQ

SEQ ID NO: 6947 - protein, 7 aa, Artificial Sequence
  Description of Artificial Sequence: Synthetic peptide
ERGNAAS

SEQ ID NO: 6948 - protein, 7 aa, Artificial Sequence
  Description of Artificial Sequence: Synthetic peptide
EPATKGT

SEQ ID NO: 6949 - protein, 7 aa, Artificial Sequence
  Description of Artificial Sequence: Synthetic peptide
DDGRATV

SEQ ID NO: 6950 - protein, 7 aa, Artificial Sequence
  Description of Artificial Sequence: Synthetic peptide
RVTDKPS

SEQ ID NO: 6951 - protein, 7 aa, Artificial Sequence
  Description of Artificial Sequence: Synthetic peptide
TRNSPTQ

SEQ ID NO: 6952 - protein, 7 aa, Artificial Sequence
  Description of Artificial Sequence: Synthetic peptide
STGGSGT

SEQ ID NO: 6953 - protein, 7 aa, Artificial Sequence
  Description of Artificial Sequence: Synthetic peptide
SIASSGG

SEQ ID NO: 6954 - protein, 7 aa, Artificial Sequence
  Description of Artificial Sequence: Synthetic peptide
SHNTANS

SEQ ID NO: 6955 - protein, 7 aa, Artificial Sequence
  Description of Artificial Sequence: Synthetic peptide
QISDPKH

SEQ ID NO: 6956 - protein, 7 aa, Artificial Sequence
  Description of Artificial Sequence: Synthetic peptide
HNTSSPT

SEQ ID NO: 6957 - protein, 7 aa, Artificial Sequence
  Description of Artificial Sequence: Synthetic peptide
SKENVPV

SEQ ID NO: 6958 - protein, 7 aa, Artificial Sequence
  Description of Artificial Sequence: Synthetic peptide
HVDSGGG

SEQ ID NO: 6959 - protein, 7 aa, Artificial Sequence
  Description of Artificial Sequence: Synthetic peptide
AMSNESK

SEQ ID NO: 6960 - protein, 7 aa, Artificial Sequence
  Description of Artificial Sequence: Synthetic peptide
GEKAQKV

SEQ ID NO: 6961 - protein, 7 aa, Artificial Sequence
  Description of Artificial Sequence: Synthetic peptide
LSSGSSG

SEQ ID NO: 6962 - protein, 7 aa, Artificial Sequence
  Description of Artificial Sequence: Synthetic peptide
GVSNSSI

SEQ ID NO: 6963 - protein, 7 aa, Artificial Sequence
  Description of Artificial Sequence: Synthetic peptide
SSGTAIS

SEQ ID NO: 6964 - protein, 7 aa, Artificial Sequence
  Description of Artificial Sequence: Synthetic peptide
DKSSGGK

SEQ ID NO: 6965 - protein, 7 aa, Artificial Sequence
  Description of Artificial Sequence: Synthetic peptide
GSTGSGS

SEQ ID NO: 6966 - protein, 7 aa, Artificial Sequence
  Description of Artificial Sequence: Synthetic peptide
GADRPAG

SEQ ID NO: 6967 - protein, 7 aa, Artificial Sequence
  Description of Artificial Sequence: Synthetic peptide
MSHGSNS

SEQ ID NO: 6968 - protein, 7 aa, Artificial Sequence
  Description of Artificial Sequence: Synthetic peptide
IKQSPQS

SEQ ID NO: 6969 - protein, 7 aa, Artificial Sequence
  Description of Artificial Sequence: Synthetic peptide
SANGNNK

SEQ ID NO: 6970 - protein, 7 aa, Artificial Sequence
  Description of Artificial Sequence: Synthetic peptide
GAGASRS

SEQ ID NO: 6971 - protein, 7 aa, Artificial Sequence
  Description of Artificial Sequence: Synthetic peptide
SPQQTVS

SEQ ID NO: 6972 - protein, 7 aa, Artificial Sequence
  Description of Artificial Sequence: Synthetic peptide
NGNGAKL

SEQ ID NO: 6973 - protein, 7 aa, Artificial Sequence
  Description of Artificial Sequence: Synthetic peptide
GPKESNA

SEQ ID NO: 6974 - protein, 7 aa, Artificial Sequence
  Description of Artificial Sequence: Synthetic peptide
SNQSSPS

SEQ ID NO: 6975 - protein, 7 aa, Artificial Sequence
  Description of Artificial Sequence: Synthetic peptide
NSAQGGG

SEQ ID NO: 6976 - protein, 7 aa, Artificial Sequence
  Description of Artificial Sequence: Synthetic peptide
TGDRDRA

SEQ ID NO: 6977 - protein, 7 aa, Artificial Sequence
  Description of Artificial Sequence: Synthetic peptide
TNDSRPE

SEQ ID NO: 6978 - protein, 7 aa, Artificial Sequence
  Description of Artificial Sequence: Synthetic peptide
DSAGPRS

SEQ ID NO: 6979 - protein, 7 aa, Artificial Sequence
  Description of Artificial Sequence: Synthetic peptide
ATGKPGV

SEQ ID NO: 6980 - protein, 7 aa, Artificial Sequence
  Description of Artificial Sequence: Synthetic peptide
SGIKDSP

SEQ ID NO: 6981 - protein, 7 aa, Artificial Sequence
  Description of Artificial Sequence: Synthetic peptide
STHTPSS

SEQ ID NO: 6982 - protein, 7 aa, Artificial Sequence
  Description of Artificial Sequence: Synthetic peptide
NSSGNTP

SEQ ID NO: 6983 - protein, 7 aa, Artificial Sequence
  Description of Artificial Sequence: Synthetic peptide
QMAKSNE

SEQ ID NO: 6984 - protein, 7 aa, Artificial Sequence
  Description of Artificial Sequence: Synthetic peptide
DSNRVNV

SEQ ID NO: 6985 - protein, 7 aa, Artificial Sequence
  Description of Artificial Sequence: Synthetic peptide
SGVGSTL

SEQ ID NO: 6986 - protein, 7 aa, Artificial Sequence
  Description of Artificial Sequence: Synthetic peptide
TQKQAST

SEQ ID NO: 6987 - protein, 7 aa, Artificial Sequence
  Description of Artificial Sequence: Synthetic peptide
SAASTAS

SEQ ID NO: 6988 - protein, 7 aa, Artificial Sequence
  Description of Artificial Sequence: Synthetic peptide
GVASTSS

SEQ ID NO: 6989 - protein, 7 aa, Artificial Sequence
  Description of Artificial Sequence: Synthetic peptide
DGAKSSG

SEQ ID NO: 6990 - protein, 7 aa, Artificial Sequence
  Description of Artificial Sequence: Synthetic peptide
HATAGGS

SEQ ID NO: 6991 - protein, 7 aa, Artificial Sequence
  Description of Artificial Sequence: Synthetic peptide
SGSGSSV

SEQ ID NO: 6992 - protein, 7 aa, Artificial Sequence
  Description of Artificial Sequence: Synthetic peptide
GHGGTQN

SEQ ID NO: 6993 - protein, 7 aa, Artificial Sequence
  Description of Artificial Sequence: Synthetic peptide
SGTDKRS

SEQ ID NO: 6994 - protein, 7 aa, Artificial Sequence
  Description of Artificial Sequence: Synthetic peptide
DKEQKSM

SEQ ID NO: 6995 - protein, 7 aa, Artificial Sequence
  Description of Artificial Sequence: Synthetic peptide
NTGQRST

SEQ ID NO: 6996 - protein, 7 aa, Artificial Sequence
  Description of Artificial Sequence: Synthetic peptide
NLGAAAG

SEQ ID NO: 6997 - protein, 7 aa, Artificial Sequence
  Description of Artificial Sequence: Synthetic peptide
KGSTTVI

SEQ ID NO: 6998 - protein, 7 aa, Artificial Sequence
  Description of Artificial Sequence: Synthetic peptide
NATGTPV

SEQ ID NO: 6999 - protein, 7 aa, Artificial Sequence
  Description of Artificial Sequence: Synthetic peptide
TASASSG

SEQ ID NO: 7000 - protein, 7 aa, Artificial Sequence
  Description of Artificial Sequence: Synthetic peptide
TGTQTPG

SEQ ID NO: 7001 - protein, 7 aa, Artificial Sequence
  Description of Artificial Sequence: Synthetic peptide
STGAGAS

SEQ ID NO: 7002 - protein, 7 aa, Artificial Sequence
  Description of Artificial Sequence: Synthetic peptide
SLASKSG

SEQ ID NO: 7003 - protein, 7 aa, Artificial Sequence
  Description of Artificial Sequence: Synthetic peptide
SAMDSKR

SEQ ID NO: 7004 - protein, 7 aa, Artificial Sequence
  Description of Artificial Sequence: Synthetic peptide
RSTDKTT

SEQ ID NO: 7005 - protein, 7 aa, Artificial Sequence
  Description of Artificial Sequence: Synthetic peptide
ISSQQSH

SEQ ID NO: 7006 - protein, 7 aa, Artificial Sequence
  Description of Artificial Sequence: Synthetic peptide
QGGASLQ

SEQ ID NO: 7007 - protein, 7 aa, Artificial Sequence
  Description of Artificial Sequence: Synthetic peptide
HEEKSPR

SEQ ID NO: 7008 - protein, 7 aa, Artificial Sequence
  Description of Artificial Sequence: Synthetic peptide
LNHTNAG

SEQ ID NO: 7009 - protein, 7 aa, Artificial Sequence
  Description of Artificial Sequence: Synthetic peptide
LTTGERA

SEQ ID NO: 7010 - protein, 7 aa, Artificial Sequence
  Description of Artificial Sequence: Synthetic peptide
LSGTNAQ

SEQ ID NO: 7011 - protein, 7 aa, Artificial Sequence
  Description of Artificial Sequence: Synthetic peptide
DTGGSRH

SEQ ID NO: 7012 - protein, 7 aa, Artificial Sequence
  Description of Artificial Sequence: Synthetic peptide
ESRQSVQ

SEQ ID NO: 7013 - protein, 7 aa, Artificial Sequence
  Description of Artificial Sequence: Synthetic peptide
AGNTSRE

SEQ ID NO: 7014 - protein, 7 aa, Artificial Sequence
  Description of Artificial Sequence: Synthetic peptide
GPGASSS

SEQ ID NO: 7015 - protein, 7 aa, Artificial Sequence
  Description of Artificial Sequence: Synthetic peptide
SGSSALV

SEQ ID NO: 7016 - protein, 7 aa, Artificial Sequence
  Description of Artificial Sequence: Synthetic peptide
WRESKDI

SEQ ID NO: 7017 - protein, 7 aa, Artificial Sequence
  Description of Artificial Sequence: Synthetic peptide
GSGHKVL

SEQ ID NO: 7018 - protein, 7 aa, Artificial Sequence
  Description of Artificial Sequence: Synthetic peptide
ETTKQLG

SEQ ID NO: 7019 - protein, 7 aa, Artificial Sequence
  Description of Artificial Sequence: Synthetic peptide
HGTPSSV

SEQ ID NO: 7020 - protein, 7 aa, Artificial Sequence
  Description of Artificial Sequence: Synthetic peptide
ESSGERR

SEQ ID NO: 7021 - protein, 7 aa, Artificial Sequence
  Description of Artificial Sequence: Synthetic peptide
DKHGQPV

SEQ ID NO: 7022 - protein, 7 aa, Artificial Sequence
  Description of Artificial Sequence: Synthetic peptide
TQGGSSS

SEQ ID NO: 7023 - protein, 7 aa, Artificial Sequence
  Description of Artificial Sequence: Synthetic peptide
SRTASNV

SEQ ID NO: 7024 - protein, 7 aa, Artificial Sequence
  Description of Artificial Sequence: Synthetic peptide
VQKPTMA

SEQ ID NO: 7025 - protein, 7 aa, Artificial Sequence
  Description of Artificial Sequence: Synthetic peptide
TGNPSLT

SEQ ID NO: 7026 - protein, 7 aa, Artificial Sequence
  Description of Artificial Sequence: Synthetic peptide
GSHTPVT

SEQ ID NO: 7027 - protein, 7 aa, Artificial Sequence
  Description of Artificial Sequence: Synthetic peptide
TQQQSAT

SEQ ID NO: 7028 - protein, 7 aa, Artificial Sequence
  Description of Artificial Sequence: Synthetic peptide
TGVQTVG

SEQ ID NO: 7029 - protein, 7 aa, Artificial Sequence
  Description of Artificial Sequence: Synthetic peptide
SSTQTPS

SEQ ID NO: 7030 - protein, 7 aa, Artificial Sequence
  Description of Artificial Sequence: Synthetic peptide
ARGEHPI

SEQ ID NO: 7031 - protein, 7 aa, Artificial Sequence
  Description of Artificial Sequence: Synthetic peptide
NGKTGTA

SEQ ID NO: 7032 - protein, 7 aa, Artificial Sequence
  Description of Artificial Sequence: Synthetic peptide
ENTKSLA

SEQ ID NO: 7033 - protein, 7 aa, Artificial Sequence
  Description of Artificial Sequence: Synthetic peptide
GQGKEQG

SEQ ID NO: 7034 - protein, 7 aa, Artificial Sequence
  Description of Artificial Sequence: Synthetic peptide
TSSGTRN

SEQ ID NO: 7035 - protein, 7 aa, Artificial Sequence
  Description of Artificial Sequence: Synthetic peptide
VGVSNTQ

SEQ ID NO: 7036 - protein, 7 aa, Artificial Sequence
  Description of Artificial Sequence: Synthetic peptide
CLEPSNR

SEQ ID NO: 7037 - protein, 7 aa, Artificial Sequence
  Description of Artificial Sequence: Synthetic peptide
APEKDHR

SEQ ID NO: 7038 - protein, 7 aa, Artificial Sequence
  Description of Artificial Sequence: Synthetic peptide
SGDAVKQ

SEQ ID NO: 7039 - protein, 7 aa, Artificial Sequence
  Description of Artificial Sequence: Synthetic peptide
SSSSTIA

SEQ ID NO: 7040 - protein, 7 aa, Artificial Sequence
  Description of Artificial Sequence: Synthetic peptide
TATAAPM

SEQ ID NO: 7041 - protein, 7 aa, Artificial Sequence
  Description of Artificial Sequence: Synthetic peptide
ASSPGTT

SEQ ID NO: 7042 - protein, 7 aa, Artificial Sequence
  Description of Artificial Sequence: Synthetic peptide
SNSNKNG

SEQ ID NO: 7043 - protein, 7 aa, Artificial Sequence
  Description of Artificial Sequence: Synthetic peptide
AHQGSNT

SEQ ID NO: 7044 - protein, 7 aa, Artificial Sequence
  Description of Artificial Sequence: Synthetic peptide
GRSSQSG

SEQ ID NO: 7045 - protein, 7 aa, Artificial Sequence
  Description of Artificial Sequence: Synthetic peptide
SAAEKSA

SEQ ID NO: 7046 - protein, 7 aa, Artificial Sequence
  Description of Artificial Sequence: Synthetic peptide
VPDRTPV

SEQ ID NO: 7047 - protein, 7 aa, Artificial Sequence
  Description of Artificial Sequence: Synthetic peptide
NRDSSSS

SEQ ID NO: 7048 - protein, 7 aa, Artificial Sequence
  Description of Artificial Sequence: Synthetic peptide
SGDQKGS

SEQ ID NO: 7049 - protein, 7 aa, Artificial Sequence
  Description of Artificial Sequence: Synthetic peptide
ATQASSH

SEQ ID NO: 7050 - protein, 7 aa, Artificial Sequence
  Description of Artificial Sequence: Synthetic peptide
QTSPNGS

SEQ ID NO: 7051 - protein, 7 aa, Artificial Sequence
  Description of Artificial Sequence: Synthetic peptide
SGTPSLS

SEQ ID NO: 7052 - protein, 7 aa, Artificial Sequence
  Description of Artificial Sequence: Synthetic peptide
SMAGASR

SEQ ID NO: 7053 - protein, 7 aa, Artificial Sequence
  Description of Artificial Sequence: Synthetic peptide
MRTEQSM

SEQ ID NO: 7054 - protein, 7 aa, Artificial Sequence
  Description of Artificial Sequence: Synthetic peptide
GTGTHLQ

SEQ ID NO: 7055 - protein, 7 aa, Artificial Sequence
  Description of Artificial Sequence: Synthetic peptide
GQEERKY

SEQ ID NO: 7056 - protein, 7 aa, Artificial Sequence
  Description of Artificial Sequence: Synthetic peptide
SGSPTGL

SEQ ID NO: 7057 - protein, 7 aa, Artificial Sequence
  Description of Artificial Sequence: Synthetic peptide
GSTSSPN

SEQ ID NO: 7058 - protein, 7 aa, Artificial Sequence
  Description of Artificial Sequence: Synthetic peptide
GSNTPAL

SEQ ID NO: 7059 - protein, 7 aa, Artificial Sequence
  Description of Artificial Sequence: Synthetic peptide
RSGEHSV

SEQ ID NO: 7060 - protein, 7 aa, Artificial Sequence
  Description of Artificial Sequence: Synthetic peptide
SATKISS

SEQ ID NO: 7061 - protein, 7 aa, Artificial Sequence
  Description of Artificial Sequence: Synthetic peptide
SSGQGNG

SEQ ID NO: 7062 - protein, 7 aa, Artificial Sequence
  Description of Artificial Sequence: Synthetic peptide
QVHDGPK

SEQ ID NO: 7063 - protein, 7 aa, Artificial Sequence
  Description of Artificial Sequence: Synthetic peptide
NSEVRTS

SEQ ID NO: 7064 - protein, 7 aa, Artificial Sequence
  Description of Artificial Sequence: Synthetic peptide
RVGSAQG

SEQ ID NO: 7065 - protein, 7 aa, Artificial Sequence
  Description of Artificial Sequence: Synthetic peptide
LPTDGAK

SEQ ID NO: 7066 - protein, 7 aa, Artificial Sequence
  Description of Artificial Sequence: Synthetic peptide
ESSPSKG

SEQ ID NO: 7067 - protein, 7 aa, Artificial Sequence
  Description of Artificial Sequence: Synthetic peptide
AAGTTGT

SEQ ID NO: 7068 - protein, 7 aa, Artificial Sequence
  Description of Artificial Sequence: Synthetic peptide
AGDSTKL

SEQ ID NO: 7069 - protein, 7 aa, Artificial Sequence
  Description of Artificial Sequence: Synthetic peptide
GSTTSAG

SEQ ID NO: 7070 - protein, 7 aa, Artificial Sequence
  Description of Artificial Sequence: Synthetic peptide
VSSSQTS

SEQ ID NO: 7071 - protein, 7 aa, Artificial Sequence
  Description of Artificial Sequence: Synthetic peptide
TNGAPSQ

SEQ ID NO: 7072 - protein, 7 aa, Artificial Sequence
  Description of Artificial Sequence: Synthetic peptide
MGGQSGT

SEQ ID NO: 7073 - protein, 7 aa, Artificial Sequence
  Description of Artificial Sequence: Synthetic peptide
GSSTPSQ

SEQ ID NO: 7074 - protein, 7 aa, Artificial Sequence
  Description of Artificial Sequence: Synthetic peptide
SQGHSPT

SEQ ID NO: 7075 - protein, 7 aa, Artificial Sequence
  Description of Artificial Sequence: Synthetic peptide
MTGGSVA

SEQ ID NO: 7076 - protein, 7 aa, Artificial Sequence
  Description of Artificial Sequence: Synthetic peptide
EVKTPAV

SEQ ID NO: 7077 - protein, 7 aa, Artificial Sequence
  Description of Artificial Sequence: Synthetic peptide
SVSAPSR

SEQ ID NO: 7078 - protein, 7 aa, Artificial Sequence
  Description of Artificial Sequence: Synthetic peptide
GKVGANN

SEQ ID NO: 7079 - protein, 7 aa, Artificial Sequence
  Description of Artificial Sequence: Synthetic peptide
RDGNSTT

SEQ ID NO: 7080 - protein, 7 aa, Artificial Sequence
  Description of Artificial Sequence: Synthetic peptide
ENLAPSK

SEQ ID NO: 7081 - protein, 7 aa, Artificial Sequence
  Description of Artificial Sequence: Synthetic peptide
GISDKPT

SEQ ID NO: 7082 - protein, 7 aa, Artificial Sequence
  Description of Artificial Sequence: Synthetic peptide
TSSKVSS

SEQ ID NO: 7083 - protein, 7 aa, Artificial Sequence
  Description of Artificial Sequence: Synthetic peptide
LSAGGAG

SEQ ID NO: 7084 - protein, 7 aa, Artificial Sequence
  Description of Artificial Sequence: Synthetic peptide
QQQGKGP

SEQ ID NO: 7085 - protein, 7 aa, Artificial Sequence
  Description of Artificial Sequence: Synthetic peptide
LPQQNSK

SEQ ID NO: 7086 - protein, 7 aa, Artificial Sequence
  Description of Artificial Sequence: Synthetic peptide
GSSSPRE

SEQ ID NO: 7087 - protein, 7 aa, Artificial Sequence
  Description of Artificial Sequence: Synthetic peptide
TDSPTTK

SEQ ID NO: 7088 - protein, 7 aa, Artificial Sequence
  Description of Artificial Sequence: Synthetic peptide
TGSENRV

SEQ ID NO: 7089 - protein, 7 aa, Artificial Sequence
  Description of Artificial Sequence: Synthetic peptide
HKATTAV

SEQ ID NO: 7090 - protein, 7 aa, Artificial Sequence
  Description of Artificial Sequence: Synthetic peptide
LDNGKPP

SEQ ID NO: 7091 - protein, 7 aa, Artificial Sequence
  Description of Artificial Sequence: Synthetic peptide
SESRSSI

SEQ ID NO: 7092 - protein, 7 aa, Artificial Sequence
  Description of Artificial Sequence: Synthetic peptide
ESGQPAK

SEQ ID NO: 7093 - protein, 7 aa, Artificial Sequence
  Description of Artificial Sequence: Synthetic peptide
NAASAGA

SEQ ID NO: 7094 - protein, 7 aa, Artificial Sequence
  Description of Artificial Sequence: Synthetic peptide
HSESKLA

SEQ ID NO: 7095 - protein, 7 aa, Artificial Sequence
  Description of Artificial Sequence: Synthetic peptide
TPGDKTM

SEQ ID NO: 7096 - protein, 7 aa, Artificial Sequence
  Description of Artificial Sequence: Synthetic peptide
GIADSRT

SEQ ID NO: 7097 - protein, 7 aa, Artificial Sequence
  Description of Artificial Sequence: Synthetic peptide
GVDGKAT

SEQ ID NO: 7098 - protein, 7 aa, Artificial Sequence
  Description of Artificial Sequence: Synthetic peptide
DNHKPAQ

SEQ ID NO: 7099 - protein, 7 aa, Artificial Sequence
  Description of Artificial Sequence: Synthetic peptide
PPGQPQT

SEQ ID NO: 7100 - protein, 7 aa, Artificial Sequence
  Description of Artificial Sequence: Synthetic peptide
NNTSHPA

SEQ ID NO: 7101 - protein, 7 aa, Artificial Sequence
  Description of Artificial Sequence: Synthetic peptide
TGTSPSR

SEQ ID NO: 7102 - protein, 7 aa, Artificial Sequence
  Description of Artificial Sequence: Synthetic peptide
TGSPPPS

SEQ ID NO: 7103 - protein, 7 aa, Artificial Sequence
  Description of Artificial Sequence: Synthetic peptide
TGLKENP

SEQ ID NO: 7104 - protein, 7 aa, Artificial Sequence
  Description of Artificial Sequence: Synthetic peptide
SRNPSNS

SEQ ID NO: 7105 - protein, 7 aa, Artificial Sequence
  Description of Artificial Sequence: Synthetic peptide
LRTATSN

SEQ ID NO: 7106 - protein, 7 aa, Artificial Sequence
  Description of Artificial Sequence: Synthetic peptide
GDTQRSA

SEQ ID NO: 7107 - protein, 7 aa, Artificial Sequence
  Description of Artificial Sequence: Synthetic peptide
TQGKTNT

SEQ ID NO: 7108 - protein, 7 aa, Artificial Sequence
  Description of Artificial Sequence: Synthetic peptide
GTRATPQ

SEQ ID NO: 7109 - protein, 7 aa, Artificial Sequence
  Description of Artificial Sequence: Synthetic peptide
QSTKAVE

SEQ ID NO: 7110 - protein, 7 aa, Artificial Sequence
  Description of Artificial Sequence: Synthetic peptide
SSNSPTA

SEQ ID NO: 7111 - protein, 7 aa, Artificial Sequence
  Description of Artificial Sequence: Synthetic peptide
SQGSSLT

SEQ ID NO: 7112 - protein, 7 aa, Artificial Sequence
  Description of Artificial Sequence: Synthetic peptide
SHNSQGG

SEQ ID NO: 7113 - protein, 7 aa, Artificial Sequence
  Description of Artificial Sequence: Synthetic peptide
QGSSTST

SEQ ID NO: 7114 - protein, 7 aa, Artificial Sequence
  Description of Artificial Sequence: Synthetic peptide
QGKDASM

SEQ ID NO: 7115 - protein, 7 aa, Artificial Sequence
  Description of Artificial Sequence: Synthetic peptide
RMGAPTG

SEQ ID NO: 7116 - protein, 7 aa, Artificial Sequence
  Description of Artificial Sequence: Synthetic peptide
LDGTPSH

SEQ ID NO: 7117 - protein, 7 aa, Artificial Sequence
  Description of Artificial Sequence: Synthetic peptide
TTDTGNH

SEQ ID NO: 7118 - protein, 7 aa, Artificial Sequence
  Description of Artificial Sequence: Synthetic peptide
MSGQSSR

SEQ ID NO: 7119 - protein, 7 aa, Artificial Sequence
  Description of Artificial Sequence: Synthetic peptide
RTGSKSD

SEQ ID NO: 7120 - protein, 7 aa, Artificial Sequence
  Description of Artificial Sequence: Synthetic peptide
NVVRDSK

SEQ ID NO: 7121 - protein, 7 aa, Artificial Sequence
  Description of Artificial Sequence: Synthetic peptide
HTGSASA

SEQ ID NO: 7122 - protein, 7 aa, Artificial Sequence
  Description of Artificial Sequence: Synthetic peptide
DFSQKGM

SEQ ID NO: 7123 - protein, 7 aa, Artificial Sequence
  Description of Artificial Sequence: Synthetic peptide
GVSSSPA

SEQ ID NO: 7124 - protein, 7 aa, Artificial Sequence
  Description of Artificial Sequence: Synthetic peptide
SGQNKES

SEQ ID NO: 7125 - protein, 7 aa, Artificial Sequence
  Description of Artificial Sequence: Synthetic peptide
DGSRSGS

SEQ ID NO: 7126 - protein, 7 aa, Artificial Sequence
  Description of Artificial Sequence: Synthetic peptide
NSQSPSA

SEQ ID NO: 7127 - protein, 7 aa, Artificial Sequence
  Description of Artificial Sequence: Synthetic peptide
LTQGGNS

SEQ ID NO: 7128 - protein, 7 aa, Artificial Sequence
  Description of Artificial Sequence: Synthetic peptide
ARTAQPV

SEQ ID NO: 7129 - protein, 7 aa, Artificial Sequence
  Description of Artificial Sequence: Synthetic peptide
SADRVAT

SEQ ID NO: 7130 - protein, 7 aa, Artificial Sequence
  Description of Artificial Sequence: Synthetic peptide
GGPSANQ

SEQ ID NO: 7131 - protein, 7 aa, Artificial Sequence
  Description of Artificial Sequence: Synthetic peptide
TGTATSL

SEQ ID NO: 7132 - protein, 7 aa, Artificial Sequence
  Description of Artificial Sequence: Synthetic peptide
EKGNGST

SEQ ID NO: 7133 - protein, 7 aa, Artificial Sequence
  Description of Artificial Sequence: Synthetic peptide
VANASGG

SEQ ID NO: 7134 - protein, 7 aa, Artificial Sequence
  Description of Artificial Sequence: Synthetic peptide
SNDSKRV

SEQ ID NO: 7135 - protein, 7 aa, Artificial Sequence
  Description of Artificial Sequence: Synthetic peptide
SGEAKTK

SEQ ID NO: 7136 - protein, 7 aa, Artificial Sequence
  Description of Artificial Sequence: Synthetic peptide
QAGTSVN

SEQ ID NO: 7137 - protein, 7 aa, Artificial Sequence
  Description of Artificial Sequence: Synthetic peptide
ELPGGTK

SEQ ID NO: 7138 - protein, 7 aa, Artificial Sequence
  Description of Artificial Sequence: Synthetic peptide
GLGGERN

SEQ ID NO: 7139 - protein, 7 aa, Artificial Sequence
  Description of Artificial Sequence: Synthetic peptide
VPSQVGG

SEQ ID NO: 7140 - protein, 7 aa, Artificial Sequence
  Description of Artificial Sequence: Synthetic peptide
YRDDKTI

SEQ ID NO: 7141 - protein, 7 aa, Artificial Sequence
  Description of Artificial Sequence: Synthetic peptide
NSLDTSK

SEQ ID NO: 7142 - protein, 7 aa, Artificial Sequence
  Description of Artificial Sequence: Synthetic peptide
AGTQSTA

SEQ ID NO: 7143 - protein, 7 aa, Artificial Sequence
  Description of Artificial Sequence: Synthetic peptide
STVKGSQ

SEQ ID NO: 7144 - protein, 7 aa, Artificial Sequence
  Description of Artificial Sequence: Synthetic peptide
QLKSPSS

SEQ ID NO: 7145 - protein, 7 aa, Artificial Sequence
  Description of Artificial Sequence: Synthetic peptide
ASQERVA

SEQ ID NO: 7146 - protein, 7 aa, Artificial Sequence
  Description of Artificial Sequence: Synthetic peptide
ARSQTSS

SEQ ID NO: 7147 - protein, 7 aa, Artificial Sequence
  Description of Artificial Sequence: Synthetic peptide
GSSQGLT

SEQ ID NO: 7148 - protein, 7 aa, Artificial Sequence
  Description of Artificial Sequence: Synthetic peptide
ASHLKPP

SEQ ID NO: 7149 - protein, 7 aa, Artificial Sequence
  Description of Artificial Sequence: Synthetic peptide
ASTSPVV

SEQ ID NO: 7150 - protein, 7 aa, Artificial Sequence
  Description of Artificial Sequence: Synthetic peptide
LNSAKNS

SEQ ID NO: 7151 - protein, 7 aa, Artificial Sequence
  Description of Artificial Sequence: Synthetic peptide
GPEGGNR

SEQ ID NO: 7152 - protein, 7 aa, Artificial Sequence
  Description of Artificial Sequence: Synthetic peptide
SKGSGTL

SEQ ID NO: 7153 - protein, 7 aa, Artificial Sequence
  Description of Artificial Sequence: Synthetic peptide
DSKTPAR

SEQ ID NO: 7154 - protein, 7 aa, Artificial Sequence
  Description of Artificial Sequence: Synthetic peptide
SKSTGSV

SEQ ID NO: 7155 - protein, 7 aa, Artificial Sequence
  Description of Artificial Sequence: Synthetic peptide
LSGDAAR

SEQ ID NO: 7156 - protein, 7 aa, Artificial Sequence
  Description of Artificial Sequence: Synthetic peptide
LGSPVST

SEQ ID NO: 7157 - protein, 7 aa, Artificial Sequence
  Description of Artificial Sequence: Synthetic peptide
QATSSST

SEQ ID NO: 7158 - protein, 7 aa, Artificial Sequence
  Description of Artificial Sequence: Synthetic peptide
TGSNKSH

SEQ ID NO: 7159 - protein, 7 aa, Artificial Sequence
  Description of Artificial Sequence: Synthetic peptide
ETKTANK

SEQ ID NO: 7160 - protein, 7 aa, Artificial Sequence
  Description of Artificial Sequence: Synthetic peptide
GMTTAAG

SEQ ID NO: 7161 - protein, 7 aa, Artificial Sequence
  Description of Artificial Sequence: Synthetic peptide
TSVASTQ

SEQ ID NO: 7162 - protein, 7 aa, Artificial Sequence
  Description of Artificial Sequence: Synthetic peptide
TVAEKLG

SEQ ID NO: 7163 - protein, 7 aa, Artificial Sequence
  Description of Artificial Sequence: Synthetic peptide
ITGSTPP

SEQ ID NO: 7164 - protein, 7 aa, Artificial Sequence
  Description of Artificial Sequence: Synthetic peptide
DIGASHA

SEQ ID NO: 7165 - protein, 7 aa, Artificial Sequence
  Description of Artificial Sequence: Synthetic peptide
SSTSSTH

SEQ ID NO: 7166 - protein, 7 aa, Artificial Sequence
  Description of Artificial Sequence: Synthetic peptide
NNTPTLS

SEQ ID NO: 7167 - protein, 7 aa, Artificial Sequence
  Description of Artificial Sequence: Synthetic peptide
SSSSTSK

SEQ ID NO: 7168 - protein, 7 aa, Artificial Sequence
  Description of Artificial Sequence: Synthetic peptide
STGHSPH

SEQ ID NO: 7169 - protein, 7 aa, Artificial Sequence
  Description of Artificial Sequence: Synthetic peptide
NSSGAHT

SEQ ID NO: 7170 - protein, 7 aa, Artificial Sequence
  Description of Artificial Sequence: Synthetic peptide
TTGTSTP

SEQ ID NO: 7171 - protein, 7 aa, Artificial Sequence
  Description of Artificial Sequence: Synthetic peptide
QVGSNHS

SEQ ID NO: 7172 - protein, 7 aa, Artificial Sequence
  Description of Artificial Sequence: Synthetic peptide
DSRGPSS

SEQ ID NO: 7173 - protein, 7 aa, Artificial Sequence
  Description of Artificial Sequence: Synthetic peptide
HGAGNAA

SEQ ID NO: 7174 - protein, 7 aa, Artificial Sequence
  Description of Artificial Sequence: Synthetic peptide
VGSSTVM

SEQ ID NO: 7175 - protein, 7 aa, Artificial Sequence
  Description of Artificial Sequence: Synthetic peptide
EARSAHG

SEQ ID NO: 7176 - protein, 7 aa, Artificial Sequence
  Description of Artificial Sequence: Synthetic peptide
ATGTGNG

SEQ ID NO: 7177 - protein, 7 aa, Artificial Sequence
  Description of Artificial Sequence: Synthetic peptide
GSKANTL

SEQ ID NO: 7178 - protein, 7 aa, Artificial Sequence
  Description of Artificial Sequence: Synthetic peptide
TSGTGNQ

SEQ ID NO: 7179 - protein, 7 aa, Artificial Sequence
  Description of Artificial Sequence: Synthetic peptide
DRNGSQG

SEQ ID NO: 7180 - protein, 7 aa, Artificial Sequence
  Description of Artificial Sequence: Synthetic peptide
QQVNPKL

SEQ ID NO: 7181 - protein, 7 aa, Artificial Sequence
  Description of Artificial Sequence: Synthetic peptide
NGSLKPT

SEQ ID NO: 7182 - protein, 7 aa, Artificial Sequence
  Description of Artificial Sequence: Synthetic peptide
RNGSPNV

SEQ ID NO: 7183 - protein, 7 aa, Artificial Sequence
  Description of Artificial Sequence: Synthetic peptide
ESNKGIG

SEQ ID NO: 7184 - protein, 7 aa, Artificial Sequence
  Description of Artificial Sequence: Synthetic peptide
DTSPRNN

SEQ ID NO: 7185 - protein, 7 aa, Artificial Sequence
  Description of Artificial Sequence: Synthetic peptide
AGDSSRG

SEQ ID NO: 7186 - protein, 7 aa, Artificial Sequence
  Description of Artificial Sequence: Synthetic peptide
VGSREKG

SEQ ID NO: 7187 - protein, 7 aa, Artificial Sequence
  Description of Artificial Sequence: Synthetic peptide
SPSSKNS

SEQ ID NO: 7188 - protein, 7 aa, Artificial Sequence
  Description of Artificial Sequence: Synthetic peptide
RSQGASM

SEQ ID NO: 7189 - protein, 7 aa, Artificial Sequence
  Description of Artificial Sequence: Synthetic peptide
GTTPTSR

SEQ ID NO: 7190 - protein, 7 aa, Artificial Sequence
  Description of Artificial Sequence: Synthetic peptide
DGRVKNG

SEQ ID NO: 7191 - protein, 7 aa, Artificial Sequence
  Description of Artificial Sequence: Synthetic peptide
TQAVNGG

SEQ ID NO: 7192 - protein, 7 aa, Artificial Sequence
  Description of Artificial Sequence: Synthetic peptide
EQRATAQ

SEQ ID NO: 7193 - protein, 7 aa, Artificial Sequence
  Description of Artificial Sequence: Synthetic peptide
DLSGKSL

SEQ ID NO: 7194 - protein, 7 aa, Artificial Sequence
  Description of Artificial Sequence: Synthetic peptide
NTRSSTV

SEQ ID NO: 7195 - protein, 7 aa, Artificial Sequence
  Description of Artificial Sequence: Synthetic peptide
APSASPN

SEQ ID NO: 7196 - protein, 7 aa, Artificial Sequence
  Description of Artificial Sequence: Synthetic peptide
GSSKSPE

SEQ ID NO: 7197 - protein, 7 aa, Artificial Sequence
  Description of Artificial Sequence: Synthetic peptide
NGSDAKT

SEQ ID NO: 7198 - protein, 7 aa, Artificial Sequence
  Description of Artificial Sequence: Synthetic peptide
NSANQNH

SEQ ID NO: 7199 - protein, 7 aa, Artificial Sequence
  Description of Artificial Sequence: Synthetic peptide
SGGAPAV

SEQ ID NO: 7200 - protein, 7 aa, Artificial Sequence
  Description of Artificial Sequence: Synthetic peptide
LTSPAGA

SEQ ID NO: 7201 - protein, 7 aa, Artificial Sequence
  Description of Artificial Sequence: Synthetic peptide
DHSKDHS

SEQ ID NO: 7202 - protein, 7 aa, Artificial Sequence
  Description of Artificial Sequence: Synthetic peptide
ESGKPGL

SEQ ID NO: 7203 - protein, 7 aa, Artificial Sequence
  Description of Artificial Sequence: Synthetic peptide
VRDNSSQ

SEQ ID NO: 7204 - protein, 7 aa, Artificial Sequence
  Description of Artificial Sequence: Synthetic peptide
TQQSPSM

SEQ ID NO: 7205 - protein, 7 aa, Artificial Sequence
  Description of Artificial Sequence: Synthetic peptide
NGGSKSL

SEQ ID NO: 7206 - protein, 7 aa, Artificial Sequence
  Description of Artificial Sequence: Synthetic peptide
SPVSGGH

SEQ ID NO: 7207 - protein, 7 aa, Artificial Sequence
  Description of Artificial Sequence: Synthetic peptide
GRDDTRV

SEQ ID NO: 7208 - protein, 7 aa, Artificial Sequence
  Description of Artificial Sequence: Synthetic peptide
GMNSKLT

SEQ ID NO: 7209 - protein, 7 aa, Artificial Sequence
  Description of Artificial Sequence: Synthetic peptide
SGASATS

SEQ ID NO: 7210 - protein, 7 aa, Artificial Sequence
  Description of Artificial Sequence: Synthetic peptide
QGTMSNG

SEQ ID NO: 7211 - protein, 7 aa, Artificial Sequence
  Description of Artificial Sequence: Synthetic peptide
GGGTPLI

SEQ ID NO: 7212 - protein, 7 aa, Artificial Sequence
  Description of Artificial Sequence: Synthetic peptide
SQADSKQ

SEQ ID NO: 7213 - protein, 7 aa, Artificial Sequence
  Description of Artificial Sequence: Synthetic peptide
STSATNT

SEQ ID NO: 7214 - protein, 7 aa, Artificial Sequence
  Description of Artificial Sequence: Synthetic peptide
NSGEHAS

SEQ ID NO: 7215 - protein, 7 aa, Artificial Sequence
  Description of Artificial Sequence: Synthetic peptide
GPQPSKA

SEQ ID NO: 7216 - protein, 7 aa, Artificial Sequence
  Description of Artificial Sequence: Synthetic peptide
VNGTSKV

SEQ ID NO: 7217 - protein, 7 aa, Artificial Sequence
  Description of Artificial Sequence: Synthetic peptide
DVAKTSS

SEQ ID NO: 7218 - protein, 7 aa, Artificial Sequence
  Description of Artificial Sequence: Synthetic peptide
GTSPPGT

SEQ ID NO: 7219 - protein, 7 aa, Artificial Sequence
  Description of Artificial Sequence: Synthetic peptide
NPSPANV

SEQ ID NO: 7220 - protein, 7 aa, Artificial Sequence
  Description of Artificial Sequence: Synthetic peptide
QHTSTNA

SEQ ID NO: 7221 - protein, 7 aa, Artificial Sequence
  Description of Artificial Sequence: Synthetic peptide
VSSSTNS

SEQ ID NO: 7222 - protein, 7 aa, Artificial Sequence
  Description of Artificial Sequence: Synthetic peptide
LTSKGPS

SEQ ID NO: 7223 - protein, 7 aa, Artificial Sequence
  Description of Artificial Sequence: Synthetic peptide
RSNGSAG

SEQ ID NO: 7224 - protein, 7 aa, Artificial Sequence
  Description of Artificial Sequence: Synthetic peptide
SSNTSNV

SEQ ID NO: 7225 - protein, 7 aa, Artificial Sequence
  Description of Artificial Sequence: Synthetic peptide
NSKNNKE

SEQ ID NO: 7226 - protein, 7 aa, Artificial Sequence
  Description of Artificial Sequence: Synthetic peptide
NSQGNLG

SEQ ID NO: 7227 - protein, 7 aa, Artificial Sequence
  Description of Artificial Sequence: Synthetic peptide
NAGSHSQ

SEQ ID NO: 7228 - protein, 7 aa, Artificial Sequence
  Description of Artificial Sequence: Synthetic peptide
KVGQDRL

SEQ ID NO: 7229 - protein, 7 aa, Artificial Sequence
  Description of Artificial Sequence: Synthetic peptide
NGVASAT

SEQ ID NO: 7230 - protein, 7 aa, Artificial Sequence
  Description of Artificial Sequence: Synthetic peptide
TRSETSQ

SEQ ID NO: 7231 - protein, 7 aa, Artificial Sequence
  Description of Artificial Sequence: Synthetic peptide
TQVPAPS

SEQ ID NO: 7232 - protein, 7 aa, Artificial Sequence
  Description of Artificial Sequence: Synthetic peptide
TGKGSPN

SEQ ID NO: 7233 - protein, 7 aa, Artificial Sequence
  Description of Artificial Sequence: Synthetic peptide
SRVSSGT

SEQ ID NO: 7234 - protein, 7 aa, Artificial Sequence
  Description of Artificial Sequence: Synthetic peptide
IAGNTST

SEQ ID NO: 7235 - protein, 7 aa, Artificial Sequence
  Description of Artificial Sequence: Synthetic peptide
QASASSR

SEQ ID NO: 7236 - protein, 7 aa, Artificial Sequence
  Description of Artificial Sequence: Synthetic peptide
QGGSPPG

SEQ ID NO: 7237 - protein, 7 aa, Artificial Sequence
  Description of Artificial Sequence: Synthetic peptide
LMDQKSA

SEQ ID NO: 7238 - protein, 7 aa, Artificial Sequence
  Description of Artificial Sequence: Synthetic peptide
EGTNLRS

SEQ ID NO: 7239 - protein, 7 aa, Artificial Sequence
  Description of Artificial Sequence: Synthetic peptide
GKETRDK

SEQ ID NO: 7240 - protein, 7 aa, Artificial Sequence
  Description of Artificial Sequence: Synthetic peptide
GPGGRND

SEQ ID NO: 7241 - protein, 7 aa, Artificial Sequence
  Description of Artificial Sequence: Synthetic peptide
GNTRDSS

SEQ ID NO: 7242 - protein, 7 aa, Artificial Sequence
  Description of Artificial Sequence: Synthetic peptide
GSNSGAT

SEQ ID NO: 7243 - protein, 7 aa, Artificial Sequence
  Description of Artificial Sequence: Synthetic peptide
VSNKVQE

SEQ ID NO: 7244 - protein, 7 aa, Artificial Sequence
  Description of Artificial Sequence: Synthetic peptide
VQQSASR

SEQ ID NO: 7245 - protein, 7 aa, Artificial Sequence
  Description of Artificial Sequence: Synthetic peptide
FAASENR

SEQ ID NO: 7246 - protein, 7 aa, Artificial Sequence
  Description of Artificial Sequence: Synthetic peptide
QPKSSST

SEQ ID NO: 7247 - protein, 7 aa, Artificial Sequence
  Description of Artificial Sequence: Synthetic peptide
SSASNHT

SEQ ID NO: 7248 - protein, 7 aa, Artificial Sequence
  Description of Artificial Sequence: Synthetic peptide
DSVRSSG

SEQ ID NO: 7249 - protein, 7 aa, Artificial Sequence
  Description of Artificial Sequence: Synthetic peptide
NAVTTPN

SEQ ID NO: 7250 - protein, 7 aa, Artificial Sequence
  Description of Artificial Sequence: Synthetic peptide
VTAASNS

SEQ ID NO: 7251 - protein, 7 aa, Artificial Sequence
  Description of Artificial Sequence: Synthetic peptide
EPSSSKT

SEQ ID NO: 7252 - protein, 7 aa, Artificial Sequence
  Description of Artificial Sequence: Synthetic peptide
TPTNSKV

SEQ ID NO: 7253 - protein, 7 aa, Artificial Sequence
  Description of Artificial Sequence: Synthetic peptide
SGPTTVS

SEQ ID NO: 7254 - protein, 7 aa, Artificial Sequence
  Description of Artificial Sequence: Synthetic peptide
AMTSGSK

SEQ ID NO: 7255 - protein, 7 aa, Artificial Sequence
  Description of Artificial Sequence: Synthetic peptide
VNASSVQ

SEQ ID NO: 7256 - protein, 7 aa, Artificial Sequence
  Description of Artificial Sequence: Synthetic peptide
DSASSRG

SEQ ID NO: 7257 - protein, 7 aa, Artificial Sequence
  Description of Artificial Sequence: Synthetic peptide
GTGDRER

SEQ ID NO: 7258 - protein, 7 aa, Artificial Sequence
  Description of Artificial Sequence: Synthetic peptide
GSGGHNS

SEQ ID NO: 7259 - protein, 7 aa, Artificial Sequence
  Description of Artificial Sequence: Synthetic peptide
LTQGQTK

SEQ ID NO: 7260 - protein, 7 aa, Artificial Sequence
  Description of Artificial Sequence: Synthetic peptide
GGVESHQ

SEQ ID NO: 7261 - protein, 7 aa, Artificial Sequence
  Description of Artificial Sequence: Synthetic peptide
FGAGTSS

SEQ ID NO: 7262 - protein, 7 aa, Artificial Sequence
  Description of Artificial Sequence: Synthetic peptide
QRNSGNG

SEQ ID NO: 7263 - protein, 7 aa, Artificial Sequence
  Description of Artificial Sequence: Synthetic peptide
DTVTGKQ

SEQ ID NO: 7264 - protein, 7 aa, Artificial Sequence
  Description of Artificial Sequence: Synthetic peptide
AGSSTAA

SEQ ID NO: 7265 - protein, 7 aa, Artificial Sequence
  Description of Artificial Sequence: Synthetic peptide
RSENTPS

SEQ ID NO: 7266 - protein, 7 aa, Artificial Sequence
  Description of Artificial Sequence: Synthetic peptide
SFDNKGK

SEQ ID NO: 7267 - protein, 7 aa, Artificial Sequence
  Description of Artificial Sequence: Synthetic peptide
ERGTPGG

SEQ ID NO: 7268 - protein, 7 aa, Artificial Sequence
  Description of Artificial Sequence: Synthetic peptide
VGTSTIV

SEQ ID NO: 7269 - protein, 7 aa, Artificial Sequence
  Description of Artificial Sequence: Synthetic peptide
SGGKGAA

SEQ ID NO: 7270 - protein, 7 aa, Artificial Sequence
  Description of Artificial Sequence: Synthetic peptide
QSRPTVA

SEQ ID NO: 7271 - protein, 7 aa, Artificial Sequence
  Description of Artificial Sequence: Synthetic peptide
AGESAHS

SEQ ID NO: 7272 - protein, 7 aa, Artificial Sequence
  Description of Artificial Sequence: Synthetic peptide
STSTSSL

SEQ ID NO: 7273 - protein, 7 aa, Artificial Sequence
  Description of Artificial Sequence: Synthetic peptide
KPDAPGV

SEQ ID NO: 7274 - protein, 7 aa, Artificial Sequence
  Description of Artificial Sequence: Synthetic peptide
SSSTTAG

SEQ ID NO: 7275 - protein, 7 aa, Artificial Sequence
  Description of Artificial Sequence: Synthetic peptide
GRETPSL

SEQ ID NO: 7276 - protein, 7 aa, Artificial Sequence
  Description of Artificial Sequence: Synthetic peptide
SADSQKG

SEQ ID NO: 7277 - protein, 7 aa, Artificial Sequence
  Description of Artificial Sequence: Synthetic peptide
LGSGSGA

SEQ ID NO: 7278 - protein, 7 aa, Artificial Sequence
  Description of Artificial Sequence: Synthetic peptide
SNSERTS

SEQ ID NO: 7279 - protein, 7 aa, Artificial Sequence
  Description of Artificial Sequence: Synthetic peptide
SSPPSPS

SEQ ID NO: 7280 - protein, 7 aa, Artificial Sequence
  Description of Artificial Sequence: Synthetic peptide
DRAGTHN

SEQ ID NO: 7281 - protein, 7 aa, Artificial Sequence
  Description of Artificial Sequence: Synthetic peptide
LGTPSNG

SEQ ID NO: 7282 - protein, 7 aa, Artificial Sequence
  Description of Artificial Sequence: Synthetic peptide
EGSNKVV

SEQ ID NO: 7283 - protein, 7 aa, Artificial Sequence
  Description of Artificial Sequence: Synthetic peptide
GTSATAL

SEQ ID NO: 7284 - protein, 7 aa, Artificial Sequence
  Description of Artificial Sequence: Synthetic peptide
KQVSSPV

SEQ ID NO: 7285 - protein, 7 aa, Artificial Sequence
  Description of Artificial Sequence: Synthetic peptide
DATSSPQ

SEQ ID NO: 7286 - protein, 7 aa, Artificial Sequence
  Description of Artificial Sequence: Synthetic peptide
GQEHGVS

SEQ ID NO: 7287 - protein, 7 aa, Artificial Sequence
  Description of Artificial Sequence: Synthetic peptide
GVNSKAT

SEQ ID NO: 7288 - protein, 7 aa, Artificial Sequence
  Description of Artificial Sequence: Synthetic peptide
SPASTTK

SEQ ID NO: 7289 - protein, 7 aa, Artificial Sequence
  Description of Artificial Sequence: Synthetic peptide
ESTKPRD

SEQ ID NO: 7290 - protein, 7 aa, Artificial Sequence
  Description of Artificial Sequence: Synthetic peptide
NPSRESS

SEQ ID NO: 7291 - protein, 7 aa, Artificial Sequence
  Description of Artificial Sequence: Synthetic peptide
SESPKAG

SEQ ID NO: 7292 - protein, 7 aa, Artificial Sequence
  Description of Artificial Sequence: Synthetic peptide
NQSGDRS

SEQ ID NO: 7293 - protein, 7 aa, Artificial Sequence
  Description of Artificial Sequence: Synthetic peptide
AQGSSKT

SEQ ID NO: 7294 - protein, 7 aa, Artificial Sequence
  Description of Artificial Sequence: Synthetic peptide
RVDASNV

SEQ ID NO: 7295 - protein, 7 aa, Artificial Sequence
  Description of Artificial Sequence: Synthetic peptide
SKNGLQG

SEQ ID NO: 7296 - protein, 7 aa, Artificial Sequence
  Description of Artificial Sequence: Synthetic peptide
SDDSSRH

SEQ ID NO: 7297 - protein, 7 aa, Artificial Sequence
  Description of Artificial Sequence: Synthetic peptide
QHATSAG

SEQ ID NO: 7298 - protein, 7 aa, Artificial Sequence
  Description of Artificial Sequence: Synthetic peptide
DLGSHNR

SEQ ID NO: 7299 - protein, 7 aa, Artificial Sequence
  Description of Artificial Sequence: Synthetic peptide
APGGKMV

SEQ ID NO: 7300 - protein, 7 aa, Artificial Sequence
  Description of Artificial Sequence: Synthetic peptide
GSESRSG

SEQ ID NO: 7301 - protein, 7 aa, Artificial Sequence
  Description of Artificial Sequence: Synthetic peptide
VASSSTV

SEQ ID NO: 7302 - protein, 7 aa, Artificial Sequence
  Description of Artificial Sequence: Synthetic peptide
SGTSKAE

SEQ ID NO: 7303 - protein, 7 aa, Artificial Sequence
  Description of Artificial Sequence: Synthetic peptide
LGKDQIQ

SEQ ID NO: 7304 - protein, 7 aa, Artificial Sequence
  Description of Artificial Sequence: Synthetic peptide
VTSSSSQ

SEQ ID NO: 7305 - protein, 7 aa, Artificial Sequence
  Description of Artificial Sequence: Synthetic peptide
NKNQAAN

SEQ ID NO: 7306 - protein, 7 aa, Artificial Sequence
  Description of Artificial Sequence: Synthetic peptide
QGQQHSQ

SEQ ID NO: 7307 - protein, 7 aa, Artificial Sequence
  Description of Artificial Sequence: Synthetic peptide
LSDPQRG

SEQ ID NO: 7308 - protein, 7 aa, Artificial Sequence
  Description of Artificial Sequence: Synthetic peptide
GEKPGGN

SEQ ID NO: 7309 - protein, 7 aa, Artificial Sequence
  Description of Artificial Sequence: Synthetic peptide
GDISSKN

SEQ ID NO: 7310 - protein, 7 aa, Artificial Sequence
  Description of Artificial Sequence: Synthetic peptide
SSSTHSL

SEQ ID NO: 7311 - protein, 7 aa, Artificial Sequence
  Description of Artificial Sequence: Synthetic peptide
SSGNGHA

SEQ ID NO: 7312 - protein, 7 aa, Artificial Sequence
  Description of Artificial Sequence: Synthetic peptide
GDSSPKT

SEQ ID NO: 7313 - protein, 7 aa, Artificial Sequence
  Description of Artificial Sequence: Synthetic peptide
AVNSSAG

SEQ ID NO: 7314 - protein, 7 aa, Artificial Sequence
  Description of Artificial Sequence: Synthetic peptide
TTGSSST

SEQ ID NO: 7315 - protein, 7 aa, Artificial Sequence
  Description of Artificial Sequence: Synthetic peptide
SDGQTNR

SEQ ID NO: 7316 - protein, 7 aa, Artificial Sequence
  Description of Artificial Sequence: Synthetic peptide
SSSNSSQ

SEQ ID NO: 7317 - protein, 7 aa, Artificial Sequence
  Description of Artificial Sequence: Synthetic peptide
SSTPNGK

SEQ ID NO: 7318 - protein, 7 aa, Artificial Sequence
  Description of Artificial Sequence: Synthetic peptide
HPDSTGK

SEQ ID NO: 7319 - protein, 7 aa, Artificial Sequence
  Description of Artificial Sequence: Synthetic peptide
DSTKTSV

SEQ ID NO: 7320 - protein, 7 aa, Artificial Sequence
  Description of Artificial Sequence: Synthetic peptide
QVSAAAG

SEQ ID NO: 7321 - protein, 7 aa, Artificial Sequence
  Description of Artificial Sequence: Synthetic peptide
GDIKPSS

SEQ ID NO: 7322 - protein, 7 aa, Artificial Sequence
  Description of Artificial Sequence: Synthetic peptide
KTGNVSS

SEQ ID NO: 7323 - protein, 7 aa, Artificial Sequence
  Description of Artificial Sequence: Synthetic peptide
SSDSKTS

SEQ ID NO: 7324 - protein, 7 aa, Artificial Sequence
  Description of Artificial Sequence: Synthetic peptide
GTEPSHK

SEQ ID NO: 7325 - protein, 7 aa, Artificial Sequence
  Description of Artificial Sequence: Synthetic peptide
TTEKAQS

SEQ ID NO: 7326 - protein, 7 aa, Artificial Sequence
  Description of Artificial Sequence: Synthetic peptide
EKRDAVA

SEQ ID NO: 7327 - protein, 7 aa, Artificial Sequence
  Description of Artificial Sequence: Synthetic peptide
LGTSTSS

SEQ ID NO: 7328 - protein, 7 aa, Artificial Sequence
  Description of Artificial Sequence: Synthetic peptide
VQGSSAT

SEQ ID NO: 7329 - protein, 7 aa, Artificial Sequence
  Description of Artificial Sequence: Synthetic peptide
NLNLPKG

SEQ ID NO: 7330 - protein, 7 aa, Artificial Sequence
  Description of Artificial Sequence: Synthetic peptide
TVTSSRD

SEQ ID NO: 7331 - protein, 7 aa, Artificial Sequence
  Description of Artificial Sequence: Synthetic peptide
SLTSPAE

SEQ ID NO: 7332 - protein, 7 aa, Artificial Sequence
  Description of Artificial Sequence: Synthetic peptide
QRSQTSA

SEQ ID NO: 7333 - protein, 7 aa, Artificial Sequence
  Description of Artificial Sequence: Synthetic peptide
GTQSVPA

SEQ ID NO: 7334 - protein, 7 aa, Artificial Sequence
  Description of Artificial Sequence: Synthetic peptide
VASSSGG

SEQ ID NO: 7335 - protein, 7 aa, Artificial Sequence
  Description of Artificial Sequence: Synthetic peptide
SNTQPVS

SEQ ID NO: 7336 - protein, 7 aa, Artificial Sequence
  Description of Artificial Sequence: Synthetic peptide
DSKPSAL

SEQ ID NO: 7337 - protein, 7 aa, Artificial Sequence
  Description of Artificial Sequence: Synthetic peptide
GETSKVV

SEQ ID NO: 7338 - protein, 7 aa, Artificial Sequence
  Description of Artificial Sequence: Synthetic peptide
SGQASTH

SEQ ID NO: 7339 - protein, 7 aa, Artificial Sequence
  Description of Artificial Sequence: Synthetic peptide
DSHKTST

SEQ ID NO: 7340 - protein, 7 aa, Artificial Sequence
  Description of Artificial Sequence: Synthetic peptide
SVDKSTR

SEQ ID NO: 7341 - protein, 7 aa, Artificial Sequence
  Description of Artificial Sequence: Synthetic peptide
EVSPAAK

SEQ ID NO: 7342 - protein, 7 aa, Artificial Sequence
  Description of Artificial Sequence: Synthetic peptide
KDSGGHK

SEQ ID NO: 7343 - protein, 7 aa, Artificial Sequence
  Description of Artificial Sequence: Synthetic peptide
NKDTRPE

SEQ ID NO: 7344 - protein, 7 aa, Artificial Sequence
  Description of Artificial Sequence: Synthetic peptide
NKLGSAG

SEQ ID NO: 7345 - protein, 7 aa, Artificial Sequence
  Description of Artificial Sequence: Synthetic peptide
TTSAVSS

SEQ ID NO: 7346 - protein, 7 aa, Artificial Sequence
  Description of Artificial Sequence: Synthetic peptide
SGVGTHT

SEQ ID NO: 7347 - protein, 7 aa, Artificial Sequence
  Description of Artificial Sequence: Synthetic peptide
APTSGGQ

SEQ ID NO: 7348 - protein, 7 aa, Artificial Sequence
  Description of Artificial Sequence: Synthetic peptide
GEVKPSA

SEQ ID NO: 7349 - protein, 7 aa, Artificial Sequence
  Description of Artificial Sequence: Synthetic peptide
VSKPGGN

SEQ ID NO: 7350 - protein, 7 aa, Artificial Sequence
  Description of Artificial Sequence: Synthetic peptide
SSTKDQV

SEQ ID NO: 7351 - protein, 7 aa, Artificial Sequence
  Description of Artificial Sequence: Synthetic peptide
NGSNGQN

SEQ ID NO: 7352 - protein, 7 aa, Artificial Sequence
  Description of Artificial Sequence: Synthetic peptide
LPDAKGT

SEQ ID NO: 7353 - protein, 7 aa, Artificial Sequence
  Description of Artificial Sequence: Synthetic peptide
QSGTHSS

SEQ ID NO: 7354 - protein, 7 aa, Artificial Sequence
  Description of Artificial Sequence: Synthetic peptide
STNSSRD

SEQ ID NO: 7355 - protein, 7 aa, Artificial Sequence
  Description of Artificial Sequence: Synthetic peptide
TSNPTSG

SEQ ID NO: 7356 - protein, 7 aa, Artificial Sequence
  Description of Artificial Sequence: Synthetic peptide
VPVDGKQ

SEQ ID NO: 7357 - protein, 7 aa, Artificial Sequence
  Description of Artificial Sequence: Synthetic peptide
TATSKPD

SEQ ID NO: 7358 - protein, 7 aa, Artificial Sequence
  Description of Artificial Sequence: Synthetic peptide
DSTPATQ

SEQ ID NO: 7359 - protein, 7 aa, Artificial Sequence
  Description of Artificial Sequence: Synthetic peptide
DGASRAQ

SEQ ID NO: 7360 - protein, 7 aa, Artificial Sequence
  Description of Artificial Sequence: Synthetic peptide
SPQNTPS

SEQ ID NO: 7361 - protein, 7 aa, Artificial Sequence
  Description of Artificial Sequence: Synthetic peptide
RSNSPVE

SEQ ID NO: 7362 - protein, 7 aa, Artificial Sequence
  Description of Artificial Sequence: Synthetic peptide
KNGDRAS

SEQ ID NO: 7363 - protein, 7 aa, Artificial Sequence
  Description of Artificial Sequence: Synthetic peptide
NVEGSRT

SEQ ID NO: 7364 - protein, 7 aa, Artificial Sequence
  Description of Artificial Sequence: Synthetic peptide
SENRSPA

SEQ ID NO: 7365 - protein, 7 aa, Artificial Sequence
  Description of Artificial Sequence: Synthetic peptide
SRQAGSG

SEQ ID NO: 7366 - protein, 7 aa, Artificial Sequence
  Description of Artificial Sequence: Synthetic peptide
SGESKRG

SEQ ID NO: 7367 - protein, 7 aa, Artificial Sequence
  Description of Artificial Sequence: Synthetic peptide
DSNSRSI

SEQ ID NO: 7368 - protein, 7 aa, Artificial Sequence
  Description of Artificial Sequence: Synthetic peptide
SGANNSS

SEQ ID NO: 7369 - protein, 7 aa, Artificial Sequence
  Description of Artificial Sequence: Synthetic peptide
VGGPAPN

SEQ ID NO: 7370 - protein, 7 aa, Artificial Sequence
  Description of Artificial Sequence: Synthetic peptide
NGTQTSR

SEQ ID NO: 7371 - protein, 7 aa, Artificial Sequence
  Description of Artificial Sequence: Synthetic peptide
SADSNRS

SEQ ID NO: 7372 - protein, 7 aa, Artificial Sequence
  Description of Artificial Sequence: Synthetic peptide
GQNKTNH

SEQ ID NO: 7373 - protein, 7 aa, Artificial Sequence
  Description of Artificial Sequence: Synthetic peptide
NSGNENR

SEQ ID NO: 7374 - protein, 7 aa, Artificial Sequence
  Description of Artificial Sequence: Synthetic peptide
SSAGATS

SEQ ID NO: 7375 - protein, 7 aa, Artificial Sequence
  Description of Artificial Sequence: Synthetic peptide
SPVESSR

SEQ ID NO: 7376 - protein, 7 aa, Artificial Sequence
  Description of Artificial Sequence: Synthetic peptide
AGSREST

SEQ ID NO: 7377 - protein, 7 aa, Artificial Sequence
  Description of Artificial Sequence: Synthetic peptide
SQPPTGK

SEQ ID NO: 7378 - protein, 7 aa, Artificial Sequence
  Description of Artificial Sequence: Synthetic peptide
SAGSSIS

SEQ ID NO: 7379 - protein, 7 aa, Artificial Sequence
  Description of Artificial Sequence: Synthetic peptide
SGQSDKN

SEQ ID NO: 7380 - protein, 7 aa, Artificial Sequence
  Description of Artificial Sequence: Synthetic peptide
THTATSS

SEQ ID NO: 7381 - protein, 7 aa, Artificial Sequence
  Description of Artificial Sequence: Synthetic peptide
STAQRSE

SEQ ID NO: 7382 - protein, 7 aa, Artificial Sequence
  Description of Artificial Sequence: Synthetic peptide
GKETQSV

SEQ ID NO: 7383 - protein, 7 aa, Artificial Sequence
  Description of Artificial Sequence: Synthetic peptide
VSGEHSQ

SEQ ID NO: 7384 - protein, 7 aa, Artificial Sequence
  Description of Artificial Sequence: Synthetic peptide
SYGKTGS

SEQ ID NO: 7385 - protein, 7 aa, Artificial Sequence
  Description of Artificial Sequence: Synthetic peptide
QQTSDHR

SEQ ID NO: 7386 - protein, 7 aa, Artificial Sequence
  Description of Artificial Sequence: Synthetic peptide
TRGNPGT

SEQ ID NO: 7387 - protein, 7 aa, Artificial Sequence
  Description of Artificial Sequence: Synthetic peptide
QTSGKSN

SEQ ID NO: 7388 - protein, 7 aa, Artificial Sequence
  Description of Artificial Sequence: Synthetic peptide
MGNNTPS

SEQ ID NO: 7389 - protein, 7 aa, Artificial Sequence
  Description of Artificial Sequence: Synthetic peptide
HGVSTSN

SEQ ID NO: 7390 - protein, 7 aa, Artificial Sequence
  Description of Artificial Sequence: Synthetic peptide
QGHTNGK

SEQ ID NO: 7391 - protein, 7 aa, Artificial Sequence
  Description of Artificial Sequence: Synthetic peptide
VVTGSSK

SEQ ID NO: 7392 - protein, 7 aa, Artificial Sequence
  Description of Artificial Sequence: Synthetic peptide
SADRSGK

SEQ ID NO: 7393 - protein, 7 aa, Artificial Sequence
  Description of Artificial Sequence: Synthetic peptide
CDAKNTG

SEQ ID NO: 7394 - protein, 7 aa, Artificial Sequence
  Description of Artificial Sequence: Synthetic peptide
GTTKEHY

SEQ ID NO: 7395 - protein, 7 aa, Artificial Sequence
  Description of Artificial Sequence: Synthetic peptide
MPSKVAS

SEQ ID NO: 7396 - protein, 7 aa, Artificial Sequence
  Description of Artificial Sequence: Synthetic peptide
NGSGQKL

SEQ ID NO: 7397 - protein, 7 aa, Artificial Sequence
  Description of Artificial Sequence: Synthetic peptide
SGLTDKK

SEQ ID NO: 7398 - protein, 7 aa, Artificial Sequence
  Description of Artificial Sequence: Synthetic peptide
ENVSGIK

SEQ ID NO: 7399 - protein, 7 aa, Artificial Sequence
  Description of Artificial Sequence: Synthetic peptide
AGSSGKT

SEQ ID NO: 7400 - protein, 7 aa, Artificial Sequence
  Description of Artificial Sequence: Synthetic peptide
GMKQTST

SEQ ID NO: 7401 - protein, 7 aa, Artificial Sequence
  Description of Artificial Sequence: Synthetic peptide
SAAQQGN

SEQ ID NO: 7402 - protein, 7 aa, Artificial Sequence
  Description of Artificial Sequence: Synthetic peptide
SGDQHSR

SEQ ID NO: 7403 - protein, 7 aa, Artificial Sequence
  Description of Artificial Sequence: Synthetic peptide
VSNSKSE

SEQ ID NO: 7404 - protein, 7 aa, Artificial Sequence
  Description of Artificial Sequence: Synthetic peptide
TMSPSGH

SEQ ID NO: 7405 - protein, 7 aa, Artificial Sequence
  Description of Artificial Sequence: Synthetic peptide
SLTKGVG

SEQ ID NO: 7406 - protein, 7 aa, Artificial Sequence
  Description of Artificial Sequence: Synthetic peptide
SGTGEPR

SEQ ID NO: 7407 - protein, 7 aa, Artificial Sequence
  Description of Artificial Sequence: Synthetic peptide
HGTSPSM

SEQ ID NO: 7408 - protein, 7 aa, Artificial Sequence
  Description of Artificial Sequence: Synthetic peptide
GAKGSNL

SEQ ID NO: 7409 - protein, 7 aa, Artificial Sequence
  Description of Artificial Sequence: Synthetic peptide
GSGSSAQ

SEQ ID NO: 7410 - protein, 7 aa, Artificial Sequence
  Description of Artificial Sequence: Synthetic peptide
TLSQPNT

SEQ ID NO: 7411 - protein, 7 aa, Artificial Sequence
  Description of Artificial Sequence: Synthetic peptide
TTHNPSQ

SEQ ID NO: 7412 - protein, 7 aa, Artificial Sequence
  Description of Artificial Sequence: Synthetic peptide
SINQQGK

SEQ ID NO: 7413 - protein, 7 aa, Artificial Sequence
  Description of Artificial Sequence: Synthetic peptide
TQNSRAQ

SEQ ID NO: 7414 - protein, 7 aa, Artificial Sequence
  Description of Artificial Sequence: Synthetic peptide
QSDIKVN

SEQ ID NO: 7415 - protein, 7 aa, Artificial Sequence
  Description of Artificial Sequence: Synthetic peptide
LGTSSNG

SEQ ID NO: 7416 - protein, 7 aa, Artificial Sequence
  Description of Artificial Sequence: Synthetic peptide
SSGKTLT

SEQ ID NO: 7417 - protein, 7 aa, Artificial Sequence
  Description of Artificial Sequence: Synthetic peptide
TVASTNA

SEQ ID NO: 7418 - protein, 7 aa, Artificial Sequence
  Description of Artificial Sequence: Synthetic peptide
EVTKTGL

SEQ ID NO: 7419 - protein, 7 aa, Artificial Sequence
  Description of Artificial Sequence: Synthetic peptide
AVDNKNS

SEQ ID NO: 7420 - protein, 7 aa, Artificial Sequence
  Description of Artificial Sequence: Synthetic peptide
GRDSSPN

SEQ ID NO: 7421 - protein, 7 aa, Artificial Sequence
  Description of Artificial Sequence: Synthetic peptide
VTGPSTS

SEQ ID NO: 7422 - protein, 7 aa, Artificial Sequence
  Description of Artificial Sequence: Synthetic peptide
TTGTPSG

SEQ ID NO: 7423 - protein, 7 aa, Artificial Sequence
  Description of Artificial Sequence: Synthetic peptide
SKEGKPH

SEQ ID NO: 7424 - protein, 7 aa, Artificial Sequence
  Description of Artificial Sequence: Synthetic peptide
LTNTTSQ

SEQ ID NO: 7425 - protein, 7 aa, Artificial Sequence
  Description of Artificial Sequence: Synthetic peptide
ARDSKAQ

SEQ ID NO: 7426 - protein, 7 aa, Artificial Sequence
  Description of Artificial Sequence: Synthetic peptide
DRPTHQS

SEQ ID NO: 7427 - protein, 7 aa, Artificial Sequence
  Description of Artificial Sequence: Synthetic peptide
EGRPTSS

SEQ ID NO: 7428 - protein, 7 aa, Artificial Sequence
  Description of Artificial Sequence: Synthetic peptide
SIGSTNA

SEQ ID NO: 7429 - protein, 7 aa, Artificial Sequence
  Description of Artificial Sequence: Synthetic peptide
SESDPRK

SEQ ID NO: 7430 - protein, 7 aa, Artificial Sequence
  Description of Artificial Sequence: Synthetic peptide
NSQTHSG

SEQ ID NO: 7431 - protein, 7 aa, Artificial Sequence
  Description of Artificial Sequence: Synthetic peptide
SGKSDFS

SEQ ID NO: 7432 - protein, 7 aa, Artificial Sequence
  Description of Artificial Sequence: Synthetic peptide
MSGPSNS

SEQ ID NO: 7433 - protein, 7 aa, Artificial Sequence
  Description of Artificial Sequence: Synthetic peptide
QKADSVN

SEQ ID NO: 7434 - protein, 7 aa, Artificial Sequence
  Description of Artificial Sequence: Synthetic peptide
ATAPLKN

SEQ ID NO: 7435 - protein, 7 aa, Artificial Sequence
  Description of Artificial Sequence: Synthetic peptide
TSDAKLV

SEQ ID NO: 7436 - protein, 7 aa, Artificial Sequence
  Description of Artificial Sequence: Synthetic peptide
GSGSGSS

SEQ ID NO: 7437 - protein, 7 aa, Artificial Sequence
  Description of Artificial Sequence: Synthetic peptide
TQGDRAG

SEQ ID NO: 7438 - protein, 7 aa, Artificial Sequence
  Description of Artificial Sequence: Synthetic peptide
TRETDVR

SEQ ID NO: 7439 - protein, 7 aa, Artificial Sequence
  Description of Artificial Sequence: Synthetic peptide
DRATSSH

SEQ ID NO: 7440 - protein, 7 aa, Artificial Sequence
  Description of Artificial Sequence: Synthetic peptide
QPNNAQV

SEQ ID NO: 7441 - protein, 7 aa, Artificial Sequence
  Description of Artificial Sequence: Synthetic peptide
DPAKSAV

SEQ ID NO: 7442 - protein, 7 aa, Artificial Sequence
  Description of Artificial Sequence: Synthetic peptide
GSGKGGN

SEQ ID NO: 7443 - protein, 7 aa, Artificial Sequence
  Description of Artificial Sequence: Synthetic peptide
KRSDTTT

SEQ ID NO: 7444 - protein, 7 aa, Artificial Sequence
  Description of Artificial Sequence: Synthetic peptide
KDSGGNS

SEQ ID NO: 7445 - protein, 7 aa, Artificial Sequence
  Description of Artificial Sequence: Synthetic peptide
TVSPSHQ

SEQ ID NO: 7446 - protein, 7 aa, Artificial Sequence
  Description of Artificial Sequence: Synthetic peptide
SSPGKDQ

SEQ ID NO: 7447 - protein, 7 aa, Artificial Sequence
  Description of Artificial Sequence: Synthetic peptide
SQTPGNQ

SEQ ID NO: 7448 - protein, 7 aa, Artificial Sequence
  Description of Artificial Sequence: Synthetic peptide
HNASKIE

SEQ ID NO: 7449 - protein, 7 aa, Artificial Sequence
  Description of Artificial Sequence: Synthetic peptide
QRDSSPV

SEQ ID NO: 7450 - protein, 7 aa, Artificial Sequence
  Description of Artificial Sequence: Synthetic peptide
EATANTK

SEQ ID NO: 7451 - protein, 7 aa, Artificial Sequence
  Description of Artificial Sequence: Synthetic peptide
GFGQSKA

SEQ ID NO: 7452 - protein, 7 aa, Artificial Sequence
  Description of Artificial Sequence: Synthetic peptide
NSKATQS

SEQ ID NO: 7453 - protein, 7 aa, Artificial Sequence
  Description of Artificial Sequence: Synthetic peptide
TPAPSLT

SEQ ID NO: 7454 - protein, 7 aa, Artificial Sequence
  Description of Artificial Sequence: Synthetic peptide
EASVKGL

SEQ ID NO: 7455 - protein, 7 aa, Artificial Sequence
  Description of Artificial Sequence: Synthetic peptide
VNTPPSK

SEQ ID NO: 7456 - protein, 7 aa, Artificial Sequence
  Description of Artificial Sequence: Synthetic peptide
ANAVPAA

SEQ ID NO: 7457 - protein, 7 aa, Artificial Sequence
  Description of Artificial Sequence: Synthetic peptide
VTGTPIA

SEQ ID NO: 7458 - protein, 7 aa, Artificial Sequence
  Description of Artificial Sequence: Synthetic peptide
TVDKAAS

SEQ ID NO: 7459 - protein, 7 aa, Artificial Sequence
  Description of Artificial Sequence: Synthetic peptide
TGSGTPT

SEQ ID NO: 7460 - protein, 7 aa, Artificial Sequence
  Description of Artificial Sequence: Synthetic peptide
GQNSSIQ

SEQ ID NO: 7461 - protein, 7 aa, Artificial Sequence
  Description of Artificial Sequence: Synthetic peptide
VPNDHPV

SEQ ID NO: 7462 - protein, 7 aa, Artificial Sequence
  Description of Artificial Sequence: Synthetic peptide
HGDTPTK

SEQ ID NO: 7463 - protein, 7 aa, Artificial Sequence
  Description of Artificial Sequence: Synthetic peptide
AGNGPTS

SEQ ID NO: 7464 - protein, 7 aa, Artificial Sequence
  Description of Artificial Sequence: Synthetic peptide
GMKNAPT

SEQ ID NO: 7465 - protein, 7 aa, Artificial Sequence
  Description of Artificial Sequence: Synthetic peptide
GLKPSDK

SEQ ID NO: 7466 - protein, 7 aa, Artificial Sequence
  Description of Artificial Sequence: Synthetic peptide
TAQSSSH

SEQ ID NO: 7467 - protein, 7 aa, Artificial Sequence
  Description of Artificial Sequence: Synthetic peptide
SGQGTIL

SEQ ID NO: 7468 - protein, 7 aa, Artificial Sequence
  Description of Artificial Sequence: Synthetic peptide
LGGSSTT

SEQ ID NO: 7469 - protein, 7 aa, Artificial Sequence
  Description of Artificial Sequence: Synthetic peptide
LTSDKAS

SEQ ID NO: 7470 - protein, 7 aa, Artificial Sequence
  Description of Artificial Sequence: Synthetic peptide
NTTDHNR

SEQ ID NO: 7471 - protein, 7 aa, Artificial Sequence
  Description of Artificial Sequence: Synthetic peptide
QRVNSSA

SEQ ID NO: 7472 - protein, 7 aa, Artificial Sequence
  Description of Artificial Sequence: Synthetic peptide
TADRVGH

SEQ ID NO: 7473 - protein, 7 aa, Artificial Sequence
  Description of Artificial Sequence: Synthetic peptide
STGASNG

SEQ ID NO: 7474 - protein, 7 aa, Artificial Sequence
  Description of Artificial Sequence: Synthetic peptide
SGIASTA

SEQ ID NO: 7475 - protein, 7 aa, Artificial Sequence
  Description of Artificial Sequence: Synthetic peptide
SAPGTSS

SEQ ID NO: 7476 - protein, 7 aa, Artificial Sequence
  Description of Artificial Sequence: Synthetic peptide
GSGSNGS

SEQ ID NO: 7477 - protein, 7 aa, Artificial Sequence
  Description of Artificial Sequence: Synthetic peptide
SSSSTPS

SEQ ID NO: 7478 - protein, 7 aa, Artificial Sequence
  Description of Artificial Sequence: Synthetic peptide
ASVDSKS

SEQ ID NO: 7479 - protein, 7 aa, Artificial Sequence
  Description of Artificial Sequence: Synthetic peptide
TSNGSLT

SEQ ID NO: 7480 - protein, 7 aa, Artificial Sequence
  Description of Artificial Sequence: Synthetic peptide
RQESSKD

SEQ ID NO: 7481 - protein, 7 aa, Artificial Sequence
  Description of Artificial Sequence: Synthetic peptide
SGNSPNK

SEQ ID NO: 7482 - protein, 7 aa, Artificial Sequence
  Description of Artificial Sequence: Synthetic peptide
MGEKSTP

SEQ ID NO: 7483 - protein, 7 aa, Artificial Sequence
  Description of Artificial Sequence: Synthetic peptide
GAHQPSS

SEQ ID NO: 7484 - protein, 7 aa, Artificial Sequence
  Description of Artificial Sequence: Synthetic peptide
STTTANT

SEQ ID NO: 7485 - protein, 7 aa, Artificial Sequence
  Description of Artificial Sequence: Synthetic peptide
ERTDRPG

SEQ ID NO: 7486 - protein, 7 aa, Artificial Sequence
  Description of Artificial Sequence: Synthetic peptide
GVGQASS

SEQ ID NO: 7487 - protein, 7 aa, Artificial Sequence
  Description of Artificial Sequence: Synthetic peptide
TGVKDRP

SEQ ID NO: 7488 - protein, 7 aa, Artificial Sequence
  Description of Artificial Sequence: Synthetic peptide
KSGTPPV

SEQ ID NO: 7489 - protein, 7 aa, Artificial Sequence
  Description of Artificial Sequence: Synthetic peptide
TRETATS

SEQ ID NO: 7490 - protein, 7 aa, Artificial Sequence
  Description of Artificial Sequence: Synthetic peptide
QKSKDQA

SEQ ID NO: 7491 - protein, 7 aa, Artificial Sequence
  Description of Artificial Sequence: Synthetic peptide
DKGNGQL

SEQ ID NO: 7492 - protein, 7 aa, Artificial Sequence
  Description of Artificial Sequence: Synthetic peptide
GPDSNKS

SEQ ID NO: 7493 - protein, 7 aa, Artificial Sequence
  Description of Artificial Sequence: Synthetic peptide
ETTSNPR

SEQ ID NO: 7494 - protein, 7 aa, Artificial Sequence
  Description of Artificial Sequence: Synthetic peptide
SGTPPAS

SEQ ID NO: 7495 - protein, 7 aa, Artificial Sequence
  Description of Artificial Sequence: Synthetic peptide
SGSGHQS

SEQ ID NO: 7496 - protein, 7 aa, Artificial Sequence
  Description of Artificial Sequence: Synthetic peptide
AGSQSPL

SEQ ID NO: 7497 - protein, 7 aa, Artificial Sequence
  Description of Artificial Sequence: Synthetic peptide
GASSNQN

SEQ ID NO: 7498 - protein, 7 aa, Artificial Sequence
  Description of Artificial Sequence: Synthetic peptide
FTGKESV

SEQ ID NO: 7499 - protein, 7 aa, Artificial Sequence
  Description of Artificial Sequence: Synthetic peptide
NTPAKPT

SEQ ID NO: 7500 - protein, 7 aa, Artificial Sequence
  Description of Artificial Sequence: Synthetic peptide
MPDRSGS

SEQ ID NO: 7501 - protein, 7 aa, Artificial Sequence
  Description of Artificial Sequence: Synthetic peptide
QNNSHSA

SEQ ID NO: 7502 - protein, 7 aa, Artificial Sequence
  Description of Artificial Sequence: Synthetic peptide
ASSGQHP

SEQ ID NO: 7503 - protein, 7 aa, Artificial Sequence
  Description of Artificial Sequence: Synthetic peptide
GGQDDRK

SEQ ID NO: 7504 - protein, 7 aa, Artificial Sequence
  Description of Artificial Sequence: Synthetic peptide
NTSSKSG

SEQ ID NO: 7505 - protein, 7 aa, Artificial Sequence
  Description of Artificial Sequence: Synthetic peptide
VSDKSVS

SEQ ID NO: 7506 - protein, 7 aa, Artificial Sequence
  Description of Artificial Sequence: Synthetic peptide
GSEGTNS

SEQ ID NO: 7507 - protein, 7 aa, Artificial Sequence
  Description of Artificial Sequence: Synthetic peptide
NVGGGSG

SEQ ID NO: 7508 - protein, 7 aa, Artificial Sequence
  Description of Artificial Sequence: Synthetic peptide
ETSSTPS

SEQ ID NO: 7509 - protein, 7 aa, Artificial Sequence
  Description of Artificial Sequence: Synthetic peptide
GGPTEPK

SEQ ID NO: 7510 - protein, 7 aa, Artificial Sequence
  Description of Artificial Sequence: Synthetic peptide
VTDKSSN

SEQ ID NO: 7511 - protein, 7 aa, Artificial Sequence
  Description of Artificial Sequence: Synthetic peptide
QMGATPN

SEQ ID NO: 7512 - protein, 7 aa, Artificial Sequence
  Description of Artificial Sequence: Synthetic peptide
TPSSSTT

SEQ ID NO: 7513 - protein, 7 aa, Artificial Sequence
  Description of Artificial Sequence: Synthetic peptide
DNMSKQL

SEQ ID NO: 7514 - protein, 7 aa, Artificial Sequence
  Description of Artificial Sequence: Synthetic peptide
ETQRPNA

SEQ ID NO: 7515 - protein, 7 aa, Artificial Sequence
  Description of Artificial Sequence: Synthetic peptide
NGVTNNR

SEQ ID NO: 7516 - protein, 7 aa, Artificial Sequence
  Description of Artificial Sequence: Synthetic peptide
SLNGSRG

SEQ ID NO: 7517 - protein, 7 aa, Artificial Sequence
  Description of Artificial Sequence: Synthetic peptide
NGLNVKG

SEQ ID NO: 7518 - protein, 7 aa, Artificial Sequence
  Description of Artificial Sequence: Synthetic peptide
TGESQVK

SEQ ID NO: 7519 - protein, 7 aa, Artificial Sequence
  Description of Artificial Sequence: Synthetic peptide
TGGSSTL

SEQ ID NO: 7520 - protein, 7 aa, Artificial Sequence
  Description of Artificial Sequence: Synthetic peptide
ERATHTQ

SEQ ID NO: 7521 - protein, 7 aa, Artificial Sequence
  Description of Artificial Sequence: Synthetic peptide
SSTPRVA

SEQ ID NO: 7522 - protein, 7 aa, Artificial Sequence
  Description of Artificial Sequence: Synthetic peptide
SSSPTNH

SEQ ID NO: 7523 - protein, 7 aa, Artificial Sequence
  Description of Artificial Sequence: Synthetic peptide
TVNSGSG

SEQ ID NO: 7524 - protein, 7 aa, Artificial Sequence
  Description of Artificial Sequence: Synthetic peptide
HAGNAPV

SEQ ID NO: 7525 - protein, 7 aa, Artificial Sequence
  Description of Artificial Sequence: Synthetic peptide
GQAETLK

SEQ ID NO: 7526 - protein, 7 aa, Artificial Sequence
  Description of Artificial Sequence: Synthetic peptide
GAKSQAV

SEQ ID NO: 7527 - protein, 7 aa, Artificial Sequence
  Description of Artificial Sequence: Synthetic peptide
TLSDRGS

SEQ ID NO: 7528 - protein, 7 aa, Artificial Sequence
  Description of Artificial Sequence: Synthetic peptide
SGTSHTQ

SEQ ID NO: 7529 - protein, 7 aa, Artificial Sequence
  Description of Artificial Sequence: Synthetic peptide
REGAPPA

SEQ ID NO: 7530 - protein, 7 aa, Artificial Sequence
  Description of Artificial Sequence: Synthetic peptide
TATTTGS

SEQ ID NO: 7531 - protein, 7 aa, Artificial Sequence
  Description of Artificial Sequence: Synthetic peptide
QGQNQTR

SEQ ID NO: 7532 - protein, 7 aa, Artificial Sequence
  Description of Artificial Sequence: Synthetic peptide
LDPSKSS

SEQ ID NO: 7533 - protein, 7 aa, Artificial Sequence
  Description of Artificial Sequence: Synthetic peptide
DTNHSTK

SEQ ID NO: 7534 - protein, 7 aa, Artificial Sequence
  Description of Artificial Sequence: Synthetic peptide
GEKSSLS

SEQ ID NO: 7535 - protein, 7 aa, Artificial Sequence
  Description of Artificial Sequence: Synthetic peptide
SHSNNGS

SEQ ID NO: 7536 - protein, 7 aa, Artificial Sequence
  Description of Artificial Sequence: Synthetic peptide
SQVKPTS

SEQ ID NO: 7537 - protein, 7 aa, Artificial Sequence
  Description of Artificial Sequence: Synthetic peptide
ASKERNM

SEQ ID NO: 7538 - protein, 7 aa, Artificial Sequence
  Description of Artificial Sequence: Synthetic peptide
TANSAST

SEQ ID NO: 7539 - protein, 7 aa, Artificial Sequence
  Description of Artificial Sequence: Synthetic peptide
RGLPDKN

SEQ ID NO: 7540 - protein, 7 aa, Artificial Sequence
  Description of Artificial Sequence: Synthetic peptide
NASDRGG

SEQ ID NO: 7541 - protein, 7 aa, Artificial Sequence
  Description of Artificial Sequence: Synthetic peptide
SANSKLG

SEQ ID NO: 7542 - protein, 7 aa, Artificial Sequence
  Description of Artificial Sequence: Synthetic peptide
LSDGKGN

SEQ ID NO: 7543 - protein, 7 aa, Artificial Sequence
  Description of Artificial Sequence: Synthetic peptide
GGKSHGG

SEQ ID NO: 7544 - protein, 7 aa, Artificial Sequence
  Description of Artificial Sequence: Synthetic peptide
GDNKLNQ

SEQ ID NO: 7545 - protein, 7 aa, Artificial Sequence
  Description of Artificial Sequence: Synthetic peptide
CSGQSNK

SEQ ID NO: 7546 - protein, 7 aa, Artificial Sequence
  Description of Artificial Sequence: Synthetic peptide
LVTKASQ

SEQ ID NO: 7547 - protein, 7 aa, Artificial Sequence
  Description of Artificial Sequence: Synthetic peptide
STRTDNR

SEQ ID NO: 7548 - protein, 7 aa, Artificial Sequence
  Description of Artificial Sequence: Synthetic peptide
GKNTAAV

SEQ ID NO: 7549 - protein, 7 aa, Artificial Sequence
  Description of Artificial Sequence: Synthetic peptide
TNGTHAG

SEQ ID NO: 7550 - protein, 7 aa, Artificial Sequence
  Description of Artificial Sequence: Synthetic peptide
TGSGVKS

SEQ ID NO: 7551 - protein, 7 aa, Artificial Sequence
  Description of Artificial Sequence: Synthetic peptide
SDKATDR

SEQ ID NO: 7552 - protein, 7 aa, Artificial Sequence
  Description of Artificial Sequence: Synthetic peptide
DQSAARN

SEQ ID NO: 7553 - protein, 7 aa, Artificial Sequence
  Description of Artificial Sequence: Synthetic peptide
GRSTDVK

SEQ ID NO: 7554 - protein, 7 aa, Artificial Sequence
  Description of Artificial Sequence: Synthetic peptide
VANSSTA

SEQ ID NO: 7555 - protein, 7 aa, Artificial Sequence
  Description of Artificial Sequence: Synthetic peptide
AQKSSVN

SEQ ID NO: 7556 - protein, 7 aa, Artificial Sequence
  Description of Artificial Sequence: Synthetic peptide
NTSGKGL

SEQ ID NO: 7557 - protein, 7 aa, Artificial Sequence
  Description of Artificial Sequence: Synthetic peptide
SGNNVTS

SEQ ID NO: 7558 - protein, 7 aa, Artificial Sequence
  Description of Artificial Sequence: Synthetic peptide
MGSGAKE

SEQ ID NO: 7559 - protein, 7 aa, Artificial Sequence
  Description of Artificial Sequence: Synthetic peptide
NSIGKSD

SEQ ID NO: 7560 - protein, 7 aa, Artificial Sequence
  Description of Artificial Sequence: Synthetic peptide
SRDSGAL

SEQ ID NO: 7561 - protein, 7 aa, Artificial Sequence
  Description of Artificial Sequence: Synthetic peptide
DSYADKK

SEQ ID NO: 7562 - protein, 7 aa, Artificial Sequence
  Description of Artificial Sequence: Synthetic peptide
AHSSATS

SEQ ID NO: 7563 - protein, 7 aa, Artificial Sequence
  Description of Artificial Sequence: Synthetic peptide
TVGNSPT

SEQ ID NO: 7564 - protein, 7 aa, Artificial Sequence
  Description of Artificial Sequence: Synthetic peptide
DAANPQK

SEQ ID NO: 7565 - protein, 7 aa, Artificial Sequence
  Description of Artificial Sequence: Synthetic peptide
WGTDRSS

SEQ ID NO: 7566 - protein, 7 aa, Artificial Sequence
  Description of Artificial Sequence: Synthetic peptide
HTESKMA

SEQ ID NO: 7567 - protein, 7 aa, Artificial Sequence
  Description of Artificial Sequence: Synthetic peptide
DTNPAVK

SEQ ID NO: 7568 - protein, 7 aa, Artificial Sequence
  Description of Artificial Sequence: Synthetic peptide
STPGSSS

SEQ ID NO: 7569 - protein, 7 aa, Artificial Sequence
  Description of Artificial Sequence: Synthetic peptide
TPNQTPT

SEQ ID NO: 7570 - protein, 7 aa, Artificial Sequence
  Description of Artificial Sequence: Synthetic peptide
TSLGGNA

SEQ ID NO: 7571 - protein, 7 aa, Artificial Sequence
  Description of Artificial Sequence: Synthetic peptide
QQSTSST

SEQ ID NO: 7572 - protein, 7 aa, Artificial Sequence
  Description of Artificial Sequence: Synthetic peptide
DRSGQST

SEQ ID NO: 7573 - protein, 7 aa, Artificial Sequence
  Description of Artificial Sequence: Synthetic peptide
DSTKGRD

SEQ ID NO: 7574 - protein, 7 aa, Artificial Sequence
  Description of Artificial Sequence: Synthetic peptide
SDGHANN

SEQ ID NO: 7575 - protein, 7 aa, Artificial Sequence
  Description of Artificial Sequence: Synthetic peptide
QRDQQNA

SEQ ID NO: 7576 - protein, 7 aa, Artificial Sequence
  Description of Artificial Sequence: Synthetic peptide
EGVHTSN

SEQ ID NO: 7577 - protein, 7 aa, Artificial Sequence
  Description of Artificial Sequence: Synthetic peptide
DKVSSNA

SEQ ID NO: 7578 - protein, 7 aa, Artificial Sequence
  Description of Artificial Sequence: Synthetic peptide
DSVNARS

SEQ ID NO: 7579 - protein, 7 aa, Artificial Sequence
  Description of Artificial Sequence: Synthetic peptide
GVSPSDR

SEQ ID NO: 7580 - protein, 7 aa, Artificial Sequence
  Description of Artificial Sequence: Synthetic peptide
SSQSSVK

SEQ ID NO: 7581 - protein, 7 aa, Artificial Sequence
  Description of Artificial Sequence: Synthetic peptide
SRAGTSG

SEQ ID NO: 7582 - protein, 7 aa, Artificial Sequence
  Description of Artificial Sequence: Synthetic peptide
SGGGRND

SEQ ID NO: 7583 - protein, 7 aa, Artificial Sequence
  Description of Artificial Sequence: Synthetic peptide
TSATAVS

SEQ ID NO: 7584 - protein, 7 aa, Artificial Sequence
  Description of Artificial Sequence: Synthetic peptide
DNHPKPN

SEQ ID NO: 7585 - protein, 7 aa, Artificial Sequence
  Description of Artificial Sequence: Synthetic peptide
AAVNPKG

SEQ ID NO: 7586 - protein, 7 aa, Artificial Sequence
  Description of Artificial Sequence: Synthetic peptide
NLTKPGS

SEQ ID NO: 7587 - protein, 7 aa, Artificial Sequence
  Description of Artificial Sequence: Synthetic peptide
SSSPAGR

SEQ ID NO: 7588 - protein, 7 aa, Artificial Sequence
  Description of Artificial Sequence: Synthetic peptide
SSGMGSK

SEQ ID NO: 7589 - protein, 7 aa, Artificial Sequence
  Description of Artificial Sequence: Synthetic peptide
NSQTTVA

SEQ ID NO: 7590 - protein, 7 aa, Artificial Sequence
  Description of Artificial Sequence: Synthetic peptide
TGSSPLV

SEQ ID NO: 7591 - protein, 7 aa, Artificial Sequence
  Description of Artificial Sequence: Synthetic peptide
AVVKSPM

SEQ ID NO: 7592 - protein, 7 aa, Artificial Sequence
  Description of Artificial Sequence: Synthetic peptide
GDKPNTA

SEQ ID NO: 7593 - protein, 7 aa, Artificial Sequence
  Description of Artificial Sequence: Synthetic peptide
LQDSPSK

SEQ ID NO: 7594 - protein, 7 aa, Artificial Sequence
  Description of Artificial Sequence: Synthetic peptide
TPSDKIL

SEQ ID NO: 7595 - protein, 7 aa, Artificial Sequence
  Description of Artificial Sequence: Synthetic peptide
TAASPSN

SEQ ID NO: 7596 - protein, 7 aa, Artificial Sequence
  Description of Artificial Sequence: Synthetic peptide
SAAQTSL

SEQ ID NO: 7597 - protein, 7 aa, Artificial Sequence
  Description of Artificial Sequence: Synthetic peptide
GTAGDKQ

SEQ ID NO: 7598 - protein, 7 aa, Artificial Sequence
  Description of Artificial Sequence: Synthetic peptide
KTTDSKG

SEQ ID NO: 7599 - protein, 7 aa, Artificial Sequence
  Description of Artificial Sequence: Synthetic peptide
TSSDLRK

SEQ ID NO: 7600 - protein, 7 aa, Artificial Sequence
  Description of Artificial Sequence: Synthetic peptide
SVSKERA

SEQ ID NO: 7601 - protein, 7 aa, Artificial Sequence
  Description of Artificial Sequence: Synthetic peptide
SKTGSST

SEQ ID NO: 7602 - protein, 7 aa, Artificial Sequence
  Description of Artificial Sequence: Synthetic peptide
AGNGQTM

SEQ ID NO: 7603 - protein, 7 aa, Artificial Sequence
  Description of Artificial Sequence: Synthetic peptide
YGQTVSQ

SEQ ID NO: 7604 - protein, 7 aa, Artificial Sequence
  Description of Artificial Sequence: Synthetic peptide
SDGNTTK

SEQ ID NO: 7605 - protein, 7 aa, Artificial Sequence
  Description of Artificial Sequence: Synthetic peptide
TKAANQA

SEQ ID NO: 7606 - protein, 7 aa, Artificial Sequence
  Description of Artificial Sequence: Synthetic peptide
GLGKDTG

SEQ ID NO: 7607 - protein, 7 aa, Artificial Sequence
  Description of Artificial Sequence: Synthetic peptide
SMPSGKE

SEQ ID NO: 7608 - protein, 7 aa, Artificial Sequence
  Description of Artificial Sequence: Synthetic peptide
IPSNAGT

SEQ ID NO: 7609 - protein, 7 aa, Artificial Sequence
  Description of Artificial Sequence: Synthetic peptide
VSASGIS

SEQ ID NO: 7610 - protein, 7 aa, Artificial Sequence
  Description of Artificial Sequence: Synthetic peptide
STSREST

SEQ ID NO: 7611 - protein, 7 aa, Artificial Sequence
  Description of Artificial Sequence: Synthetic peptide
SEGQLSK

SEQ ID NO: 7612 - protein, 7 aa, Artificial Sequence
  Description of Artificial Sequence: Synthetic peptide
SHEKASG

SEQ ID NO: 7613 - protein, 7 aa, Artificial Sequence
  Description of Artificial Sequence: Synthetic peptide
TVDSKSY

SEQ ID NO: 7614 - protein, 7 aa, Artificial Sequence
  Description of Artificial Sequence: Synthetic peptide
RVGATNE

SEQ ID NO: 7615 - protein, 7 aa, Artificial Sequence
  Description of Artificial Sequence: Synthetic peptide
VRESPSH

SEQ ID NO: 7616 - protein, 7 aa, Artificial Sequence
  Description of Artificial Sequence: Synthetic peptide
SSTSAKE

SEQ ID NO: 7617 - protein, 7 aa, Artificial Sequence
  Description of Artificial Sequence: Synthetic peptide
GDHHGSG

SEQ ID NO: 7618 - protein, 7 aa, Artificial Sequence
  Description of Artificial Sequence: Synthetic peptide
GSGNLGT

SEQ ID NO: 7619 - protein, 7 aa, Artificial Sequence
  Description of Artificial Sequence: Synthetic peptide
NSPNSSG

SEQ ID NO: 7620 - protein, 7 aa, Artificial Sequence
  Description of Artificial Sequence: Synthetic peptide
ITSSNPP

SEQ ID NO: 7621 - protein, 7 aa, Artificial Sequence
  Description of Artificial Sequence: Synthetic peptide
STAPAGT

SEQ ID NO: 7622 - protein, 7 aa, Artificial Sequence
  Description of Artificial Sequence: Synthetic peptide
KSTSGSV

SEQ ID NO: 7623 - protein, 7 aa, Artificial Sequence
  Description of Artificial Sequence: Synthetic peptide
NSGNSMS

SEQ ID NO: 7624 - protein, 7 aa, Artificial Sequence
  Description of Artificial Sequence: Synthetic peptide
SSSGNNR

SEQ ID NO: 7625 - protein, 7 aa, Artificial Sequence
  Description of Artificial Sequence: Synthetic peptide
NRGSPSE

SEQ ID NO: 7626 - protein, 7 aa, Artificial Sequence
  Description of Artificial Sequence: Synthetic peptide
EMSSPNR

SEQ ID NO: 7627 - protein, 7 aa, Artificial Sequence
  Description of Artificial Sequence: Synthetic peptide
GGTSKRD

SEQ ID NO: 7628 - protein, 7 aa, Artificial Sequence
  Description of Artificial Sequence: Synthetic peptide
NLSTSSA

SEQ ID NO: 7629 - protein, 7 aa, Artificial Sequence
  Description of Artificial Sequence: Synthetic peptide
DREERSH

SEQ ID NO: 7630 - protein, 7 aa, Artificial Sequence
  Description of Artificial Sequence: Synthetic peptide
NASTAPS

SEQ ID NO: 7631 - protein, 7 aa, Artificial Sequence
  Description of Artificial Sequence: Synthetic peptide
SGTSSLS

SEQ ID NO: 7632 - protein, 7 aa, Artificial Sequence
  Description of Artificial Sequence: Synthetic peptide
GDGTASN

SEQ ID NO: 7633 - protein, 7 aa, Artificial Sequence
  Description of Artificial Sequence: Synthetic peptide
SASSSTV

SEQ ID NO: 7634 - protein, 7 aa, Artificial Sequence
  Description of Artificial Sequence: Synthetic peptide
GTEKPAP

SEQ ID NO: 7635 - protein, 7 aa, Artificial Sequence
  Description of Artificial Sequence: Synthetic peptide
NPSTPSS

SEQ ID NO: 7636 - protein, 7 aa, Artificial Sequence
  Description of Artificial Sequence: Synthetic peptide
SQGSALL

SEQ ID NO: 7637 - protein, 7 aa, Artificial Sequence
  Description of Artificial Sequence: Synthetic peptide
QGEGRTL

SEQ ID NO: 7638 - protein, 7 aa, Artificial Sequence
  Description of Artificial Sequence: Synthetic peptide
HGDRTTV

SEQ ID NO: 7639 - protein, 7 aa, Artificial Sequence
  Description of Artificial Sequence: Synthetic peptide
GGNEHAR

SEQ ID NO: 7640 - protein, 7 aa, Artificial Sequence
  Description of Artificial Sequence: Synthetic peptide
NQSTSGS

SEQ ID NO: 7641 - protein, 7 aa, Artificial Sequence
  Description of Artificial Sequence: Synthetic peptide
HGTSNTR

SEQ ID NO: 7642 - protein, 7 aa, Artificial Sequence
  Description of Artificial Sequence: Synthetic peptide
ETKTGSA

SEQ ID NO: 7643 - protein, 7 aa, Artificial Sequence
  Description of Artificial Sequence: Synthetic peptide
INVKGSQ

SEQ ID NO: 7644 - protein, 7 aa, Artificial Sequence
  Description of Artificial Sequence: Synthetic peptide
SGNPPGI

SEQ ID NO: 7645 - protein, 7 aa, Artificial Sequence
  Description of Artificial Sequence: Synthetic peptide
EGSTRPE

SEQ ID NO: 7646 - protein, 7 aa, Artificial Sequence
  Description of Artificial Sequence: Synthetic peptide
SSDNRPT

SEQ ID NO: 7647 - protein, 7 aa, Artificial Sequence
  Description of Artificial Sequence: Synthetic peptide
GNGTRGT

SEQ ID NO: 7648 - protein, 7 aa, Artificial Sequence
  Description of Artificial Sequence: Synthetic peptide
TGSQGNI

SEQ ID NO: 7649 - protein, 7 aa, Artificial Sequence
  Description of Artificial Sequence: Synthetic peptide
SEDRKSP

SEQ ID NO: 7650 - protein, 7 aa, Artificial Sequence
  Description of Artificial Sequence: Synthetic peptide
VTSDKSL

SEQ ID NO: 7651 - protein, 7 aa, Artificial Sequence
  Description of Artificial Sequence: Synthetic peptide
SNGQSNG

SEQ ID NO: 7652 - protein, 7 aa, Artificial Sequence
  Description of Artificial Sequence: Synthetic peptide
KASTDNK

SEQ ID NO: 7653 - protein, 7 aa, Artificial Sequence
  Description of Artificial Sequence: Synthetic peptide
NNSSRNL

SEQ ID NO: 7654 - protein, 7 aa, Artificial Sequence
  Description of Artificial Sequence: Synthetic peptide
NSQSGST

SEQ ID NO: 7655 - protein, 7 aa, Artificial Sequence
  Description of Artificial Sequence: Synthetic peptide
NSVSSTT

SEQ ID NO: 7656 - protein, 7 aa, Artificial Sequence
  Description of Artificial Sequence: Synthetic peptide
TSEHRAN

SEQ ID NO: 7657 - protein, 7 aa, Artificial Sequence
  Description of Artificial Sequence: Synthetic peptide
TDGTHPL

SEQ ID NO: 7658 - protein, 7 aa, Artificial Sequence
  Description of Artificial Sequence: Synthetic peptide
TNNNQPR

SEQ ID NO: 7659 - protein, 7 aa, Artificial Sequence
  Description of Artificial Sequence: Synthetic peptide
TQEPQLK

SEQ ID NO: 7660 - protein, 7 aa, Artificial Sequence
  Description of Artificial Sequence: Synthetic peptide
TSSTGVV

SEQ ID NO: 7661 - protein, 7 aa, Artificial Sequence
  Description of Artificial Sequence: Synthetic peptide
SPTGHKA

SEQ ID NO: 7662 - protein, 7 aa, Artificial Sequence
  Description of Artificial Sequence: Synthetic peptide
SPSTANL

SEQ ID NO: 7663 - protein, 7 aa, Artificial Sequence
  Description of Artificial Sequence: Synthetic peptide
SPGDRPL

SEQ ID NO: 7664 - protein, 7 aa, Artificial Sequence
  Description of Artificial Sequence: Synthetic peptide
SGEAQKT

SEQ ID NO: 7665 - protein, 7 aa, Artificial Sequence
  Description of Artificial Sequence: Synthetic peptide
SGDKSKT

SEQ ID NO: 7666 - protein, 7 aa, Artificial Sequence
  Description of Artificial Sequence: Synthetic peptide
SQASNRT

SEQ ID NO: 7667 - protein, 7 aa, Artificial Sequence
  Description of Artificial Sequence: Synthetic peptide
MEGAGQI

SEQ ID NO: 7668 - protein, 7 aa, Artificial Sequence
  Description of Artificial Sequence: Synthetic peptide
MVATGTQ

SEQ ID NO: 7669 - protein, 7 aa, Artificial Sequence
  Description of Artificial Sequence: Synthetic peptide
QANASTG

SEQ ID NO: 7670 - protein, 7 aa, Artificial Sequence
  Description of Artificial Sequence: Synthetic peptide
QVGASST

SEQ ID NO: 7671 - protein, 7 aa, Artificial Sequence
  Description of Artificial Sequence: Synthetic peptide
REGAPSA

SEQ ID NO: 7672 - protein, 7 aa, Artificial Sequence
  Description of Artificial Sequence: Synthetic peptide
LKTESQH

SEQ ID NO: 7673 - protein, 7 aa, Artificial Sequence
  Description of Artificial Sequence: Synthetic peptide
LTGHSPP

SEQ ID NO: 7674 - protein, 7 aa, Artificial Sequence
  Description of Artificial Sequence: Synthetic peptide
LATASPS

SEQ ID NO: 7675 - protein, 7 aa, Artificial Sequence
  Description of Artificial Sequence: Synthetic peptide
LGQPSRQ

SEQ ID NO: 7676 - protein, 7 aa, Artificial Sequence
  Description of Artificial Sequence: Synthetic peptide
LLEPKGL

SEQ ID NO: 7677 - protein, 7 aa, Artificial Sequence
  Description of Artificial Sequence: Synthetic peptide
EKPNAGA

SEQ ID NO: 7678 - protein, 7 aa, Artificial Sequence
  Description of Artificial Sequence: Synthetic peptide
ESATHAG

SEQ ID NO: 7679 - protein, 7 aa, Artificial Sequence
  Description of Artificial Sequence: Synthetic peptide
DKPPNNI

SEQ ID NO: 7680 - protein, 7 aa, Artificial Sequence
  Description of Artificial Sequence: Synthetic peptide
DTHRTPG

SEQ ID NO: 7681 - protein, 7 aa, Artificial Sequence
  Description of Artificial Sequence: Synthetic peptide
DGNSKTP

SEQ ID NO: 7682 - protein, 7 aa, Artificial Sequence
  Description of Artificial Sequence: Synthetic peptide
DGSTTKL

SEQ ID NO: 7683 - protein, 7 aa, Artificial Sequence
  Description of Artificial Sequence: Synthetic peptide
EAGSSAR

SEQ ID NO: 7684 - protein, 7 aa, Artificial Sequence
  Description of Artificial Sequence: Synthetic peptide
EARDKTR

SEQ ID NO: 7685 - protein, 7 aa, Artificial Sequence
  Description of Artificial Sequence: Synthetic peptide
DRNGSNK

SEQ ID NO: 7686 - protein, 7 aa, Artificial Sequence
  Description of Artificial Sequence: Synthetic peptide
ADSREKG

SEQ ID NO: 7687 - protein, 7 aa, Artificial Sequence
  Description of Artificial Sequence: Synthetic peptide
AAGSTKD

SEQ ID NO: 7688 - protein, 7 aa, Artificial Sequence
  Description of Artificial Sequence: Synthetic peptide
AGQAPLN

SEQ ID NO: 7689 - protein, 7 aa, Artificial Sequence
  Description of Artificial Sequence: Synthetic peptide
AQSQKAS

SEQ ID NO: 7690 - protein, 7 aa, Artificial Sequence
  Description of Artificial Sequence: Synthetic peptide
ALGGAPT

SEQ ID NO: 7691 - protein, 7 aa, Artificial Sequence
  Description of Artificial Sequence: Synthetic peptide
GKGETRT

SEQ ID NO: 7692 - protein, 7 aa, Artificial Sequence
  Description of Artificial Sequence: Synthetic peptide
GTPGHGQ

SEQ ID NO: 7693 - protein, 7 aa, Artificial Sequence
  Description of Artificial Sequence: Synthetic peptide
GLASSKG

SEQ ID NO: 7694 - protein, 7 aa, Artificial Sequence
  Description of Artificial Sequence: Synthetic peptide
GAASSNR

SEQ ID NO: 7695 - protein, 7 aa, Artificial Sequence
  Description of Artificial Sequence: Synthetic peptide
GTGDNKV

SEQ ID NO: 7696 - protein, 7 aa, Artificial Sequence
  Description of Artificial Sequence: Synthetic peptide
GKAQTSQ

SEQ ID NO: 7697 - protein, 7 aa, Artificial Sequence
  Description of Artificial Sequence: Synthetic peptide
GAGASVQ

SEQ ID NO: 7698 - protein, 7 aa, Artificial Sequence
  Description of Artificial Sequence: Synthetic peptide
GSGPNAP

SEQ ID NO: 7699 - protein, 7 aa, Artificial Sequence
  Description of Artificial Sequence: Synthetic peptide
VADRSGQ

SEQ ID NO: 7700 - protein, 7 aa, Artificial Sequence
  Description of Artificial Sequence: Synthetic peptide
YRNDSSV

SEQ ID NO: 7701 - protein, 7 aa, Artificial Sequence
  Description of Artificial Sequence: Synthetic peptide
YGKGGSQ

SEQ ID NO: 7702 - protein, 7 aa, Artificial Sequence
  Description of Artificial Sequence: Synthetic peptide
SMLPQKG

SEQ ID NO: 7703 - protein, 7 aa, Artificial Sequence
  Description of Artificial Sequence: Synthetic peptide
CVPTSAG

SEQ ID NO: 7704 - protein, 7 aa, Artificial Sequence
  Description of Artificial Sequence: Synthetic peptide
WGGPTAS

SEQ ID NO: 7705 - protein, 7 aa, Artificial Sequence
  Description of Artificial Sequence: Synthetic peptide
LNSERAA

SEQ ID NO: 7706 - protein, 7 aa, Artificial Sequence
  Description of Artificial Sequence: Synthetic peptide
DDNKKGL

SEQ ID NO: 7707 - protein, 7 aa, Artificial Sequence
  Description of Artificial Sequence: Synthetic peptide
DKPAPGK

SEQ ID NO: 7708 - protein, 7 aa, Artificial Sequence
  Description of Artificial Sequence: Synthetic peptide
GNAGSSV

SEQ ID NO: 7709 - protein, 7 aa, Artificial Sequence
  Description of Artificial Sequence: Synthetic peptide
NSTNPAS

SEQ ID NO: 7710 - protein, 7 aa, Artificial Sequence
  Description of Artificial Sequence: Synthetic peptide
TPSSKST

SEQ ID NO: 7711 - protein, 7 aa, Artificial Sequence
  Description of Artificial Sequence: Synthetic peptide
STNTAPH

SEQ ID NO: 7712 - protein, 7 aa, Artificial Sequence
  Description of Artificial Sequence: Synthetic peptide
GATSPSH

SEQ ID NO: 7713 - protein, 7 aa, Artificial Sequence
  Description of Artificial Sequence: Synthetic peptide
GNDSAGR

SEQ ID NO: 7714 - protein, 7 aa, Artificial Sequence
  Description of Artificial Sequence: Synthetic peptide
GSNVSNQ

SEQ ID NO: 7715 - protein, 7 aa, Artificial Sequence
  Description of Artificial Sequence: Synthetic peptide
DGKGTSG

SEQ ID NO: 7716 - protein, 7 aa, Artificial Sequence
  Description of Artificial Sequence: Synthetic peptide
SAGATPV

SEQ ID NO: 7717 - protein, 7 aa, Artificial Sequence
  Description of Artificial Sequence: Synthetic peptide
TGSNTVM

SEQ ID NO: 7718 - protein, 7 aa, Artificial Sequence
  Description of Artificial Sequence: Synthetic peptide
TTDARPA

SEQ ID NO: 7719 - protein, 7 aa, Artificial Sequence
  Description of Artificial Sequence: Synthetic peptide
ETRSSAA

SEQ ID NO: 7720 - protein, 7 aa, Artificial Sequence
  Description of Artificial Sequence: Synthetic peptide
DNGKSNR

SEQ ID NO: 7721 - protein, 7 aa, Artificial Sequence
  Description of Artificial Sequence: Synthetic peptide
SSQERPV

SEQ ID NO: 7722 - protein, 7 aa, Artificial Sequence
  Description of Artificial Sequence: Synthetic peptide
SLASTSQ

SEQ ID NO: 7723 - protein, 7 aa, Artificial Sequence
  Description of Artificial Sequence: Synthetic peptide
NQSRNES

SEQ ID NO: 7724 - protein, 7 aa, Artificial Sequence
  Description of Artificial Sequence: Synthetic peptide
QGSSPTA

SEQ ID NO: 7725 - protein, 7 aa, Artificial Sequence
  Description of Artificial Sequence: Synthetic peptide
DKSGPHS

SEQ ID NO: 7726 - protein, 7 aa, Artificial Sequence
  Description of Artificial Sequence: Synthetic peptide
ANAPDKS

SEQ ID NO: 7727 - protein, 7 aa, Artificial Sequence
  Description of Artificial Sequence: Synthetic peptide
SKQTNGG

SEQ ID NO: 7728 - protein, 7 aa, Artificial Sequence
  Description of Artificial Sequence: Synthetic peptide
IGEGKTA

SEQ ID NO: 7729 - protein, 7 aa, Artificial Sequence
  Description of Artificial Sequence: Synthetic peptide
EKATSGV

SEQ ID NO: 7730 - protein, 7 aa, Artificial Sequence
  Description of Artificial Sequence: Synthetic peptide
ETTGTRS

SEQ ID NO: 7731 - protein, 7 aa, Artificial Sequence
  Description of Artificial Sequence: Synthetic peptide
VTEGSMR

SEQ ID NO: 7732 - protein, 7 aa, Artificial Sequence
  Description of Artificial Sequence: Synthetic peptide
TDSQSPR

SEQ ID NO: 7733 - protein, 7 aa, Artificial Sequence
  Description of Artificial Sequence: Synthetic peptide
QTPTTNG

SEQ ID NO: 7734 - protein, 7 aa, Artificial Sequence
  Description of Artificial Sequence: Synthetic peptide
TLGAQGG

SEQ ID NO: 7735 - protein, 7 aa, Artificial Sequence
  Description of Artificial Sequence: Synthetic peptide
STTHKTL

SEQ ID NO: 7736 - protein, 7 aa, Artificial Sequence
  Description of Artificial Sequence: Synthetic peptide
SRSDKTH

SEQ ID NO: 7737 - protein, 7 aa, Artificial Sequence
  Description of Artificial Sequence: Synthetic peptide
LGGAQGS

SEQ ID NO: 7738 - protein, 7 aa, Artificial Sequence
  Description of Artificial Sequence: Synthetic peptide
SRSGGTA

SEQ ID NO: 7739 - protein, 7 aa, Artificial Sequence
  Description of Artificial Sequence: Synthetic peptide
DTNAGNH

SEQ ID NO: 7740 - protein, 7 aa, Artificial Sequence
  Description of Artificial Sequence: Synthetic peptide
DSKANNL

SEQ ID NO: 7741 - protein, 7 aa, Artificial Sequence
  Description of Artificial Sequence: Synthetic peptide
AEGSNRQ

SEQ ID NO: 7742 - protein, 7 aa, Artificial Sequence
  Description of Artificial Sequence: Synthetic peptide
GKSANVG

SEQ ID NO: 7743 - protein, 7 aa, Artificial Sequence
  Description of Artificial Sequence: Synthetic peptide
GTKPNTQ

SEQ ID NO: 7744 - protein, 7 aa, Artificial Sequence
  Description of Artificial Sequence: Synthetic peptide
KTTERSS

SEQ ID NO: 7745 - protein, 7 aa, Artificial Sequence
  Description of Artificial Sequence: Synthetic peptide
TLSERGV

SEQ ID NO: 7746 - protein, 7 aa, Artificial Sequence
  Description of Artificial Sequence: Synthetic peptide
GTVDLKR

SEQ ID NO: 7747 - protein, 7 aa, Artificial Sequence
  Description of Artificial Sequence: Synthetic peptide
LGAPASQ

SEQ ID NO: 7748 - protein, 7 aa, Artificial Sequence
  Description of Artificial Sequence: Synthetic peptide
QGKPNLG

SEQ ID NO: 7749 - protein, 7 aa, Artificial Sequence
  Description of Artificial Sequence: Synthetic peptide
DRPGTPG

SEQ ID NO: 7750 - protein, 7 aa, Artificial Sequence
  Description of Artificial Sequence: Synthetic peptide
DAASSRL

SEQ ID NO: 7751 - protein, 7 aa, Artificial Sequence
  Description of Artificial Sequence: Synthetic peptide
GQSATTV

SEQ ID NO: 7752 - protein, 7 aa, Artificial Sequence
  Description of Artificial Sequence: Synthetic peptide
QVDTKSS

SEQ ID NO: 7753 - protein, 7 aa, Artificial Sequence
  Description of Artificial Sequence: Synthetic peptide
GGGNATS

SEQ ID NO: 7754 - protein, 7 aa, Artificial Sequence
  Description of Artificial Sequence: Synthetic peptide
VSKSPAN

SEQ ID NO: 7755 - protein, 7 aa, Artificial Sequence
  Description of Artificial Sequence: Synthetic peptide
LGAGKDL

SEQ ID NO: 7756 - protein, 7 aa, Artificial Sequence
  Description of Artificial Sequence: Synthetic peptide
APESKVT

SEQ ID NO: 7757 - protein, 7 aa, Artificial Sequence
  Description of Artificial Sequence: Synthetic peptide
GTQAQPL

SEQ ID NO: 7758 - protein, 7 aa, Artificial Sequence
  Description of Artificial Sequence: Synthetic peptide
ALNDSRS

SEQ ID NO: 7759 - protein, 7 aa, Artificial Sequence
  Description of Artificial Sequence: Synthetic peptide
SSEKARA

SEQ ID NO: 7760 - protein, 7 aa, Artificial Sequence
  Description of Artificial Sequence: Synthetic peptide
GDGVKGV

SEQ ID NO: 7761 - protein, 7 aa, Artificial Sequence
  Description of Artificial Sequence: Synthetic peptide
VNNSPAT

SEQ ID NO: 7762 - protein, 7 aa, Artificial Sequence
  Description of Artificial Sequence: Synthetic peptide
TAQSNPH

SEQ ID NO: 7763 - protein, 7 aa, Artificial Sequence
  Description of Artificial Sequence: Synthetic peptide
TNTTSKV

SEQ ID NO: 7764 - protein, 7 aa, Artificial Sequence
  Description of Artificial Sequence: Synthetic peptide
DSTARPG

SEQ ID NO: 7765 - protein, 7 aa, Artificial Sequence
  Description of Artificial Sequence: Synthetic peptide
NSKGPQG

SEQ ID NO: 7766 - protein, 7 aa, Artificial Sequence
  Description of Artificial Sequence: Synthetic peptide
EHSGAAK

SEQ ID NO: 7767 - protein, 7 aa, Artificial Sequence
  Description of Artificial Sequence: Synthetic peptide
QTASSVS

SEQ ID NO: 7768 - protein, 7 aa, Artificial Sequence
  Description of Artificial Sequence: Synthetic peptide
VGTQSQA

SEQ ID NO: 7769 - protein, 7 aa, Artificial Sequence
  Description of Artificial Sequence: Synthetic peptide
SSAQGSS

SEQ ID NO: 7770 - protein, 7 aa, Artificial Sequence
  Description of Artificial Sequence: Synthetic peptide
SSEDRKL

SEQ ID NO: 7771 - protein, 7 aa, Artificial Sequence
  Description of Artificial Sequence: Synthetic peptide
NGSQTIQ

SEQ ID NO: 7772 - protein, 7 aa, Artificial Sequence
  Description of Artificial Sequence: Synthetic peptide
TSGGEPR

SEQ ID NO: 7773 - protein, 7 aa, Artificial Sequence
  Description of Artificial Sequence: Synthetic peptide
SQHKDLS

SEQ ID NO: 7774 - protein, 7 aa, Artificial Sequence
  Description of Artificial Sequence: Synthetic peptide
QQTKSSE

SEQ ID NO: 7775 - protein, 7 aa, Artificial Sequence
  Description of Artificial Sequence: Synthetic peptide
APDSRSA

SEQ ID NO: 7776 - protein, 7 aa, Artificial Sequence
  Description of Artificial Sequence: Synthetic peptide
AQSGGKS

SEQ ID NO: 7777 - protein, 7 aa, Artificial Sequence
  Description of Artificial Sequence: Synthetic peptide
NGAGTSS

SEQ ID NO: 7778 - protein, 7 aa, Artificial Sequence
  Description of Artificial Sequence: Synthetic peptide
SKQNASA

SEQ ID NO: 7779 - protein, 7 aa, Artificial Sequence
  Description of Artificial Sequence: Synthetic peptide
QGNLSSG

SEQ ID NO: 7780 - protein, 7 aa, Artificial Sequence
  Description of Artificial Sequence: Synthetic peptide
QGASQNI

SEQ ID NO: 7781 - protein, 7 aa, Artificial Sequence
  Description of Artificial Sequence: Synthetic peptide
AVTSGGK

SEQ ID NO: 7782 - protein, 7 aa, Artificial Sequence
  Description of Artificial Sequence: Synthetic peptide
GGVDTSK

SEQ ID NO: 7783 - protein, 7 aa, Artificial Sequence
  Description of Artificial Sequence: Synthetic peptide
RSNGSAS

SEQ ID NO: 7784 - protein, 7 aa, Artificial Sequence
  Description of Artificial Sequence: Synthetic peptide
DSLGTKK

SEQ ID NO: 7785 - protein, 7 aa, Artificial Sequence
  Description of Artificial Sequence: Synthetic peptide
GPGSNRG

SEQ ID NO: 7786 - protein, 7 aa, Artificial Sequence
  Description of Artificial Sequence: Synthetic peptide
NTSSSGL

SEQ ID NO: 7787 - protein, 7 aa, Artificial Sequence
  Description of Artificial Sequence: Synthetic peptide
NQSSGVS

SEQ ID NO: 7788 - protein, 7 aa, Artificial Sequence
  Description of Artificial Sequence: Synthetic peptide
TNGNPTT

SEQ ID NO: 7789 - protein, 7 aa, Artificial Sequence
  Description of Artificial Sequence: Synthetic peptide
SNSQRSS

SEQ ID NO: 7790 - protein, 7 aa, Artificial Sequence
  Description of Artificial Sequence: Synthetic peptide
ESGGSAS

SEQ ID NO: 7791 - protein, 7 aa, Artificial Sequence
  Description of Artificial Sequence: Synthetic peptide
GADSMPK

SEQ ID NO: 7792 - protein, 7 aa, Artificial Sequence
  Description of Artificial Sequence: Synthetic peptide
LNADHQK

SEQ ID NO: 7793 - protein, 7 aa, Artificial Sequence
  Description of Artificial Sequence: Synthetic peptide
TSGTVAR

SEQ ID NO: 7794 - protein, 7 aa, Artificial Sequence
  Description of Artificial Sequence: Synthetic peptide
SQSRDAL

SEQ ID NO: 7795 - protein, 7 aa, Artificial Sequence
  Description of Artificial Sequence: Synthetic peptide
NTNPSMA

SEQ ID NO: 7796 - protein, 7 aa, Artificial Sequence
  Description of Artificial Sequence: Synthetic peptide
TGQSNSA

SEQ ID NO: 7797 - protein, 7 aa, Artificial Sequence
  Description of Artificial Sequence: Synthetic peptide
DTTTAKA

SEQ ID NO: 7798 - protein, 7 aa, Artificial Sequence
  Description of Artificial Sequence: Synthetic peptide
ENPGGGR

SEQ ID NO: 7799 - protein, 7 aa, Artificial Sequence
  Description of Artificial Sequence: Synthetic peptide
ERNSNPG

SEQ ID NO: 7800 - protein, 7 aa, Artificial Sequence
  Description of Artificial Sequence: Synthetic peptide
GAGNDRT

SEQ ID NO: 7801 - protein, 7 aa, Artificial Sequence
  Description of Artificial Sequence: Synthetic peptide
GNTEGRS

SEQ ID NO: 7802 - protein, 7 aa, Artificial Sequence
  Description of Artificial Sequence: Synthetic peptide
SLATSNQ

SEQ ID NO: 7803 - protein, 7 aa, Artificial Sequence
  Description of Artificial Sequence: Synthetic peptide
VTKDSQS

SEQ ID NO: 7804 - protein, 7 aa, Artificial Sequence
  Description of Artificial Sequence: Synthetic peptide
SSANNKL

SEQ ID NO: 7805 - protein, 7 aa, Artificial Sequence
  Description of Artificial Sequence: Synthetic peptide
NDQGKSS

SEQ ID NO: 7806 - protein, 7 aa, Artificial Sequence
  Description of Artificial Sequence: Synthetic peptide
KNGNDRA

SEQ ID NO: 7807 - protein, 7 aa, Artificial Sequence
  Description of Artificial Sequence: Synthetic peptide
KGTPASA

SEQ ID NO: 7808 - protein, 7 aa, Artificial Sequence
  Description of Artificial Sequence: Synthetic peptide
NTKGTNT

SEQ ID NO: 7809 - protein, 7 aa, Artificial Sequence
  Description of Artificial Sequence: Synthetic peptide
ETSKSLP

SEQ ID NO: 7810 - protein, 7 aa, Artificial Sequence
  Description of Artificial Sequence: Synthetic peptide
GLSTEAH

SEQ ID NO: 7811 - protein, 7 aa, Artificial Sequence
  Description of Artificial Sequence: Synthetic peptide
SNSNKVS

SEQ ID NO: 7812 - protein, 7 aa, Artificial Sequence
  Description of Artificial Sequence: Synthetic peptide
NQAPSGS

SEQ ID NO: 7813 - protein, 7 aa, Artificial Sequence
  Description of Artificial Sequence: Synthetic peptide
SRNDKDA

SEQ ID NO: 7814 - protein, 7 aa, Artificial Sequence
  Description of Artificial Sequence: Synthetic peptide
YSGHEPK

SEQ ID NO: 7815 - protein, 7 aa, Artificial Sequence
  Description of Artificial Sequence: Synthetic peptide
STGVTPV

SEQ ID NO: 7816 - protein, 7 aa, Artificial Sequence
  Description of Artificial Sequence: Synthetic peptide
ATGTGQG

SEQ ID NO: 7817 - protein, 7 aa, Artificial Sequence
  Description of Artificial Sequence: Synthetic peptide
GHADNKT

SEQ ID NO: 7818 - protein, 7 aa, Artificial Sequence
  Description of Artificial Sequence: Synthetic peptide
DGVGHNP

SEQ ID NO: 7819 - protein, 7 aa, Artificial Sequence
  Description of Artificial Sequence: Synthetic peptide
SGTSSIL

SEQ ID NO: 7820 - protein, 7 aa, Artificial Sequence
  Description of Artificial Sequence: Synthetic peptide
TQHTSNQ

SEQ ID NO: 7821 - protein, 7 aa, Artificial Sequence
  Description of Artificial Sequence: Synthetic peptide
GSSKGSN

SEQ ID NO: 7822 - protein, 7 aa, Artificial Sequence
  Description of Artificial Sequence: Synthetic peptide
DRTSGVS

SEQ ID NO: 7823 - protein, 7 aa, Artificial Sequence
  Description of Artificial Sequence: Synthetic peptide
NISEQRS

SEQ ID NO: 7824 - protein, 7 aa, Artificial Sequence
  Description of Artificial Sequence: Synthetic peptide
NAKTSVG

SEQ ID NO: 7825 - protein, 7 aa, Artificial Sequence
  Description of Artificial Sequence: Synthetic peptide
TGGNSSS

SEQ ID NO: 7826 - protein, 7 aa, Artificial Sequence
  Description of Artificial Sequence: Synthetic peptide
DSGERGR

SEQ ID NO: 7827 - protein, 7 aa, Artificial Sequence
  Description of Artificial Sequence: Synthetic peptide
GANSSPS

SEQ ID NO: 7828 - protein, 7 aa, Artificial Sequence
  Description of Artificial Sequence: Synthetic peptide
GGHKSST

SEQ ID NO: 7829 - protein, 7 aa, Artificial Sequence
  Description of Artificial Sequence: Synthetic peptide
GKSGTSS

SEQ ID NO: 7830 - protein, 7 aa, Artificial Sequence
  Description of Artificial Sequence: Synthetic peptide
SRASGVS

SEQ ID NO: 7831 - protein, 7 aa, Artificial Sequence
  Description of Artificial Sequence: Synthetic peptide
SLASTHA

SEQ ID NO: 7832 - protein, 7 aa, Artificial Sequence
  Description of Artificial Sequence: Synthetic peptide
SQTSTHT

SEQ ID NO: 7833 - protein, 7 aa, Artificial Sequence
  Description of Artificial Sequence: Synthetic peptide
DGRSAAS

SEQ ID NO: 7834 - protein, 7 aa, Artificial Sequence
  Description of Artificial Sequence: Synthetic peptide
SVGTSSS

SEQ ID NO: 7835 - protein, 7 aa, Artificial Sequence
  Description of Artificial Sequence: Synthetic peptide
HSGNSNS

SEQ ID NO: 7836 - protein, 7 aa, Artificial Sequence
  Description of Artificial Sequence: Synthetic peptide
GTGSSVS

SEQ ID NO: 7837 - protein, 7 aa, Artificial Sequence
  Description of Artificial Sequence: Synthetic peptide
TNEGTNR

SEQ ID NO: 7838 - protein, 7 aa, Artificial Sequence
  Description of Artificial Sequence: Synthetic peptide
SKSKDIA

SEQ ID NO: 7839 - protein, 7 aa, Artificial Sequence
  Description of Artificial Sequence: Synthetic peptide
ASPGSSG

SEQ ID NO: 7840 - protein, 7 aa, Artificial Sequence
  Description of Artificial Sequence: Synthetic peptide
NLESRSA

SEQ ID NO: 7841 - protein, 7 aa, Artificial Sequence
  Description of Artificial Sequence: Synthetic peptide
HGIDSMK

SEQ ID NO: 7842 - protein, 7 aa, Artificial Sequence
  Description of Artificial Sequence: Synthetic peptide
NNGQNST

SEQ ID NO: 7843 - protein, 7 aa, Artificial Sequence
  Description of Artificial Sequence: Synthetic peptide
NSAASSV

SEQ ID NO: 7844 - protein, 7 aa, Artificial Sequence
  Description of Artificial Sequence: Synthetic peptide
TGKESMI

SEQ ID NO: 7845 - protein, 7 aa, Artificial Sequence
  Description of Artificial Sequence: Synthetic peptide
TAGTGKT

SEQ ID NO: 7846 - protein, 7 aa, Artificial Sequence
  Description of Artificial Sequence: Synthetic peptide
STTKDRV

SEQ ID NO: 7847 - protein, 7 aa, Artificial Sequence
  Description of Artificial Sequence: Synthetic peptide
SPSKDKE

SEQ ID NO: 7848 - protein, 7 aa, Artificial Sequence
  Description of Artificial Sequence: Synthetic peptide
HMNTSSK

SEQ ID NO: 7849 - protein, 7 aa, Artificial Sequence
  Description of Artificial Sequence: Synthetic peptide
HTHGEGK

SEQ ID NO: 7850 - protein, 7 aa, Artificial Sequence
  Description of Artificial Sequence: Synthetic peptide
LSGHSPQ

SEQ ID NO: 7851 - protein, 7 aa, Artificial Sequence
  Description of Artificial Sequence: Synthetic peptide
EGSVQSK

SEQ ID NO: 7852 - protein, 7 aa, Artificial Sequence
  Description of Artificial Sequence: Synthetic peptide
AGNTPKR

SEQ ID NO: 7853 - protein, 7 aa, Artificial Sequence
  Description of Artificial Sequence: Synthetic peptide
GPEHTPA

SEQ ID NO: 7854 - protein, 7 aa, Artificial Sequence
  Description of Artificial Sequence: Synthetic peptide
SSGKDLA

SEQ ID NO: 7855 - protein, 7 aa, Artificial Sequence
  Description of Artificial Sequence: Synthetic peptide
RTDTGPV

SEQ ID NO: 7856 - protein, 7 aa, Artificial Sequence
  Description of Artificial Sequence: Synthetic peptide
AQDPTHK

SEQ ID NO: 7857 - protein, 7 aa, Artificial Sequence
  Description of Artificial Sequence: Synthetic peptide
TNSERNL

SEQ ID NO: 7858 - protein, 7 aa, Artificial Sequence
  Description of Artificial Sequence: Synthetic peptide
AADSKGG

SEQ ID NO: 7859 - protein, 7 aa, Artificial Sequence
  Description of Artificial Sequence: Synthetic peptide
GNTTSTQ

SEQ ID NO: 7860 - protein, 7 aa, Artificial Sequence
  Description of Artificial Sequence: Synthetic peptide
VGAAPVS

SEQ ID NO: 7861 - protein, 7 aa, Artificial Sequence
  Description of Artificial Sequence: Synthetic peptide
DKGPQVV

SEQ ID NO: 7862 - protein, 7 aa, Artificial Sequence
  Description of Artificial Sequence: Synthetic peptide
NPSSSHM

SEQ ID NO: 7863 - protein, 7 aa, Artificial Sequence
  Description of Artificial Sequence: Synthetic peptide
NHGTPVE

SEQ ID NO: 7864 - protein, 7 aa, Artificial Sequence
  Description of Artificial Sequence: Synthetic peptide
NPSTNGN

SEQ ID NO: 7865 - protein, 7 aa, Artificial Sequence
  Description of Artificial Sequence: Synthetic peptide
NSEVSSK

SEQ ID NO: 7866 - protein, 7 aa, Artificial Sequence
  Description of Artificial Sequence: Synthetic peptide
QGPNHSS

SEQ ID NO: 7867 - protein, 7 aa, Artificial Sequence
  Description of Artificial Sequence: Synthetic peptide
VKAGKNE

SEQ ID NO: 7868 - protein, 7 aa, Artificial Sequence
  Description of Artificial Sequence: Synthetic peptide
GAFGEKG

SEQ ID NO: 7869 - protein, 7 aa, Artificial Sequence
  Description of Artificial Sequence: Synthetic peptide
TSRSAQA

SEQ ID NO: 7870 - protein, 7 aa, Artificial Sequence
  Description of Artificial Sequence: Synthetic peptide
SPGSSTL

SEQ ID NO: 7871 - protein, 7 aa, Artificial Sequence
  Description of Artificial Sequence: Synthetic peptide
RQGTTSG

SEQ ID NO: 7872 - protein, 7 aa, Artificial Sequence
  Description of Artificial Sequence: Synthetic peptide
AEQNRSS

SEQ ID NO: 7873 - protein, 7 aa, Artificial Sequence
  Description of Artificial Sequence: Synthetic peptide
GGTKGTT

SEQ ID NO: 7874 - protein, 7 aa, Artificial Sequence
  Description of Artificial Sequence: Synthetic peptide
FGDSRSN

SEQ ID NO: 7875 - protein, 7 aa, Artificial Sequence
  Description of Artificial Sequence: Synthetic peptide
QTNTGKG

SEQ ID NO: 7876 - protein, 7 aa, Artificial Sequence
  Description of Artificial Sequence: Synthetic peptide
KGNAGVE

SEQ ID NO: 7877 - protein, 7 aa, Artificial Sequence
  Description of Artificial Sequence: Synthetic peptide
LTQDKPV

SEQ ID NO: 7878 - protein, 7 aa, Artificial Sequence
  Description of Artificial Sequence: Synthetic peptide
GQHKSGT

SEQ ID NO: 7879 - protein, 7 aa, Artificial Sequence
  Description of Artificial Sequence: Synthetic peptide
VKESKGT

SEQ ID NO: 7880 - protein, 7 aa, Artificial Sequence
  Description of Artificial Sequence: Synthetic peptide
VESPSNR

SEQ ID NO: 7881 - protein, 7 aa, Artificial Sequence
  Description of Artificial Sequence: Synthetic peptide
YKEQNAK

SEQ ID NO: 7882 - protein, 7 aa, Artificial Sequence
  Description of Artificial Sequence: Synthetic peptide
DLPSAKA

SEQ ID NO: 7883 - protein, 7 aa, Artificial Sequence
  Description of Artificial Sequence: Synthetic peptide
ATSETKG

SEQ ID NO: 7884 - protein, 7 aa, Artificial Sequence
  Description of Artificial Sequence: Synthetic peptide
SRTTAPA

SEQ ID NO: 7885 - protein, 7 aa, Artificial Sequence
  Description of Artificial Sequence: Synthetic peptide
SMGTPPS

SEQ ID NO: 7886 - protein, 7 aa, Artificial Sequence
  Description of Artificial Sequence: Synthetic peptide
LGPSQNN

SEQ ID NO: 7887 - protein, 7 aa, Artificial Sequence
  Description of Artificial Sequence: Synthetic peptide
NTAMKGA

SEQ ID NO: 7888 - protein, 7 aa, Artificial Sequence
  Description of Artificial Sequence: Synthetic peptide
THGKGSE

SEQ ID NO: 7889 - protein, 7 aa, Artificial Sequence
  Description of Artificial Sequence: Synthetic peptide
TSDPRGV

SEQ ID NO: 7890 - protein, 7 aa, Artificial Sequence
  Description of Artificial Sequence: Synthetic peptide
RTSTEKN

SEQ ID NO: 7891 - protein, 7 aa, Artificial Sequence
  Description of Artificial Sequence: Synthetic peptide
SVIQGGS

SEQ ID NO: 7892 - protein, 7 aa, Artificial Sequence
  Description of Artificial Sequence: Synthetic peptide
QGQTTKA

SEQ ID NO: 7893 - protein, 7 aa, Artificial Sequence
  Description of Artificial Sequence: Synthetic peptide
EKENSQR

SEQ ID NO: 7894 - protein, 7 aa, Artificial Sequence
  Description of Artificial Sequence: Synthetic peptide
ADSGHNT

SEQ ID NO: 7895 - protein, 7 aa, Artificial Sequence
  Description of Artificial Sequence: Synthetic peptide
GTIGEKL

SEQ ID NO: 7896 - protein, 7 aa, Artificial Sequence
  Description of Artificial Sequence: Synthetic peptide
VPSAKTA

SEQ ID NO: 7897 - protein, 7 aa, Artificial Sequence
  Description of Artificial Sequence: Synthetic peptide
GTVPTNS

SEQ ID NO: 7898 - protein, 7 aa, Artificial Sequence
  Description of Artificial Sequence: Synthetic peptide
TANATPV

SEQ ID NO: 7899 - protein, 7 aa, Artificial Sequence
  Description of Artificial Sequence: Synthetic peptide
TTSRDAS

SEQ ID NO: 7900 - protein, 7 aa, Artificial Sequence
  Description of Artificial Sequence: Synthetic peptide
DGVESNR

SEQ ID NO: 7901 - protein, 7 aa, Artificial Sequence
  Description of Artificial Sequence: Synthetic peptide
TAGKSTD

SEQ ID NO: 7902 - protein, 7 aa, Artificial Sequence
  Description of Artificial Sequence: Synthetic peptide
TGVGNAA

SEQ ID NO: 7903 - protein, 7 aa, Artificial Sequence
  Description of Artificial Sequence: Synthetic peptide
DPGKMAC

SEQ ID NO: 7904 - protein, 7 aa, Artificial Sequence
  Description of Artificial Sequence: Synthetic peptide
EGSDSRS

SEQ ID NO: 7905 - protein, 7 aa, Artificial Sequence
  Description of Artificial Sequence: Synthetic peptide
AANSPRS

SEQ ID NO: 7906 - protein, 7 aa, Artificial Sequence
  Description of Artificial Sequence: Synthetic peptide
GTSANIK

SEQ ID NO: 7907 - protein, 7 aa, Artificial Sequence
  Description of Artificial Sequence: Synthetic peptide
NSSSNTK

SEQ ID NO: 7908 - protein, 7 aa, Artificial Sequence
  Description of Artificial Sequence: Synthetic peptide
GMSDTVK

SEQ ID NO: 7909 - protein, 7 aa, Artificial Sequence
  Description of Artificial Sequence: Synthetic peptide
SVTSKNV

SEQ ID NO: 7910 - protein, 7 aa, Artificial Sequence
  Description of Artificial Sequence: Synthetic peptide
GGNNAKN

SEQ ID NO: 7911 - protein, 7 aa, Artificial Sequence
  Description of Artificial Sequence: Synthetic peptide
DLDKPST

SEQ ID NO: 7912 - protein, 7 aa, Artificial Sequence
  Description of Artificial Sequence: Synthetic peptide
GGTEHRA

SEQ ID NO: 7913 - protein, 7 aa, Artificial Sequence
  Description of Artificial Sequence: Synthetic peptide
DSSSSHN

SEQ ID NO: 7914 - protein, 7 aa, Artificial Sequence
  Description of Artificial Sequence: Synthetic peptide
SHGENPR

SEQ ID NO: 7915 - protein, 7 aa, Artificial Sequence
  Description of Artificial Sequence: Synthetic peptide
SGDITKS

SEQ ID NO: 7916 - protein, 7 aa, Artificial Sequence
  Description of Artificial Sequence: Synthetic peptide
RNDGSTG

SEQ ID NO: 7917 - protein, 7 aa, Artificial Sequence
  Description of Artificial Sequence: Synthetic peptide
GSHSASN

SEQ ID NO: 7918 - protein, 7 aa, Artificial Sequence
  Description of Artificial Sequence: Synthetic peptide
SSNTKGL

SEQ ID NO: 7919 - protein, 7 aa, Artificial Sequence
  Description of Artificial Sequence: Synthetic peptide
NTSTSLN

SEQ ID NO: 7920 - protein, 7 aa, Artificial Sequence
  Description of Artificial Sequence: Synthetic peptide
VRNEKSS

SEQ ID NO: 7921 - protein, 7 aa, Artificial Sequence
  Description of Artificial Sequence: Synthetic peptide
TKHGQPV

SEQ ID NO: 7922 - protein, 7 aa, Artificial Sequence
  Description of Artificial Sequence: Synthetic peptide
GSSDHAR

SEQ ID NO: 7923 - protein, 7 aa, Artificial Sequence
  Description of Artificial Sequence: Synthetic peptide
GGSDSRK

SEQ ID NO: 7924 - protein, 7 aa, Artificial Sequence
  Description of Artificial Sequence: Synthetic peptide
NRAGAGT

SEQ ID NO: 7925 - protein, 7 aa, Artificial Sequence
  Description of Artificial Sequence: Synthetic peptide
RQNSNAG

SEQ ID NO: 7926 - protein, 7 aa, Artificial Sequence
  Description of Artificial Sequence: Synthetic peptide
LGAQVNK

SEQ ID NO: 7927 - protein, 7 aa, Artificial Sequence
  Description of Artificial Sequence: Synthetic peptide
ATVKPEV

SEQ ID NO: 7928 - protein, 7 aa, Artificial Sequence
  Description of Artificial Sequence: Synthetic peptide
SKSQVNT

SEQ ID NO: 7929 - protein, 7 aa, Artificial Sequence
  Description of Artificial Sequence: Synthetic peptide
TGNKDKP

SEQ ID NO: 7930 - protein, 7 aa, Artificial Sequence
  Description of Artificial Sequence: Synthetic peptide
TSKNVNT

SEQ ID NO: 7931 - protein, 7 aa, Artificial Sequence
  Description of Artificial Sequence: Synthetic peptide
STNGGPS

SEQ ID NO: 7932 - protein, 7 aa, Artificial Sequence
  Description of Artificial Sequence: Synthetic peptide
DVGLGNK

SEQ ID NO: 7933 - protein, 7 aa, Artificial Sequence
  Description of Artificial Sequence: Synthetic peptide
APSNAKV

SEQ ID NO: 7934 - protein, 7 aa, Artificial Sequence
  Description of Artificial Sequence: Synthetic peptide
ISGTVAK

SEQ ID NO: 7935 - protein, 7 aa, Artificial Sequence
  Description of Artificial Sequence: Synthetic peptide
GGTVSQG

SEQ ID NO: 7936 - protein, 7 aa, Artificial Sequence
  Description of Artificial Sequence: Synthetic peptide
RTTPSSG

SEQ ID NO: 7937 - protein, 7 aa, Artificial Sequence
  Description of Artificial Sequence: Synthetic peptide
SSGVGSV

SEQ ID NO: 7938 - protein, 7 aa, Artificial Sequence
  Description of Artificial Sequence: Synthetic peptide
GNQKSSQ

SEQ ID NO: 7939 - protein, 7 aa, Artificial Sequence
  Description of Artificial Sequence: Synthetic peptide
TKASQTA

SEQ ID NO: 7940 - protein, 7 aa, Artificial Sequence
  Description of Artificial Sequence: Synthetic peptide
RQSTPSV

SEQ ID NO: 7941 - protein, 7 aa, Artificial Sequence
  Description of Artificial Sequence: Synthetic peptide
LAETKPT

SEQ ID NO: 7942 - protein, 7 aa, Artificial Sequence
  Description of Artificial Sequence: Synthetic peptide
ASSGTLV

SEQ ID NO: 7943 - protein, 7 aa, Artificial Sequence
  Description of Artificial Sequence: Synthetic peptide
AGGSGSP

SEQ ID NO: 7944 - protein, 7 aa, Artificial Sequence
  Description of Artificial Sequence: Synthetic peptide
VDSGGSK

SEQ ID NO: 7945 - protein, 7 aa, Artificial Sequence
  Description of Artificial Sequence: Synthetic peptide
SQNVSSG

SEQ ID NO: 7946 - protein, 7 aa, Artificial Sequence
  Description of Artificial Sequence: Synthetic peptide
ESQSART

SEQ ID NO: 7947 - protein, 7 aa, Artificial Sequence
  Description of Artificial Sequence: Synthetic peptide
SQADAKQ

SEQ ID NO: 7948 - protein, 7 aa, Artificial Sequence
  Description of Artificial Sequence: Synthetic peptide
QDPAPTK

SEQ ID NO: 7949 - protein, 7 aa, Artificial Sequence
  Description of Artificial Sequence: Synthetic peptide
LSGTSSS

SEQ ID NO: 7950 - protein, 7 aa, Artificial Sequence
  Description of Artificial Sequence: Synthetic peptide
ENSDRLR

SEQ ID NO: 7951 - protein, 7 aa, Artificial Sequence
  Description of Artificial Sequence: Synthetic peptide
SPKGQGD

SEQ ID NO: 7952 - protein, 7 aa, Artificial Sequence
  Description of Artificial Sequence: Synthetic peptide
LGNGQGN

SEQ ID NO: 7953 - protein, 7 aa, Artificial Sequence
  Description of Artificial Sequence: Synthetic peptide
VGATTGS

SEQ ID NO: 7954 - protein, 7 aa, Artificial Sequence
  Description of Artificial Sequence: Synthetic peptide
KLAQQNA

SEQ ID NO: 7955 - protein, 7 aa, Artificial Sequence
  Description of Artificial Sequence: Synthetic peptide
SSQAQGQ

SEQ ID NO: 7956 - protein, 7 aa, Artificial Sequence
  Description of Artificial Sequence: Synthetic peptide
HQKGGGQ

SEQ ID NO: 7957 - protein, 7 aa, Artificial Sequence
  Description of Artificial Sequence: Synthetic peptide
EGNNRAH

SEQ ID NO: 7958 - protein, 7 aa, Artificial Sequence
  Description of Artificial Sequence: Synthetic peptide
ATNANPR

SEQ ID NO: 7959 - protein, 7 aa, Artificial Sequence
  Description of Artificial Sequence: Synthetic peptide
STSSQSG

SEQ ID NO: 7960 - protein, 7 aa, Artificial Sequence
  Description of Artificial Sequence: Synthetic peptide
TPSKTAT

SEQ ID NO: 7961 - protein, 7 aa, Artificial Sequence
  Description of Artificial Sequence: Synthetic peptide
QTGTTSA

SEQ ID NO: 7962 - protein, 7 aa, Artificial Sequence
  Description of Artificial Sequence: Synthetic peptide
QGSHSVM

SEQ ID NO: 7963 - protein, 7 aa, Artificial Sequence
  Description of Artificial Sequence: Synthetic peptide
NQVSTLG

SEQ ID NO: 7964 - protein, 7 aa, Artificial Sequence
  Description of Artificial Sequence: Synthetic peptide
HAGKGPT

SEQ ID NO: 7965 - protein, 7 aa, Artificial Sequence
  Description of Artificial Sequence: Synthetic peptide
SSTGSTG

SEQ ID NO: 7966 - protein, 7 aa, Artificial Sequence
  Description of Artificial Sequence: Synthetic peptide
GRTDSAT

SEQ ID NO: 7967 - protein, 7 aa, Artificial Sequence
  Description of Artificial Sequence: Synthetic peptide
STSGSSH

SEQ ID NO: 7968 - protein, 7 aa, Artificial Sequence
  Description of Artificial Sequence: Synthetic peptide
SQVGTNT

SEQ ID NO: 7969 - protein, 7 aa, Artificial Sequence
  Description of Artificial Sequence: Synthetic peptide
SHNSKAS

SEQ ID NO: 7970 - protein, 7 aa, Artificial Sequence
  Description of Artificial Sequence: Synthetic peptide
LTRERNE

SEQ ID NO: 7971 - protein, 7 aa, Artificial Sequence
  Description of Artificial Sequence: Synthetic peptide
RNDGPSK

SEQ ID NO: 7972 - protein, 7 aa, Artificial Sequence
  Description of Artificial Sequence: Synthetic peptide
RMDGKNA

SEQ ID NO: 7973 - protein, 7 aa, Artificial Sequence
  Description of Artificial Sequence: Synthetic peptide
SATSTAA

SEQ ID NO: 7974 - protein, 7 aa, Artificial Sequence
  Description of Artificial Sequence: Synthetic peptide
QLDKHNV

SEQ ID NO: 7975 - protein, 7 aa, Artificial Sequence
  Description of Artificial Sequence: Synthetic peptide
AHSQGNT

SEQ ID NO: 7976 - protein, 7 aa, Artificial Sequence
  Description of Artificial Sequence: Synthetic peptide
STTPSGP

SEQ ID NO: 7977 - protein, 7 aa, Artificial Sequence
  Description of Artificial Sequence: Synthetic peptide
SVAPRSG

SEQ ID NO: 7978 - protein, 7 aa, Artificial Sequence
  Description of Artificial Sequence: Synthetic peptide
QGEHASS

SEQ ID NO: 7979 - protein, 7 aa, Artificial Sequence
  Description of Artificial Sequence: Synthetic peptide
DTNSGPR

SEQ ID NO: 7980 - protein, 7 aa, Artificial Sequence
  Description of Artificial Sequence: Synthetic peptide
DKAIPGS

SEQ ID NO: 7981 - protein, 7 aa, Artificial Sequence
  Description of Artificial Sequence: Synthetic peptide
DAPTSRS

SEQ ID NO: 7982 - protein, 7 aa, Artificial Sequence
  Description of Artificial Sequence: Synthetic peptide
QSTGIHG

SEQ ID NO: 7983 - protein, 7 aa, Artificial Sequence
  Description of Artificial Sequence: Synthetic peptide
GVMPKEN

SEQ ID NO: 7984 - protein, 7 aa, Artificial Sequence
  Description of Artificial Sequence: Synthetic peptide
TPSTEKG

SEQ ID NO: 7985 - protein, 7 aa, Artificial Sequence
  Description of Artificial Sequence: Synthetic peptide
MADSKAN

SEQ ID NO: 7986 - protein, 7 aa, Artificial Sequence
  Description of Artificial Sequence: Synthetic peptide
GLTTGKL

SEQ ID NO: 7987 - protein, 7 aa, Artificial Sequence
  Description of Artificial Sequence: Synthetic peptide
VSGPNPA

SEQ ID NO: 7988 - protein, 7 aa, Artificial Sequence
  Description of Artificial Sequence: Synthetic peptide
ALTTNKD

SEQ ID NO: 7989 - protein, 7 aa, Artificial Sequence
  Description of Artificial Sequence: Synthetic peptide
VSGQSSP

SEQ ID NO: 7990 - protein, 7 aa, Artificial Sequence
  Description of Artificial Sequence: Synthetic peptide
SSSPAKV

SEQ ID NO: 7991 - protein, 7 aa, Artificial Sequence
  Description of Artificial Sequence: Synthetic peptide
DSASKAS

SEQ ID NO: 7992 - protein, 7 aa, Artificial Sequence
  Description of Artificial Sequence: Synthetic peptide
LATSKTT

SEQ ID NO: 7993 - protein, 7 aa, Artificial Sequence
  Description of Artificial Sequence: Synthetic peptide
AHSSKPA

SEQ ID NO: 7994 - protein, 7 aa, Artificial Sequence
  Description of Artificial Sequence: Synthetic peptide
GGVPSTH

SEQ ID NO: 7995 - protein, 7 aa, Artificial Sequence
  Description of Artificial Sequence: Synthetic peptide
ESGERSH

SEQ ID NO: 7996 - protein, 7 aa, Artificial Sequence
  Description of Artificial Sequence: Synthetic peptide
GGEPKLA

SEQ ID NO: 7997 - protein, 7 aa, Artificial Sequence
  Description of Artificial Sequence: Synthetic peptide
NSGDRGG

SEQ ID NO: 7998 - protein, 7 aa, Artificial Sequence
  Description of Artificial Sequence: Synthetic peptide
NGVKSTS

SEQ ID NO: 7999 - protein, 7 aa, Artificial Sequence
  Description of Artificial Sequence: Synthetic peptide
TGARETA

SEQ ID NO: 8000 - protein, 7 aa, Artificial Sequence
  Description of Artificial Sequence: Synthetic peptide
SNAGQHS

SEQ ID NO: 8001 - protein, 7 aa, Artificial Sequence
  Description of Artificial Sequence: Synthetic peptide
SGGTSLV

SEQ ID NO: 8002 - protein, 7 aa, Artificial Sequence
  Description of Artificial Sequence: Synthetic peptide
SSGNIHS

SEQ ID NO: 8003 - protein, 7 aa, Artificial Sequence
  Description of Artificial Sequence: Synthetic peptide
QSSSKTS

SEQ ID NO: 8004 - protein, 7 aa, Artificial Sequence
  Description of Artificial Sequence: Synthetic peptide
HAGGTAA

SEQ ID NO: 8005 - protein, 7 aa, Artificial Sequence
  Description of Artificial Sequence: Synthetic peptide
DPSRKNS

SEQ ID NO: 8006 - protein, 7 aa, Artificial Sequence
  Description of Artificial Sequence: Synthetic peptide
AMDKQNT

SEQ ID NO: 8007 - protein, 7 aa, Artificial Sequence
  Description of Artificial Sequence: Synthetic peptide
GQEGAGR

SEQ ID NO: 8008 - protein, 7 aa, Artificial Sequence
  Description of Artificial Sequence: Synthetic peptide
GTSNSRV

SEQ ID NO: 8009 - protein, 7 aa, Artificial Sequence
  Description of Artificial Sequence: Synthetic peptide
STGPSSL

SEQ ID NO: 8010 - protein, 7 aa, Artificial Sequence
  Description of Artificial Sequence: Synthetic peptide
SGTEIRK

SEQ ID NO: 8011 - protein, 7 aa, Artificial Sequence
  Description of Artificial Sequence: Synthetic peptide
RREKANE

SEQ ID NO: 8012 - protein, 7 aa, Artificial Sequence
  Description of Artificial Sequence: Synthetic peptide
RDLKPIE

SEQ ID NO: 8013 - protein, 7 aa, Artificial Sequence
  Description of Artificial Sequence: Synthetic peptide
EGKSPLT

SEQ ID NO: 8014 - protein, 7 aa, Artificial Sequence
  Description of Artificial Sequence: Synthetic peptide
AGSNEHR

SEQ ID NO: 8015 - protein, 7 aa, Artificial Sequence
  Description of Artificial Sequence: Synthetic peptide
LASGDKG

SEQ ID NO: 8016 - protein, 7 aa, Artificial Sequence
  Description of Artificial Sequence: Synthetic peptide
AETTKSL

SEQ ID NO: 8017 - protein, 7 aa, Artificial Sequence
  Description of Artificial Sequence: Synthetic peptide
GMHTSAG

SEQ ID NO: 8018 - protein, 7 aa, Artificial Sequence
  Description of Artificial Sequence: Synthetic peptide
NAISSTK

SEQ ID NO: 8019 - protein, 7 aa, Artificial Sequence
  Description of Artificial Sequence: Synthetic peptide
TDGNRGS

SEQ ID NO: 8020 - protein, 7 aa, Artificial Sequence
  Description of Artificial Sequence: Synthetic peptide
TQKTVTG

SEQ ID NO: 8021 - protein, 7 aa, Artificial Sequence
  Description of Artificial Sequence: Synthetic peptide
RDTKESG

SEQ ID NO: 8022 - protein, 7 aa, Artificial Sequence
  Description of Artificial Sequence: Synthetic peptide
ATQSSNK

SEQ ID NO: 8023 - protein, 7 aa, Artificial Sequence
  Description of Artificial Sequence: Synthetic peptide
GISKATS

SEQ ID NO: 8024 - protein, 7 aa, Artificial Sequence
  Description of Artificial Sequence: Synthetic peptide
TQESSSR

SEQ ID NO: 8025 - protein, 7 aa, Artificial Sequence
  Description of Artificial Sequence: Synthetic peptide
SSGSGVP

SEQ ID NO: 8026 - protein, 7 aa, Artificial Sequence
  Description of Artificial Sequence: Synthetic peptide
NPTNNSS

SEQ ID NO: 8027 - protein, 7 aa, Artificial Sequence
  Description of Artificial Sequence: Synthetic peptide
NAGKDLI

SEQ ID NO: 8028 - protein, 7 aa, Artificial Sequence
  Description of Artificial Sequence: Synthetic peptide
SAASPGA

SEQ ID NO: 8029 - protein, 7 aa, Artificial Sequence
  Description of Artificial Sequence: Synthetic peptide
DTNHPGR

SEQ ID NO: 8030 - protein, 7 aa, Artificial Sequence
  Description of Artificial Sequence: Synthetic peptide
GQKSQGG

SEQ ID NO: 8031 - protein, 7 aa, Artificial Sequence
  Description of Artificial Sequence: Synthetic peptide
GDGKGFL

SEQ ID NO: 8032 - protein, 7 aa, Artificial Sequence
  Description of Artificial Sequence: Synthetic peptide
QSNSGSR

SEQ ID NO: 8033 - protein, 7 aa, Artificial Sequence
  Description of Artificial Sequence: Synthetic peptide
ESGASTA

SEQ ID NO: 8034 - protein, 7 aa, Artificial Sequence
  Description of Artificial Sequence: Synthetic peptide
NNTESNK

SEQ ID NO: 8035 - protein, 7 aa, Artificial Sequence
  Description of Artificial Sequence: Synthetic peptide
TTHERGS

SEQ ID NO: 8036 - protein, 7 aa, Artificial Sequence
  Description of Artificial Sequence: Synthetic peptide
SARSPNV

SEQ ID NO: 8037 - protein, 7 aa, Artificial Sequence
  Description of Artificial Sequence: Synthetic peptide
GVSTGDR

SEQ ID NO: 8038 - protein, 7 aa, Artificial Sequence
  Description of Artificial Sequence: Synthetic peptide
YQSANAH

SEQ ID NO: 8039 - protein, 7 aa, Artificial Sequence
  Description of Artificial Sequence: Synthetic peptide
ISGNSQA

SEQ ID NO: 8040 - protein, 7 aa, Artificial Sequence
  Description of Artificial Sequence: Synthetic peptide
RGSDAKS

SEQ ID NO: 8041 - protein, 7 aa, Artificial Sequence
  Description of Artificial Sequence: Synthetic peptide
SGSSQGN

SEQ ID NO: 8042 - protein, 7 aa, Artificial Sequence
  Description of Artificial Sequence: Synthetic peptide
DRGSGTA

SEQ ID NO: 8043 - protein, 7 aa, Artificial Sequence
  Description of Artificial Sequence: Synthetic peptide
GHDSAPV

SEQ ID NO: 8044 - protein, 7 aa, Artificial Sequence
  Description of Artificial Sequence: Synthetic peptide
GSGQTLT

SEQ ID NO: 8045 - protein, 7 aa, Artificial Sequence
  Description of Artificial Sequence: Synthetic peptide
VTSSSVS

SEQ ID NO: 8046 - protein, 7 aa, Artificial Sequence
  Description of Artificial Sequence: Synthetic peptide
EGKSSLN

SEQ ID NO: 8047 - protein, 7 aa, Artificial Sequence
  Description of Artificial Sequence: Synthetic peptide
AKTNENK

SEQ ID NO: 8048 - protein, 7 aa, Artificial Sequence
  Description of Artificial Sequence: Synthetic peptide
GDRKGGQ

SEQ ID NO: 8049 - protein, 7 aa, Artificial Sequence
  Description of Artificial Sequence: Synthetic peptide
QAGSASM

SEQ ID NO: 8050 - protein, 7 aa, Artificial Sequence
  Description of Artificial Sequence: Synthetic peptide
ESTDPRI

SEQ ID NO: 8051 - protein, 7 aa, Artificial Sequence
  Description of Artificial Sequence: Synthetic peptide
LESKHAT

SEQ ID NO: 8052 - protein, 7 aa, Artificial Sequence
  Description of Artificial Sequence: Synthetic peptide
GKAQTNV

SEQ ID NO: 8053 - protein, 7 aa, Artificial Sequence
  Description of Artificial Sequence: Synthetic peptide
ERVSTNQ

SEQ ID NO: 8054 - protein, 7 aa, Artificial Sequence
  Description of Artificial Sequence: Synthetic peptide
SNVSGSG

SEQ ID NO: 8055 - protein, 7 aa, Artificial Sequence
  Description of Artificial Sequence: Synthetic peptide
TLQNPNG

SEQ ID NO: 8056 - protein, 7 aa, Artificial Sequence
  Description of Artificial Sequence: Synthetic peptide
APSPGGS

SEQ ID NO: 8057 - protein, 7 aa, Artificial Sequence
  Description of Artificial Sequence: Synthetic peptide
SAQAPTL

SEQ ID NO: 8058 - protein, 7 aa, Artificial Sequence
  Description of Artificial Sequence: Synthetic peptide
TGSDKSD

SEQ ID NO: 8059 - protein, 7 aa, Artificial Sequence
  Description of Artificial Sequence: Synthetic peptide
TSTAQST

SEQ ID NO: 8060 - protein, 7 aa, Artificial Sequence
  Description of Artificial Sequence: Synthetic peptide
SNGAASV

SEQ ID NO: 8061 - protein, 7 aa, Artificial Sequence
  Description of Artificial Sequence: Synthetic peptide
ESIKANS

SEQ ID NO: 8062 - protein, 7 aa, Artificial Sequence
  Description of Artificial Sequence: Synthetic peptide
TGSAPTT

SEQ ID NO: 8063 - protein, 7 aa, Artificial Sequence
  Description of Artificial Sequence: Synthetic peptide
LRAQKME

SEQ ID NO: 8064 - protein, 7 aa, Artificial Sequence
  Description of Artificial Sequence: Synthetic peptide
NTADRMG

SEQ ID NO: 8065 - protein, 7 aa, Artificial Sequence
  Description of Artificial Sequence: Synthetic peptide
ADEGSKK

SEQ ID NO: 8066 - protein, 7 aa, Artificial Sequence
  Description of Artificial Sequence: Synthetic peptide
VKESSRG

SEQ ID NO: 8067 - protein, 7 aa, Artificial Sequence
  Description of Artificial Sequence: Synthetic peptide
SSKQVNG

SEQ ID NO: 8068 - protein, 7 aa, Artificial Sequence
  Description of Artificial Sequence: Synthetic peptide
NGSSSPS

SEQ ID NO: 8069 - protein, 7 aa, Artificial Sequence
  Description of Artificial Sequence: Synthetic peptide
DSHGART

SEQ ID NO: 8070 - protein, 7 aa, Artificial Sequence
  Description of Artificial Sequence: Synthetic peptide
ANAKQGA

SEQ ID NO: 8071 - protein, 7 aa, Artificial Sequence
  Description of Artificial Sequence: Synthetic peptide
GSSNSQA

SEQ ID NO: 8072 - protein, 7 aa, Artificial Sequence
  Description of Artificial Sequence: Synthetic peptide
NSTGSPI

SEQ ID NO: 8073 - protein, 7 aa, Artificial Sequence
  Description of Artificial Sequence: Synthetic peptide
GTTGTLT

SEQ ID NO: 8074 - protein, 7 aa, Artificial Sequence
  Description of Artificial Sequence: Synthetic peptide
GVQDPAR

SEQ ID NO: 8075 - protein, 7 aa, Artificial Sequence
  Description of Artificial Sequence: Synthetic peptide
GSQSGSS

SEQ ID NO: 8076 - protein, 7 aa, Artificial Sequence
  Description of Artificial Sequence: Synthetic peptide
ATSSSQS

SEQ ID NO: 8077 - protein, 7 aa, Artificial Sequence
  Description of Artificial Sequence: Synthetic peptide
KESSPSL

SEQ ID NO: 8078 - protein, 7 aa, Artificial Sequence
  Description of Artificial Sequence: Synthetic peptide
ALPSKTT

SEQ ID NO: 8079 - protein, 7 aa, Artificial Sequence
  Description of Artificial Sequence: Synthetic peptide
SGSNTLS

SEQ ID NO: 8080 - protein, 7 aa, Artificial Sequence
  Description of Artificial Sequence: Synthetic peptide
SNQSSVI

SEQ ID NO: 8081 - protein, 7 aa, Artificial Sequence
  Description of Artificial Sequence: Synthetic peptide
SPLKQGG

SEQ ID NO: 8082 - protein, 7 aa, Artificial Sequence
  Description of Artificial Sequence: Synthetic peptide
SNSGSRL

SEQ ID NO: 8083 - protein, 7 aa, Artificial Sequence
  Description of Artificial Sequence: Synthetic peptide
DAGNGSH

SEQ ID NO: 8084 - protein, 7 aa, Artificial Sequence
  Description of Artificial Sequence: Synthetic peptide
GQNKPVN

SEQ ID NO: 8085 - protein, 7 aa, Artificial Sequence
  Description of Artificial Sequence: Synthetic peptide
ASTKPLL

SEQ ID NO: 8086 - protein, 7 aa, Artificial Sequence
  Description of Artificial Sequence: Synthetic peptide
GERPSPA

SEQ ID NO: 8087 - protein, 7 aa, Artificial Sequence
  Description of Artificial Sequence: Synthetic peptide
NSQNTHV

SEQ ID NO: 8088 - protein, 7 aa, Artificial Sequence
  Description of Artificial Sequence: Synthetic peptide
SSGQSGK

SEQ ID NO: 8089 - protein, 7 aa, Artificial Sequence
  Description of Artificial Sequence: Synthetic peptide
SPTKPVD

SEQ ID NO: 8090 - protein, 7 aa, Artificial Sequence
  Description of Artificial Sequence: Synthetic peptide
DPPSTSK

SEQ ID NO: 8091 - protein, 7 aa, Artificial Sequence
  Description of Artificial Sequence: Synthetic peptide
VISPKTN

SEQ ID NO: 8092 - protein, 7 aa, Artificial Sequence
  Description of Artificial Sequence: Synthetic peptide
NVSGHPN

SEQ ID NO: 8093 - protein, 7 aa, Artificial Sequence
  Description of Artificial Sequence: Synthetic peptide
SSGSGPM

SEQ ID NO: 8094 - protein, 7 aa, Artificial Sequence
  Description of Artificial Sequence: Synthetic peptide
EATSSTN

SEQ ID NO: 8095 - protein, 7 aa, Artificial Sequence
  Description of Artificial Sequence: Synthetic peptide
GQTQGRP

SEQ ID NO: 8096 - protein, 7 aa, Artificial Sequence
  Description of Artificial Sequence: Synthetic peptide
LSSSPIK

SEQ ID NO: 8097 - protein, 7 aa, Artificial Sequence
  Description of Artificial Sequence: Synthetic peptide
STNSKLM

SEQ ID NO: 8098 - protein, 7 aa, Artificial Sequence
  Description of Artificial Sequence: Synthetic peptide
ETASKVQ

SEQ ID NO: 8099 - protein, 7 aa, Artificial Sequence
  Description of Artificial Sequence: Synthetic peptide
VMSKAGS

SEQ ID NO: 8100 - protein, 7 aa, Artificial Sequence
  Description of Artificial Sequence: Synthetic peptide
SGGSSGL

SEQ ID NO: 8101 - protein, 7 aa, Artificial Sequence
  Description of Artificial Sequence: Synthetic peptide
ANSGSNL

SEQ ID NO: 8102 - protein, 7 aa, Artificial Sequence
  Description of Artificial Sequence: Synthetic peptide
STRPSSA

SEQ ID NO: 8103 - protein, 7 aa, Artificial Sequence
  Description of Artificial Sequence: Synthetic peptide
AQEQSGK

SEQ ID NO: 8104 - protein, 7 aa, Artificial Sequence
  Description of Artificial Sequence: Synthetic peptide
VANSHNK

SEQ ID NO: 8105 - protein, 7 aa, Artificial Sequence
  Description of Artificial Sequence: Synthetic peptide
ATMNASK

SEQ ID NO: 8106 - protein, 7 aa, Artificial Sequence
  Description of Artificial Sequence: Synthetic peptide
NPVKSTG

SEQ ID NO: 8107 - protein, 7 aa, Artificial Sequence
  Description of Artificial Sequence: Synthetic peptide
NANNSAS

SEQ ID NO: 8108 - protein, 7 aa, Artificial Sequence
  Description of Artificial Sequence: Synthetic peptide
SNATATM

SEQ ID NO: 8109 - protein, 7 aa, Artificial Sequence
  Description of Artificial Sequence: Synthetic peptide
DRQPTNT

SEQ ID NO: 8110 - protein, 7 aa, Artificial Sequence
  Description of Artificial Sequence: Synthetic peptide
GSETTVR

SEQ ID NO: 8111 - protein, 7 aa, Artificial Sequence
  Description of Artificial Sequence: Synthetic peptide
QSASANS

SEQ ID NO: 8112 - protein, 7 aa, Artificial Sequence
  Description of Artificial Sequence: Synthetic peptide
SGTPQRG

SEQ ID NO: 8113 - protein, 7 aa, Artificial Sequence
  Description of Artificial Sequence: Synthetic peptide
QSHKETT

SEQ ID NO: 8114 - protein, 7 aa, Artificial Sequence
  Description of Artificial Sequence: Synthetic peptide
TESNGHS

SEQ ID NO: 8115 - protein, 7 aa, Artificial Sequence
  Description of Artificial Sequence: Synthetic peptide
TKNTGNL

SEQ ID NO: 8116 - protein, 7 aa, Artificial Sequence
  Description of Artificial Sequence: Synthetic peptide
SSNDQRK

SEQ ID NO: 8117 - protein, 7 aa, Artificial Sequence
  Description of Artificial Sequence: Synthetic peptide
RNGGSSL

SEQ ID NO: 8118 - protein, 7 aa, Artificial Sequence
  Description of Artificial Sequence: Synthetic peptide
EGRASSG

SEQ ID NO: 8119 - protein, 7 aa, Artificial Sequence
  Description of Artificial Sequence: Synthetic peptide
DETQSRK

SEQ ID NO: 8120 - protein, 7 aa, Artificial Sequence
  Description of Artificial Sequence: Synthetic peptide
ETHTAKS

SEQ ID NO: 8121 - protein, 7 aa, Artificial Sequence
  Description of Artificial Sequence: Synthetic peptide
ASTSNAG

SEQ ID NO: 8122 - protein, 7 aa, Artificial Sequence
  Description of Artificial Sequence: Synthetic peptide
ASSNKEG

SEQ ID NO: 8123 - protein, 7 aa, Artificial Sequence
  Description of Artificial Sequence: Synthetic peptide
AGANTSN

SEQ ID NO: 8124 - protein, 7 aa, Artificial Sequence
  Description of Artificial Sequence: Synthetic peptide
GKETSLV

SEQ ID NO: 8125 - protein, 7 aa, Artificial Sequence
  Description of Artificial Sequence: Synthetic peptide
GGVSTNG

SEQ ID NO: 8126 - protein, 7 aa, Artificial Sequence
  Description of Artificial Sequence: Synthetic peptide
VANSNAK

SEQ ID NO: 8127 - protein, 7 aa, Artificial Sequence
  Description of Artificial Sequence: Synthetic peptide
VNTKSPT

SEQ ID NO: 8128 - protein, 7 aa, Artificial Sequence
  Description of Artificial Sequence: Synthetic peptide
TTSKASN

SEQ ID NO: 8129 - protein, 7 aa, Artificial Sequence
  Description of Artificial Sequence: Synthetic peptide
QLAEHGK

SEQ ID NO: 8130 - protein, 7 aa, Artificial Sequence
  Description of Artificial Sequence: Synthetic peptide
GANATDR

SEQ ID NO: 8131 - protein, 7 aa, Artificial Sequence
  Description of Artificial Sequence: Synthetic peptide
TADTPKQ

SEQ ID NO: 8132 - protein, 7 aa, Artificial Sequence
  Description of Artificial Sequence: Synthetic peptide
TNTTSTT

SEQ ID NO: 8133 - protein, 7 aa, Artificial Sequence
  Description of Artificial Sequence: Synthetic peptide
DTGRSSP

SEQ ID NO: 8134 - protein, 7 aa, Artificial Sequence
  Description of Artificial Sequence: Synthetic peptide
GTVPTSQ

SEQ ID NO: 8135 - protein, 7 aa, Artificial Sequence
  Description of Artificial Sequence: Synthetic peptide
GGTQDLR

SEQ ID NO: 8136 - protein, 7 aa, Artificial Sequence
  Description of Artificial Sequence: Synthetic peptide
GHDKALA

SEQ ID NO: 8137 - protein, 7 aa, Artificial Sequence
  Description of Artificial Sequence: Synthetic peptide
LPTTGSG

SEQ ID NO: 8138 - protein, 7 aa, Artificial Sequence
  Description of Artificial Sequence: Synthetic peptide
QGTSSVV

SEQ ID NO: 8139 - protein, 7 aa, Artificial Sequence
  Description of Artificial Sequence: Synthetic peptide
QGNGGPS

SEQ ID NO: 8140 - protein, 7 aa, Artificial Sequence
  Description of Artificial Sequence: Synthetic peptide
RPTDKST

SEQ ID NO: 8141 - protein, 7 aa, Artificial Sequence
  Description of Artificial Sequence: Synthetic peptide
SIATPSK

SEQ ID NO: 8142 - protein, 7 aa, Artificial Sequence
  Description of Artificial Sequence: Synthetic peptide
RQDKLGS

SEQ ID NO: 8143 - protein, 7 aa, Artificial Sequence
  Description of Artificial Sequence: Synthetic peptide
STKQSSG

SEQ ID NO: 8144 - protein, 7 aa, Artificial Sequence
  Description of Artificial Sequence: Synthetic peptide
MADKAAV

SEQ ID NO: 8145 - protein, 7 aa, Artificial Sequence
  Description of Artificial Sequence: Synthetic peptide
VGSDAVR

SEQ ID NO: 8146 - protein, 7 aa, Artificial Sequence
  Description of Artificial Sequence: Synthetic peptide
NVNSKDK

SEQ ID NO: 8147 - protein, 7 aa, Artificial Sequence
  Description of Artificial Sequence: Synthetic peptide
NLSTGGG

SEQ ID NO: 8148 - protein, 7 aa, Artificial Sequence
  Description of Artificial Sequence: Synthetic peptide
GRNVPSS

SEQ ID NO: 8149 - protein, 7 aa, Artificial Sequence
  Description of Artificial Sequence: Synthetic peptide
ANKEGPR

SEQ ID NO: 8150 - protein, 7 aa, Artificial Sequence
  Description of Artificial Sequence: Synthetic peptide
NASQTST

SEQ ID NO: 8151 - protein, 7 aa, Artificial Sequence
  Description of Artificial Sequence: Synthetic peptide
RNGGNSN

SEQ ID NO: 8152 - protein, 7 aa, Artificial Sequence
  Description of Artificial Sequence: Synthetic peptide
ASAKGSY

SEQ ID NO: 8153 - protein, 7 aa, Artificial Sequence
  Description of Artificial Sequence: Synthetic peptide
GETNTNR

SEQ ID NO: 8154 - protein, 7 aa, Artificial Sequence
  Description of Artificial Sequence: Synthetic peptide
IGTPATS

SEQ ID NO: 8155 - protein, 7 aa, Artificial Sequence
  Description of Artificial Sequence: Synthetic peptide
DSNATSR

SEQ ID NO: 8156 - protein, 7 aa, Artificial Sequence
  Description of Artificial Sequence: Synthetic peptide
QKVTNHE

SEQ ID NO: 8157 - protein, 7 aa, Artificial Sequence
  Description of Artificial Sequence: Synthetic peptide
ADGRSST

SEQ ID NO: 8158 - protein, 7 aa, Artificial Sequence
  Description of Artificial Sequence: Synthetic peptide
GATGSMN

SEQ ID NO: 8159 - protein, 7 aa, Artificial Sequence
  Description of Artificial Sequence: Synthetic peptide
GLSQSPT

SEQ ID NO: 8160 - protein, 7 aa, Artificial Sequence
  Description of Artificial Sequence: Synthetic peptide
TKSNEHA

SEQ ID NO: 8161 - protein, 7 aa, Artificial Sequence
  Description of Artificial Sequence: Synthetic peptide
SSDTRGL

SEQ ID NO: 8162 - protein, 7 aa, Artificial Sequence
  Description of Artificial Sequence: Synthetic peptide
VATKANT

SEQ ID NO: 8163 - protein, 7 aa, Artificial Sequence
  Description of Artificial Sequence: Synthetic peptide
DTGGKMV

SEQ ID NO: 8164 - protein, 7 aa, Artificial Sequence
  Description of Artificial Sequence: Synthetic peptide
AQHTKSA

SEQ ID NO: 8165 - protein, 7 aa, Artificial Sequence
  Description of Artificial Sequence: Synthetic peptide
APGSKHS

SEQ ID NO: 8166 - protein, 7 aa, Artificial Sequence
  Description of Artificial Sequence: Synthetic peptide
GTSIGDG

SEQ ID NO: 8167 - protein, 7 aa, Artificial Sequence
  Description of Artificial Sequence: Synthetic peptide
GSQDPRR

SEQ ID NO: 8168 - protein, 7 aa, Artificial Sequence
  Description of Artificial Sequence: Synthetic peptide
GLMKESP

SEQ ID NO: 8169 - protein, 7 aa, Artificial Sequence
  Description of Artificial Sequence: Synthetic peptide
VTHGKSE

SEQ ID NO: 8170 - protein, 7 aa, Artificial Sequence
  Description of Artificial Sequence: Synthetic peptide
SAASSNA

SEQ ID NO: 8171 - protein, 7 aa, Artificial Sequence
  Description of Artificial Sequence: Synthetic peptide
AAGVSSV

SEQ ID NO: 8172 - protein, 7 aa, Artificial Sequence
  Description of Artificial Sequence: Synthetic peptide
SQNEQRS

SEQ ID NO: 8173 - protein, 7 aa, Artificial Sequence
  Description of Artificial Sequence: Synthetic peptide
NSTSHSE

SEQ ID NO: 8174 - protein, 7 aa, Artificial Sequence
  Description of Artificial Sequence: Synthetic peptide
NHEAGKL

SEQ ID NO: 8175 - protein, 7 aa, Artificial Sequence
  Description of Artificial Sequence: Synthetic peptide
NGSPSAQ

SEQ ID NO: 8176 - protein, 7 aa, Artificial Sequence
  Description of Artificial Sequence: Synthetic peptide
TNTKTPS

SEQ ID NO: 8177 - protein, 7 aa, Artificial Sequence
  Description of Artificial Sequence: Synthetic peptide
DKGQTSR

SEQ ID NO: 8178 - protein, 7 aa, Artificial Sequence
  Description of Artificial Sequence: Synthetic peptide
SGTSTGH

SEQ ID NO: 8179 - protein, 7 aa, Artificial Sequence
  Description of Artificial Sequence: Synthetic peptide
VSSNSVA

SEQ ID NO: 8180 - protein, 7 aa, Artificial Sequence
  Description of Artificial Sequence: Synthetic peptide
QSNVPSS

SEQ ID NO: 8181 - protein, 7 aa, Artificial Sequence
  Description of Artificial Sequence: Synthetic peptide
DGGTHQA

SEQ ID NO: 8182 - protein, 7 aa, Artificial Sequence
  Description of Artificial Sequence: Synthetic peptide
HDGKQSL

SEQ ID NO: 8183 - protein, 7 aa, Artificial Sequence
  Description of Artificial Sequence: Synthetic peptide
HNTSSTQ

SEQ ID NO: 8184 - protein, 7 aa, Artificial Sequence
  Description of Artificial Sequence: Synthetic peptide
SPDSNIK

SEQ ID NO: 8185 - protein, 7 aa, Artificial Sequence
  Description of Artificial Sequence: Synthetic peptide
MASSTNV

SEQ ID NO: 8186 - protein, 7 aa, Artificial Sequence
  Description of Artificial Sequence: Synthetic peptide
GQIPDAK

SEQ ID NO: 8187 - protein, 7 aa, Artificial Sequence
  Description of Artificial Sequence: Synthetic peptide
GHSGSPN

SEQ ID NO: 8188 - protein, 7 aa, Artificial Sequence
  Description of Artificial Sequence: Synthetic peptide
AGVANGT

SEQ ID NO: 8189 - protein, 7 aa, Artificial Sequence
  Description of Artificial Sequence: Synthetic peptide
RSTSPSN

SEQ ID NO: 8190 - protein, 7 aa, Artificial Sequence
  Description of Artificial Sequence: Synthetic peptide
HPSNTQK

SEQ ID NO: 8191 - protein, 7 aa, Artificial Sequence
  Description of Artificial Sequence: Synthetic peptide
TSGSTLA

SEQ ID NO: 8192 - protein, 7 aa, Artificial Sequence
  Description of Artificial Sequence: Synthetic peptide
SSTSKGA

SEQ ID NO: 8193 - protein, 7 aa, Artificial Sequence
  Description of Artificial Sequence: Synthetic peptide
NSKTSSG

SEQ ID NO: 8194 - protein, 7 aa, Artificial Sequence
  Description of Artificial Sequence: Synthetic peptide
GDMSTKN

SEQ ID NO: 8195 - protein, 7 aa, Artificial Sequence
  Description of Artificial Sequence: Synthetic peptide
GGTKTEV

SEQ ID NO: 8196 - protein, 7 aa, Artificial Sequence
  Description of Artificial Sequence: Synthetic peptide
TTGEKGL

SEQ ID NO: 8197 - protein, 7 aa, Artificial Sequence
  Description of Artificial Sequence: Synthetic peptide
GLDTKSA

SEQ ID NO: 8198 - protein, 7 aa, Artificial Sequence
  Description of Artificial Sequence: Synthetic peptide
SNGASPV

SEQ ID NO: 8199 - protein, 7 aa, Artificial Sequence
  Description of Artificial Sequence: Synthetic peptide
LQTASSG

SEQ ID NO: 8200 - protein, 7 aa, Artificial Sequence
  Description of Artificial Sequence: Synthetic peptide
GSVGGDR

SEQ ID NO: 8201 - protein, 7 aa, Artificial Sequence
  Description of Artificial Sequence: Synthetic peptide
STTSSRS

SEQ ID NO: 8202 - protein, 7 aa, Artificial Sequence
  Description of Artificial Sequence: Synthetic peptide
SESHKPA

SEQ ID NO: 8203 - protein, 7 aa, Artificial Sequence
  Description of Artificial Sequence: Synthetic peptide
NPSSAPQ

SEQ ID NO: 8204 - protein, 7 aa, Artificial Sequence
  Description of Artificial Sequence: Synthetic peptide
TSSNKEQ

SEQ ID NO: 8205 - protein, 7 aa, Artificial Sequence
  Description of Artificial Sequence: Synthetic peptide
SGVSTSP

SEQ ID NO: 8206 - protein, 7 aa, Artificial Sequence
  Description of Artificial Sequence: Synthetic peptide
QESQQNS

SEQ ID NO: 8207 - protein, 7 aa, Artificial Sequence
  Description of Artificial Sequence: Synthetic peptide
LNEGKPL

SEQ ID NO: 8208 - protein, 7 aa, Artificial Sequence
  Description of Artificial Sequence: Synthetic peptide
ENPTNTS

SEQ ID NO: 8209 - protein, 7 aa, Artificial Sequence
  Description of Artificial Sequence: Synthetic peptide
DATQPSK

SEQ ID NO: 8210 - protein, 7 aa, Artificial Sequence
  Description of Artificial Sequence: Synthetic peptide
AQDKASS

SEQ ID NO: 8211 - protein, 7 aa, Artificial Sequence
  Description of Artificial Sequence: Synthetic peptide
GSKNAST

SEQ ID NO: 8212 - protein, 7 aa, Artificial Sequence
  Description of Artificial Sequence: Synthetic peptide
NNSGQNQ

SEQ ID NO: 8213 - protein, 7 aa, Artificial Sequence
  Description of Artificial Sequence: Synthetic peptide
DGPGSTK

SEQ ID NO: 8214 - protein, 7 aa, Artificial Sequence
  Description of Artificial Sequence: Synthetic peptide
LNGSQTH

SEQ ID NO: 8215 - protein, 7 aa, Artificial Sequence
  Description of Artificial Sequence: Synthetic peptide
KATAQSG

SEQ ID NO: 8216 - protein, 7 aa, Artificial Sequence
  Description of Artificial Sequence: Synthetic peptide
TLSGSAH

SEQ ID NO: 8217 - protein, 7 aa, Artificial Sequence
  Description of Artificial Sequence: Synthetic peptide
GSPSTSG

SEQ ID NO: 8218 - protein, 7 aa, Artificial Sequence
  Description of Artificial Sequence: Synthetic peptide
GLSRPNE

SEQ ID NO: 8219 - protein, 7 aa, Artificial Sequence
  Description of Artificial Sequence: Synthetic peptide
SRTENRI

SEQ ID NO: 8220 - protein, 7 aa, Artificial Sequence
  Description of Artificial Sequence: Synthetic peptide
DDKSNRA

SEQ ID NO: 8221 - protein, 7 aa, Artificial Sequence
  Description of Artificial Sequence: Synthetic peptide
QGNSAVQ

SEQ ID NO: 8222 - protein, 7 aa, Artificial Sequence
  Description of Artificial Sequence: Synthetic peptide
ASTSPAV

SEQ ID NO: 8223 - protein, 7 aa, Artificial Sequence
  Description of Artificial Sequence: Synthetic peptide
TGSTNTT

SEQ ID NO: 8224 - protein, 7 aa, Artificial Sequence
  Description of Artificial Sequence: Synthetic peptide
ERAGPSP

SEQ ID NO: 8225 - protein, 7 aa, Artificial Sequence
  Description of Artificial Sequence: Synthetic peptide
VDPSPAR

SEQ ID NO: 8226 - protein, 7 aa, Artificial Sequence
  Description of Artificial Sequence: Synthetic peptide
VVNSSTA

SEQ ID NO: 8227 - protein, 7 aa, Artificial Sequence
  Description of Artificial Sequence: Synthetic peptide
LREPKGT

SEQ ID NO: 8228 - protein, 7 aa, Artificial Sequence
  Description of Artificial Sequence: Synthetic peptide
LNASSTT

SEQ ID NO: 8229 - protein, 7 aa, Artificial Sequence
  Description of Artificial Sequence: Synthetic peptide
STMSSSS

SEQ ID NO: 8230 - protein, 7 aa, Artificial Sequence
  Description of Artificial Sequence: Synthetic peptide
EINNPKI

SEQ ID NO: 8231 - protein, 7 aa, Artificial Sequence
  Description of Artificial Sequence: Synthetic peptide
KSNQTSQ

SEQ ID NO: 8232 - protein, 7 aa, Artificial Sequence
  Description of Artificial Sequence: Synthetic peptide
GSTSQEK

SEQ ID NO: 8233 - protein, 7 aa, Artificial Sequence
  Description of Artificial Sequence: Synthetic peptide
GNSGDLR

SEQ ID NO: 8234 - protein, 7 aa, Artificial Sequence
  Description of Artificial Sequence: Synthetic peptide
SGSNSVS

SEQ ID NO: 8235 - protein, 7 aa, Artificial Sequence
  Description of Artificial Sequence: Synthetic peptide
KSGSSTN

SEQ ID NO: 8236 - protein, 7 aa, Artificial Sequence
  Description of Artificial Sequence: Synthetic peptide
SQGSAPT

SEQ ID NO: 8237 - protein, 7 aa, Artificial Sequence
  Description of Artificial Sequence: Synthetic peptide
NRTAQST

SEQ ID NO: 8238 - protein, 7 aa, Artificial Sequence
  Description of Artificial Sequence: Synthetic peptide
QGSTKNL

SEQ ID NO: 8239 - protein, 7 aa, Artificial Sequence
  Description of Artificial Sequence: Synthetic peptide
ESKQPSL

SEQ ID NO: 8240 - protein, 7 aa, Artificial Sequence
  Description of Artificial Sequence: Synthetic peptide
NHGQKDN

SEQ ID NO: 8241 - protein, 7 aa, Artificial Sequence
  Description of Artificial Sequence: Synthetic peptide
NAATQTR

SEQ ID NO: 8242 - protein, 7 aa, Artificial Sequence
  Description of Artificial Sequence: Synthetic peptide
RPVNPPE

SEQ ID NO: 8243 - protein, 7 aa, Artificial Sequence
  Description of Artificial Sequence: Synthetic peptide
SGSSSLG

SEQ ID NO: 8244 - protein, 7 aa, Artificial Sequence
  Description of Artificial Sequence: Synthetic peptide
QQGHNSA

SEQ ID NO: 8245 - protein, 7 aa, Artificial Sequence
  Description of Artificial Sequence: Synthetic peptide
RKDVSST

SEQ ID NO: 8246 - protein, 7 aa, Artificial Sequence
  Description of Artificial Sequence: Synthetic peptide
DGVSSKG

SEQ ID NO: 8247 - protein, 7 aa, Artificial Sequence
  Description of Artificial Sequence: Synthetic peptide
GDSPSKL

SEQ ID NO: 8248 - protein, 7 aa, Artificial Sequence
  Description of Artificial Sequence: Synthetic peptide
SQDTHHK

SEQ ID NO: 8249 - protein, 7 aa, Artificial Sequence
  Description of Artificial Sequence: Synthetic peptide
SNTGGVA

SEQ ID NO: 8250 - protein, 7 aa, Artificial Sequence
  Description of Artificial Sequence: Synthetic peptide
NGATSRG

SEQ ID NO: 8251 - protein, 7 aa, Artificial Sequence
  Description of Artificial Sequence: Synthetic peptide
HRGETSA

SEQ ID NO: 8252 - protein, 7 aa, Artificial Sequence
  Description of Artificial Sequence: Synthetic peptide
ENRQTIK

SEQ ID NO: 8253 - protein, 7 aa, Artificial Sequence
  Description of Artificial Sequence: Synthetic peptide
HNVEKTK

SEQ ID NO: 8254 - protein, 7 aa, Artificial Sequence
  Description of Artificial Sequence: Synthetic peptide
LQSNSSQ

SEQ ID NO: 8255 - protein, 7 aa, Artificial Sequence
  Description of Artificial Sequence: Synthetic peptide
NGNSSTS

SEQ ID NO: 8256 - protein, 7 aa, Artificial Sequence
  Description of Artificial Sequence: Synthetic peptide
TVQSTSR

SEQ ID NO: 8257 - protein, 7 aa, Artificial Sequence
  Description of Artificial Sequence: Synthetic peptide
STDSTPK

SEQ ID NO: 8258 - protein, 7 aa, Artificial Sequence
  Description of Artificial Sequence: Synthetic peptide
TSKPTNM

SEQ ID NO: 8259 - protein, 7 aa, Artificial Sequence
  Description of Artificial Sequence: Synthetic peptide
AKSSTTS

SEQ ID NO: 8260 - protein, 7 aa, Artificial Sequence
  Description of Artificial Sequence: Synthetic peptide
KTQGVGN

SEQ ID NO: 8261 - protein, 7 aa, Artificial Sequence
  Description of Artificial Sequence: Synthetic peptide
MGTGNTS

SEQ ID NO: 8262 - protein, 7 aa, Artificial Sequence
  Description of Artificial Sequence: Synthetic peptide
MGTANNH

SEQ ID NO: 8263 - protein, 7 aa, Artificial Sequence
  Description of Artificial Sequence: Synthetic peptide
GTEMPKL

SEQ ID NO: 8264 - protein, 7 aa, Artificial Sequence
  Description of Artificial Sequence: Synthetic peptide
GSTSKTQ

SEQ ID NO: 8265 - protein, 7 aa, Artificial Sequence
  Description of Artificial Sequence: Synthetic peptide
VQSTGSG

SEQ ID NO: 8266 - protein, 7 aa, Artificial Sequence
  Description of Artificial Sequence: Synthetic peptide
SQPGTTS

SEQ ID NO: 8267 - protein, 7 aa, Artificial Sequence
  Description of Artificial Sequence: Synthetic peptide
GTLTPAT

SEQ ID NO: 8268 - protein, 7 aa, Artificial Sequence
  Description of Artificial Sequence: Synthetic peptide
SPAAHSQ

SEQ ID NO: 8269 - protein, 7 aa, Artificial Sequence
  Description of Artificial Sequence: Synthetic peptide
TGSKTQS

SEQ ID NO: 8270 - protein, 7 aa, Artificial Sequence
  Description of Artificial Sequence: Synthetic peptide
NRAAQGG

SEQ ID NO: 8271 - protein, 7 aa, Artificial Sequence
  Description of Artificial Sequence: Synthetic peptide
TADRSGA

SEQ ID NO: 8272 - protein, 7 aa, Artificial Sequence
  Description of Artificial Sequence: Synthetic peptide
STTSDSK

SEQ ID NO: 8273 - protein, 7 aa, Artificial Sequence
  Description of Artificial Sequence: Synthetic peptide
MSEGTRS

SEQ ID NO: 8274 - protein, 7 aa, Artificial Sequence
  Description of Artificial Sequence: Synthetic peptide
HQGSKLA

SEQ ID NO: 8275 - protein, 7 aa, Artificial Sequence
  Description of Artificial Sequence: Synthetic peptide
VQQASSI

SEQ ID NO: 8276 - protein, 7 aa, Artificial Sequence
  Description of Artificial Sequence: Synthetic peptide
DRNGKVA

SEQ ID NO: 8277 - protein, 7 aa, Artificial Sequence
  Description of Artificial Sequence: Synthetic peptide
AGRDAAA

SEQ ID NO: 8278 - protein, 7 aa, Artificial Sequence
  Description of Artificial Sequence: Synthetic peptide
TSSQTPV

SEQ ID NO: 8279 - protein, 7 aa, Artificial Sequence
  Description of Artificial Sequence: Synthetic peptide
TTMSSHA

SEQ ID NO: 8280 - protein, 7 aa, Artificial Sequence
  Description of Artificial Sequence: Synthetic peptide
TTGQGMT

SEQ ID NO: 8281 - protein, 7 aa, Artificial Sequence
  Description of Artificial Sequence: Synthetic peptide
SEKSSAM

SEQ ID NO: 8282 - protein, 7 aa, Artificial Sequence
  Description of Artificial Sequence: Synthetic peptide
SGASQKP

SEQ ID NO: 8283 - protein, 7 aa, Artificial Sequence
  Description of Artificial Sequence: Synthetic peptide
SGNRTDG

SEQ ID NO: 8284 - protein, 7 aa, Artificial Sequence
  Description of Artificial Sequence: Synthetic peptide
DLSTKSG

SEQ ID NO: 8285 - protein, 7 aa, Artificial Sequence
  Description of Artificial Sequence: Synthetic peptide
GPDRAPT

SEQ ID NO: 8286 - protein, 7 aa, Artificial Sequence
  Description of Artificial Sequence: Synthetic peptide
NPASSSR

SEQ ID NO: 8287 - protein, 7 aa, Artificial Sequence
  Description of Artificial Sequence: Synthetic peptide
TDDHKGQ

SEQ ID NO: 8288 - protein, 7 aa, Artificial Sequence
  Description of Artificial Sequence: Synthetic peptide
DGVKSSS

SEQ ID NO: 8289 - protein, 7 aa, Artificial Sequence
  Description of Artificial Sequence: Synthetic peptide
AENKSMS

SEQ ID NO: 8290 - protein, 7 aa, Artificial Sequence
  Description of Artificial Sequence: Synthetic peptide
AGSSSIA

SEQ ID NO: 8291 - protein, 7 aa, Artificial Sequence
  Description of Artificial Sequence: Synthetic peptide
STTDRNV

SEQ ID NO: 8292 - protein, 7 aa, Artificial Sequence
  Description of Artificial Sequence: Synthetic peptide
TQSGGTT

SEQ ID NO: 8293 - protein, 7 aa, Artificial Sequence
  Description of Artificial Sequence: Synthetic peptide
SGPPPST

SEQ ID NO: 8294 - protein, 7 aa, Artificial Sequence
  Description of Artificial Sequence: Synthetic peptide
ARQSEVA

SEQ ID NO: 8295 - protein, 7 aa, Artificial Sequence
  Description of Artificial Sequence: Synthetic peptide
SSGHGNV

SEQ ID NO: 8296 - protein, 7 aa, Artificial Sequence
  Description of Artificial Sequence: Synthetic peptide
SDSSNRV

SEQ ID NO: 8297 - protein, 7 aa, Artificial Sequence
  Description of Artificial Sequence: Synthetic peptide
LGSPTNT

SEQ ID NO: 8298 - protein, 7 aa, Artificial Sequence
  Description of Artificial Sequence: Synthetic peptide
GMDSPSR

SEQ ID NO: 8299 - protein, 7 aa, Artificial Sequence
  Description of Artificial Sequence: Synthetic peptide
SGTSSST

SEQ ID NO: 8300 - protein, 7 aa, Artificial Sequence
  Description of Artificial Sequence: Synthetic peptide
SKGDAVG

SEQ ID NO: 8301 - protein, 7 aa, Artificial Sequence
  Description of Artificial Sequence: Synthetic peptide
STPAGNQ

SEQ ID NO: 8302 - protein, 7 aa, Artificial Sequence
  Description of Artificial Sequence: Synthetic peptide
QAQSTNL

SEQ ID NO: 8303 - protein, 7 aa, Artificial Sequence
  Description of Artificial Sequence: Synthetic peptide
EGSNTVV

SEQ ID NO: 8304 - protein, 7 aa, Artificial Sequence
  Description of Artificial Sequence: Synthetic peptide
SSNPSNE

SEQ ID NO: 8305 - protein, 7 aa, Artificial Sequence
  Description of Artificial Sequence: Synthetic peptide
DQGSVLK

SEQ ID NO: 8306 - protein, 7 aa, Artificial Sequence
  Description of Artificial Sequence: Synthetic peptide
GDRGKSS

SEQ ID NO: 8307 - protein, 7 aa, Artificial Sequence
  Description of Artificial Sequence: Synthetic peptide
SKASSHS

SEQ ID NO: 8308 - protein, 7 aa, Artificial Sequence
  Description of Artificial Sequence: Synthetic peptide
DGSGSTR

SEQ ID NO: 8309 - protein, 7 aa, Artificial Sequence
  Description of Artificial Sequence: Synthetic peptide
QGGGGQG

SEQ ID NO: 8310 - protein, 7 aa, Artificial Sequence
  Description of Artificial Sequence: Synthetic peptide
QGNGLLT

SEQ ID NO: 8311 - protein, 7 aa, Artificial Sequence
  Description of Artificial Sequence: Synthetic peptide
SGTSTLM

SEQ ID NO: 8312 - protein, 7 aa, Artificial Sequence
  Description of Artificial Sequence: Synthetic peptide
GTSGKGS

SEQ ID NO: 8313 - protein, 7 aa, Artificial Sequence
  Description of Artificial Sequence: Synthetic peptide
GVRGKES

SEQ ID NO: 8314 - protein, 7 aa, Artificial Sequence
  Description of Artificial Sequence: Synthetic peptide
AKSQGSL

SEQ ID NO: 8315 - protein, 7 aa, Artificial Sequence
  Description of Artificial Sequence: Synthetic peptide
HTTGTLA

SEQ ID NO: 8316 - protein, 7 aa, Artificial Sequence
  Description of Artificial Sequence: Synthetic peptide
TPAVNGH

SEQ ID NO: 8317 - protein, 7 aa, Artificial Sequence
  Description of Artificial Sequence: Synthetic peptide
SAVTTSA

SEQ ID NO: 8318 - protein, 7 aa, Artificial Sequence
  Description of Artificial Sequence: Synthetic peptide
SNASAAV

SEQ ID NO: 8319 - protein, 7 aa, Artificial Sequence
  Description of Artificial Sequence: Synthetic peptide
APHDGKT

SEQ ID NO: 8320 - protein, 7 aa, Artificial Sequence
  Description of Artificial Sequence: Synthetic peptide
SSAGTTQ

SEQ ID NO: 8321 - protein, 7 aa, Artificial Sequence
  Description of Artificial Sequence: Synthetic peptide
NQARTGE

SEQ ID NO: 8322 - protein, 7 aa, Artificial Sequence
  Description of Artificial Sequence: Synthetic peptide
TPQAVPT

SEQ ID NO: 8323 - protein, 7 aa, Artificial Sequence
  Description of Artificial Sequence: Synthetic peptide
STGTPTG

SEQ ID NO: 8324 - protein, 7 aa, Artificial Sequence
  Description of Artificial Sequence: Synthetic peptide
SSGKPAG

SEQ ID NO: 8325 - protein, 7 aa, Artificial Sequence
  Description of Artificial Sequence: Synthetic peptide
STTNAAL

SEQ ID NO: 8326 - protein, 7 aa, Artificial Sequence
  Description of Artificial Sequence: Synthetic peptide
IAAKGMN

SEQ ID NO: 8327 - protein, 7 aa, Artificial Sequence
  Description of Artificial Sequence: Synthetic peptide
MVSAAGS

SEQ ID NO: 8328 - protein, 7 aa, Artificial Sequence
  Description of Artificial Sequence: Synthetic peptide
QRDKTSG

SEQ ID NO: 8329 - protein, 7 aa, Artificial Sequence
  Description of Artificial Sequence: Synthetic peptide
HGAGSPS

SEQ ID NO: 8330 - protein, 7 aa, Artificial Sequence
  Description of Artificial Sequence: Synthetic peptide
QNSHATT

SEQ ID NO: 8331 - protein, 7 aa, Artificial Sequence
  Description of Artificial Sequence: Synthetic peptide
QTTGSRN

SEQ ID NO: 8332 - protein, 7 aa, Artificial Sequence
  Description of Artificial Sequence: Synthetic peptide
LTGQHHS

SEQ ID NO: 8333 - protein, 7 aa, Artificial Sequence
  Description of Artificial Sequence: Synthetic peptide
LSGTSTV

SEQ ID NO: 8334 - protein, 7 aa, Artificial Sequence
  Description of Artificial Sequence: Synthetic peptide
LPNSSSA

SEQ ID NO: 8335 - protein, 7 aa, Artificial Sequence
  Description of Artificial Sequence: Synthetic peptide
EKGATNL

SEQ ID NO: 8336 - protein, 7 aa, Artificial Sequence
  Description of Artificial Sequence: Synthetic peptide
DSGRSSG

SEQ ID NO: 8337 - protein, 7 aa, Artificial Sequence
  Description of Artificial Sequence: Synthetic peptide
DPTKESH

SEQ ID NO: 8338 - protein, 7 aa, Artificial Sequence
  Description of Artificial Sequence: Synthetic peptide
DGIKEHT

SEQ ID NO: 8339 - protein, 7 aa, Artificial Sequence
  Description of Artificial Sequence: Synthetic peptide
DLTSHKT

SEQ ID NO: 8340 - protein, 7 aa, Artificial Sequence
  Description of Artificial Sequence: Synthetic peptide
GSQDSHR

SEQ ID NO: 8341 - protein, 7 aa, Artificial Sequence
  Description of Artificial Sequence: Synthetic peptide
GGNKHGN

SEQ ID NO: 8342 - protein, 7 aa, Artificial Sequence
  Description of Artificial Sequence: Synthetic peptide
VTVSPSK

SEQ ID NO: 8343 - protein, 7 aa, Artificial Sequence
  Description of Artificial Sequence: Synthetic peptide
VGGTAVK

SEQ ID NO: 8344 - protein, 7 aa, Artificial Sequence
  Description of Artificial Sequence: Synthetic peptide
VASQRNE

SEQ ID NO: 8345 - protein, 7 aa, Artificial Sequence
  Description of Artificial Sequence: Synthetic peptide
CQDKNAP

SEQ ID NO: 8346 - protein, 7 aa, Artificial Sequence
  Description of Artificial Sequence: Synthetic peptide
LASKSSN

SEQ ID NO: 8347 - protein, 7 aa, Artificial Sequence
  Description of Artificial Sequence: Synthetic peptide
QVAAKSS

SEQ ID NO: 8348 - protein, 7 aa, Artificial Sequence
  Description of Artificial Sequence: Synthetic peptide
SETKGTA

SEQ ID NO: 8349 - protein, 7 aa, Artificial Sequence
  Description of Artificial Sequence: Synthetic peptide
STKSPVA

SEQ ID NO: 8350 - protein, 7 aa, Artificial Sequence
  Description of Artificial Sequence: Synthetic peptide
VSSNPPA

SEQ ID NO: 8351 - protein, 7 aa, Artificial Sequence
  Description of Artificial Sequence: Synthetic peptide
HGASAGS

SEQ ID NO: 8352 - protein, 7 aa, Artificial Sequence
  Description of Artificial Sequence: Synthetic peptide
NTVSSQN

SEQ ID NO: 8353 - protein, 7 aa, Artificial Sequence
  Description of Artificial Sequence: Synthetic peptide
AHSQSSQ

SEQ ID NO: 8354 - protein, 7 aa, Artificial Sequence
  Description of Artificial Sequence: Synthetic peptide
NPNGSST

SEQ ID NO: 8355 - protein, 7 aa, Artificial Sequence
  Description of Artificial Sequence: Synthetic peptide
SVASSNM

SEQ ID NO: 8356 - protein, 7 aa, Artificial Sequence
  Description of Artificial Sequence: Synthetic peptide
SSDRQSA

SEQ ID NO: 8357 - protein, 7 aa, Artificial Sequence
  Description of Artificial Sequence: Synthetic peptide
TADSARS

SEQ ID NO: 8358 - protein, 7 aa, Artificial Sequence
  Description of Artificial Sequence: Synthetic peptide
GPSHNQS

SEQ ID NO: 8359 - protein, 7 aa, Artificial Sequence
  Description of Artificial Sequence: Synthetic peptide
VAGPSPK

SEQ ID NO: 8360 - protein, 7 aa, Artificial Sequence
  Description of Artificial Sequence: Synthetic peptide
STSDSSR

SEQ ID NO: 8361 - protein, 7 aa, Artificial Sequence
  Description of Artificial Sequence: Synthetic peptide
QNTGSPT

SEQ ID NO: 8362 - protein, 7 aa, Artificial Sequence
  Description of Artificial Sequence: Synthetic peptide
MKAQSSG

SEQ ID NO: 8363 - protein, 7 aa, Artificial Sequence
  Description of Artificial Sequence: Synthetic peptide
ESGKTNM

SEQ ID NO: 8364 - protein, 7 aa, Artificial Sequence
  Description of Artificial Sequence: Synthetic peptide
LGSGERT

SEQ ID NO: 8365 - protein, 7 aa, Artificial Sequence
  Description of Artificial Sequence: Synthetic peptide
GLQKTSG

SEQ ID NO: 8366 - protein, 7 aa, Artificial Sequence
  Description of Artificial Sequence: Synthetic peptide
YKSDSQV

SEQ ID NO: 8367 - protein, 7 aa, Artificial Sequence
  Description of Artificial Sequence: Synthetic peptide
TATTKVD

SEQ ID NO: 8368 - protein, 7 aa, Artificial Sequence
  Description of Artificial Sequence: Synthetic peptide
LTSSTSN

SEQ ID NO: 8369 - protein, 7 aa, Artificial Sequence
  Description of Artificial Sequence: Synthetic peptide
SGASHNL

SEQ ID NO: 8370 - protein, 7 aa, Artificial Sequence
  Description of Artificial Sequence: Synthetic peptide
SAVNSSK

SEQ ID NO: 8371 - protein, 7 aa, Artificial Sequence
  Description of Artificial Sequence: Synthetic peptide
MTPPNKE

SEQ ID NO: 8372 - protein, 7 aa, Artificial Sequence
  Description of Artificial Sequence: Synthetic peptide
GDSASSK

SEQ ID NO: 8373 - protein, 7 aa, Artificial Sequence
  Description of Artificial Sequence: Synthetic peptide
GNRSEGK

SEQ ID NO: 8374 - protein, 7 aa, Artificial Sequence
  Description of Artificial Sequence: Synthetic peptide
AKQTSVV

SEQ ID NO: 8375 - protein, 7 aa, Artificial Sequence
  Description of Artificial Sequence: Synthetic peptide
GIGANSI

SEQ ID NO: 8376 - protein, 7 aa, Artificial Sequence
  Description of Artificial Sequence: Synthetic peptide
NAEKLGS

SEQ ID NO: 8377 - protein, 7 aa, Artificial Sequence
  Description of Artificial Sequence: Synthetic peptide
LAGAGSS

SEQ ID NO: 8378 - protein, 7 aa, Artificial Sequence
  Description of Artificial Sequence: Synthetic peptide
GESAKDG

SEQ ID NO: 8379 - protein, 7 aa, Artificial Sequence
  Description of Artificial Sequence: Synthetic peptide
GTAKPTH

SEQ ID NO: 8380 - protein, 7 aa, Artificial Sequence
  Description of Artificial Sequence: Synthetic peptide
MTQKSTA

SEQ ID NO: 8381 - protein, 7 aa, Artificial Sequence
  Description of Artificial Sequence: Synthetic peptide
GVANTQS

SEQ ID NO: 8382 - protein, 7 aa, Artificial Sequence
  Description of Artificial Sequence: Synthetic peptide
SSSNPST

SEQ ID NO: 8383 - protein, 7 aa, Artificial Sequence
  Description of Artificial Sequence: Synthetic peptide
TANAQNR

SEQ ID NO: 8384 - protein, 7 aa, Artificial Sequence
  Description of Artificial Sequence: Synthetic peptide
SQTSSSV

SEQ ID NO: 8385 - protein, 7 aa, Artificial Sequence
  Description of Artificial Sequence: Synthetic peptide
SPNERSH

SEQ ID NO: 8386 - protein, 7 aa, Artificial Sequence
  Description of Artificial Sequence: Synthetic peptide
QGSQATL

SEQ ID NO: 8387 - protein, 7 aa, Artificial Sequence
  Description of Artificial Sequence: Synthetic peptide
AEGARGL

SEQ ID NO: 8388 - protein, 7 aa, Artificial Sequence
  Description of Artificial Sequence: Synthetic peptide
GEEGKTK

SEQ ID NO: 8389 - protein, 7 aa, Artificial Sequence
  Description of Artificial Sequence: Synthetic peptide
GKTQHGA

SEQ ID NO: 8390 - protein, 7 aa, Artificial Sequence
  Description of Artificial Sequence: Synthetic peptide
GDSKPTT

SEQ ID NO: 8391 - protein, 7 aa, Artificial Sequence
  Description of Artificial Sequence: Synthetic peptide
LNGRESG

SEQ ID NO: 8392 - protein, 7 aa, Artificial Sequence
  Description of Artificial Sequence: Synthetic peptide
LAAPSNA

SEQ ID NO: 8393 - protein, 7 aa, Artificial Sequence
  Description of Artificial Sequence: Synthetic peptide
DSSKSAG

SEQ ID NO: 8394 - protein, 7 aa, Artificial Sequence
  Description of Artificial Sequence: Synthetic peptide
GGTSVHT

SEQ ID NO: 8395 - protein, 7 aa, Artificial Sequence
  Description of Artificial Sequence: Synthetic peptide
GVNSSKS

SEQ ID NO: 8396 - protein, 7 aa, Artificial Sequence
  Description of Artificial Sequence: Synthetic peptide
SHNGSNT

SEQ ID NO: 8397 - protein, 7 aa, Artificial Sequence
  Description of Artificial Sequence: Synthetic peptide
VGVPVST

SEQ ID NO: 8398 - protein, 7 aa, Artificial Sequence
  Description of Artificial Sequence: Synthetic peptide
ASNKVTS

SEQ ID NO: 8399 - protein, 7 aa, Artificial Sequence
  Description of Artificial Sequence: Synthetic peptide
GKSGGSS

SEQ ID NO: 8400 - protein, 7 aa, Artificial Sequence
  Description of Artificial Sequence: Synthetic peptide
TTGSGNR

SEQ ID NO: 8401 - protein, 7 aa, Artificial Sequence
  Description of Artificial Sequence: Synthetic peptide
TTGDGAK

SEQ ID NO: 8402 - protein, 7 aa, Artificial Sequence
  Description of Artificial Sequence: Synthetic peptide
LGGATNS

SEQ ID NO: 8403 - protein, 7 aa, Artificial Sequence
  Description of Artificial Sequence: Synthetic peptide
EGNSKLV

SEQ ID NO: 8404 - protein, 7 aa, Artificial Sequence
  Description of Artificial Sequence: Synthetic peptide
DGGSNQA

SEQ ID NO: 8405 - protein, 7 aa, Artificial Sequence
  Description of Artificial Sequence: Synthetic peptide
EGTESRR

SEQ ID NO: 8406 - protein, 7 aa, Artificial Sequence
  Description of Artificial Sequence: Synthetic peptide
VGSTSSS

SEQ ID NO: 8407 - protein, 7 aa, Artificial Sequence
  Description of Artificial Sequence: Synthetic peptide
TDGKHQP

SEQ ID NO: 8408 - protein, 7 aa, Artificial Sequence
  Description of Artificial Sequence: Synthetic peptide
ISTSASK

SEQ ID NO: 8409 - protein, 7 aa, Artificial Sequence
  Description of Artificial Sequence: Synthetic peptide
NANKDVA

SEQ ID NO: 8410 - protein, 7 aa, Artificial Sequence
  Description of Artificial Sequence: Synthetic peptide
QEAQKVG

SEQ ID NO: 8411 - protein, 7 aa, Artificial Sequence
  Description of Artificial Sequence: Synthetic peptide
GLDSTRI

SEQ ID NO: 8412 - protein, 7 aa, Artificial Sequence
  Description of Artificial Sequence: Synthetic peptide
SANNAAS

SEQ ID NO: 8413 - protein, 7 aa, Artificial Sequence
  Description of Artificial Sequence: Synthetic peptide
GATVKNL

SEQ ID NO: 8414 - protein, 7 aa, Artificial Sequence
  Description of Artificial Sequence: Synthetic peptide
NSPSTNS

SEQ ID NO: 8415 - protein, 7 aa, Artificial Sequence
  Description of Artificial Sequence: Synthetic peptide
MGQSQTL

SEQ ID NO: 8416 - protein, 7 aa, Artificial Sequence
  Description of Artificial Sequence: Synthetic peptide
QGSTKGI

SEQ ID NO: 8417 - protein, 7 aa, Artificial Sequence
  Description of Artificial Sequence: Synthetic peptide
STGPSAA

SEQ ID NO: 8418 - protein, 7 aa, Artificial Sequence
  Description of Artificial Sequence: Synthetic peptide
MSTNGST

SEQ ID NO: 8419 - protein, 7 aa, Artificial Sequence
  Description of Artificial Sequence: Synthetic peptide
EVTPHRG

SEQ ID NO: 8420 - protein, 7 aa, Artificial Sequence
  Description of Artificial Sequence: Synthetic peptide
DTTDKTR

SEQ ID NO: 8421 - protein, 7 aa, Artificial Sequence
  Description of Artificial Sequence: Synthetic peptide
HNSPSAK

SEQ ID NO: 8422 - protein, 7 aa, Artificial Sequence
  Description of Artificial Sequence: Synthetic peptide
DARSSAA

SEQ ID NO: 8423 - protein, 7 aa, Artificial Sequence
  Description of Artificial Sequence: Synthetic peptide
GKNGSTM

SEQ ID NO: 8424 - protein, 7 aa, Artificial Sequence
  Description of Artificial Sequence: Synthetic peptide
TGGGGQQ

SEQ ID NO: 8425 - protein, 7 aa, Artificial Sequence
  Description of Artificial Sequence: Synthetic peptide
SRSKASE

SEQ ID NO: 8426 - protein, 7 aa, Artificial Sequence
  Description of Artificial Sequence: Synthetic peptide
SGDRTEG

SEQ ID NO: 8427 - protein, 7 aa, Artificial Sequence
  Description of Artificial Sequence: Synthetic peptide
MSGTSSV

SEQ ID NO: 8428 - protein, 7 aa, Artificial Sequence
  Description of Artificial Sequence: Synthetic peptide
DARPTSG

SEQ ID NO: 8429 - protein, 7 aa, Artificial Sequence
  Description of Artificial Sequence: Synthetic peptide
ASASSNK

SEQ ID NO: 8430 - protein, 7 aa, Artificial Sequence
  Description of Artificial Sequence: Synthetic peptide
VGQKVGS

SEQ ID NO: 8431 - protein, 7 aa, Artificial Sequence
  Description of Artificial Sequence: Synthetic peptide
YSGTGNQ

SEQ ID NO: 8432 - protein, 7 aa, Artificial Sequence
  Description of Artificial Sequence: Synthetic peptide
SDTKSQS

SEQ ID NO: 8433 - protein, 7 aa, Artificial Sequence
  Description of Artificial Sequence: Synthetic peptide
GANKDTS

SEQ ID NO: 8434 - protein, 7 aa, Artificial Sequence
  Description of Artificial Sequence: Synthetic peptide
RQGQSVS

SEQ ID NO: 8435 - protein, 7 aa, Artificial Sequence
  Description of Artificial Sequence: Synthetic peptide
ENSQASR

SEQ ID NO: 8436 - protein, 7 aa, Artificial Sequence
  Description of Artificial Sequence: Synthetic peptide
EHVSKLG

SEQ ID NO: 8437 - protein, 7 aa, Artificial Sequence
  Description of Artificial Sequence: Synthetic peptide
ATGNQAQ

SEQ ID NO: 8438 - protein, 7 aa, Artificial Sequence
  Description of Artificial Sequence: Synthetic peptide
TSGTANN

SEQ ID NO: 8439 - protein, 7 aa, Artificial Sequence
  Description of Artificial Sequence: Synthetic peptide
SVVSSNQ

SEQ ID NO: 8440 - protein, 7 aa, Artificial Sequence
  Description of Artificial Sequence: Synthetic peptide
DKSTQSS

SEQ ID NO: 8441 - protein, 7 aa, Artificial Sequence
  Description of Artificial Sequence: Synthetic peptide
VQSSNIG

SEQ ID NO: 8442 - protein, 7 aa, Artificial Sequence
  Description of Artificial Sequence: Synthetic peptide
SPSNSTS

SEQ ID NO: 8443 - protein, 7 aa, Artificial Sequence
  Description of Artificial Sequence: Synthetic peptide
DSGKSQS

SEQ ID NO: 8444 - protein, 7 aa, Artificial Sequence
  Description of Artificial Sequence: Synthetic peptide
QPTASPS

SEQ ID NO: 8445 - protein, 7 aa, Artificial Sequence
  Description of Artificial Sequence: Synthetic peptide
NTNKTAS

SEQ ID NO: 8446 - protein, 7 aa, Artificial Sequence
  Description of Artificial Sequence: Synthetic peptide
SAPSGKE

SEQ ID NO: 8447 - protein, 7 aa, Artificial Sequence
  Description of Artificial Sequence: Synthetic peptide
SGLETKS

SEQ ID NO: 8448 - protein, 7 aa, Artificial Sequence
  Description of Artificial Sequence: Synthetic peptide
YTGKVSS

SEQ ID NO: 8449 - protein, 7 aa, Artificial Sequence
  Description of Artificial Sequence: Synthetic peptide
NLGSVRD

SEQ ID NO: 8450 - protein, 7 aa, Artificial Sequence
  Description of Artificial Sequence: Synthetic peptide
APDSKNG

SEQ ID NO: 8451 - protein, 7 aa, Artificial Sequence
  Description of Artificial Sequence: Synthetic peptide
NSAKGIA

SEQ ID NO: 8452 - protein, 7 aa, Artificial Sequence
  Description of Artificial Sequence: Synthetic peptide
STGAPAT

SEQ ID NO: 8453 - protein, 7 aa, Artificial Sequence
  Description of Artificial Sequence: Synthetic peptide
SQTGGRG

SEQ ID NO: 8454 - protein, 7 aa, Artificial Sequence
  Description of Artificial Sequence: Synthetic peptide
CSGDPRK

SEQ ID NO: 8455 - protein, 7 aa, Artificial Sequence
  Description of Artificial Sequence: Synthetic peptide
KSASPAH

SEQ ID NO: 8456 - protein, 7 aa, Artificial Sequence
  Description of Artificial Sequence: Synthetic peptide
EGVPSKL

SEQ ID NO: 8457 - protein, 7 aa, Artificial Sequence
  Description of Artificial Sequence: Synthetic peptide
GPSAKVN

SEQ ID NO: 8458 - protein, 7 aa, Artificial Sequence
  Description of Artificial Sequence: Synthetic peptide
TTGTTSR

SEQ ID NO: 8459 - protein, 7 aa, Artificial Sequence
  Description of Artificial Sequence: Synthetic peptide
TAEVRGS

SEQ ID NO: 8460 - protein, 7 aa, Artificial Sequence
  Description of Artificial Sequence: Synthetic peptide
STAVSSS

SEQ ID NO: 8461 - protein, 7 aa, Artificial Sequence
  Description of Artificial Sequence: Synthetic peptide
NGNQQGR

SEQ ID NO: 8462 - protein, 7 aa, Artificial Sequence
  Description of Artificial Sequence: Synthetic peptide
NSTEHSR

SEQ ID NO: 8463 - protein, 7 aa, Artificial Sequence
  Description of Artificial Sequence: Synthetic peptide
KDDRTTG

SEQ ID NO: 8464 - protein, 7 aa, Artificial Sequence
  Description of Artificial Sequence: Synthetic peptide
NQDSSKG

SEQ ID NO: 8465 - protein, 7 aa, Artificial Sequence
  Description of Artificial Sequence: Synthetic peptide
NGPSNGS

SEQ ID NO: 8466 - protein, 7 aa, Artificial Sequence
  Description of Artificial Sequence: Synthetic peptide
MEGGQRA

SEQ ID NO: 8467 - protein, 7 aa, Artificial Sequence
  Description of Artificial Sequence: Synthetic peptide
QDGRNQP

SEQ ID NO: 8468 - protein, 7 aa, Artificial Sequence
  Description of Artificial Sequence: Synthetic peptide
QVGSATA

SEQ ID NO: 8469 - protein, 7 aa, Artificial Sequence
  Description of Artificial Sequence: Synthetic peptide
EGSSRSG

SEQ ID NO: 8470 - protein, 7 aa, Artificial Sequence
  Description of Artificial Sequence: Synthetic peptide
DSSNLKS

SEQ ID NO: 8471 - protein, 7 aa, Artificial Sequence
  Description of Artificial Sequence: Synthetic peptide
ARSKDSS

SEQ ID NO: 8472 - protein, 7 aa, Artificial Sequence
  Description of Artificial Sequence: Synthetic peptide
GGTSSSI

SEQ ID NO: 8473 - protein, 7 aa, Artificial Sequence
  Description of Artificial Sequence: Synthetic peptide
VTTRESV

SEQ ID NO: 8474 - protein, 7 aa, Artificial Sequence
  Description of Artificial Sequence: Synthetic peptide
SSGTGPS

SEQ ID NO: 8475 - protein, 7 aa, Artificial Sequence
  Description of Artificial Sequence: Synthetic peptide
SSQPTLG

SEQ ID NO: 8476 - protein, 7 aa, Artificial Sequence
  Description of Artificial Sequence: Synthetic peptide
AVGTATS

SEQ ID NO: 8477 - protein, 7 aa, Artificial Sequence
  Description of Artificial Sequence: Synthetic peptide
ATTSGSL

SEQ ID NO: 8478 - protein, 7 aa, Artificial Sequence
  Description of Artificial Sequence: Synthetic peptide
TENRDSS

SEQ ID NO: 8479 - protein, 7 aa, Artificial Sequence
  Description of Artificial Sequence: Synthetic peptide
DKNNTAR

SEQ ID NO: 8480 - protein, 7 aa, Artificial Sequence
  Description of Artificial Sequence: Synthetic peptide
MASNDSK

SEQ ID NO: 8481 - protein, 7 aa, Artificial Sequence
  Description of Artificial Sequence: Synthetic peptide
HGSTASQ

SEQ ID NO: 8482 - protein, 7 aa, Artificial Sequence
  Description of Artificial Sequence: Synthetic peptide
DHSHAIK

SEQ ID NO: 8483 - protein, 7 aa, Artificial Sequence
  Description of Artificial Sequence: Synthetic peptide
NSGQHSN

SEQ ID NO: 8484 - protein, 7 aa, Artificial Sequence
  Description of Artificial Sequence: Synthetic peptide
SSNGVGA

SEQ ID NO: 8485 - protein, 7 aa, Artificial Sequence
  Description of Artificial Sequence: Synthetic peptide
EGKKADP

SEQ ID NO: 8486 - protein, 7 aa, Artificial Sequence
  Description of Artificial Sequence: Synthetic peptide
APQSSNG

SEQ ID NO: 8487 - protein, 7 aa, Artificial Sequence
  Description of Artificial Sequence: Synthetic peptide
ARSKEQQ

SEQ ID NO: 8488 - protein, 7 aa, Artificial Sequence
  Description of Artificial Sequence: Synthetic peptide
GQNGTIN

SEQ ID NO: 8489 - protein, 7 aa, Artificial Sequence
  Description of Artificial Sequence: Synthetic peptide
VTTAQPV

SEQ ID NO: 8490 - protein, 7 aa, Artificial Sequence
  Description of Artificial Sequence: Synthetic peptide
SGTKEMS

SEQ ID NO: 8491 - protein, 7 aa, Artificial Sequence
  Description of Artificial Sequence: Synthetic peptide
TSQATTQ

SEQ ID NO: 8492 - protein, 7 aa, Artificial Sequence
  Description of Artificial Sequence: Synthetic peptide
TKETTYL

SEQ ID NO: 8493 - protein, 7 aa, Artificial Sequence
  Description of Artificial Sequence: Synthetic peptide
TGVNSTR

SEQ ID NO: 8494 - protein, 7 aa, Artificial Sequence
  Description of Artificial Sequence: Synthetic peptide
SASTSTV

SEQ ID NO: 8495 - protein, 7 aa, Artificial Sequence
  Description of Artificial Sequence: Synthetic peptide
HNAAATA

SEQ ID NO: 8496 - protein, 7 aa, Artificial Sequence
  Description of Artificial Sequence: Synthetic peptide
TGQSAGT

SEQ ID NO: 8497 - protein, 7 aa, Artificial Sequence
  Description of Artificial Sequence: Synthetic peptide
GFGDKSV

SEQ ID NO: 8498 - protein, 7 aa, Artificial Sequence
  Description of Artificial Sequence: Synthetic peptide
NSSQPKT

SEQ ID NO: 8499 - protein, 7 aa, Artificial Sequence
  Description of Artificial Sequence: Synthetic peptide
TKQNAPL

SEQ ID NO: 8500 - protein, 7 aa, Artificial Sequence
  Description of Artificial Sequence: Synthetic peptide
SQEKSLG

SEQ ID NO: 8501 - protein, 7 aa, Artificial Sequence
  Description of Artificial Sequence: Synthetic peptide
SVSPRKG

SEQ ID NO: 8502 - protein, 7 aa, Artificial Sequence
  Description of Artificial Sequence: Synthetic peptide
QEHTKTS

SEQ ID NO: 8503 - protein, 7 aa, Artificial Sequence
  Description of Artificial Sequence: Synthetic peptide
DSSNPPQ

SEQ ID NO: 8504 - protein, 7 aa, Artificial Sequence
  Description of Artificial Sequence: Synthetic peptide
GSQESRH

SEQ ID NO: 8505 - protein, 7 aa, Artificial Sequence
  Description of Artificial Sequence: Synthetic peptide
GEGTSPT

SEQ ID NO: 8506 - protein, 7 aa, Artificial Sequence
  Description of Artificial Sequence: Synthetic peptide
GDSGANH

SEQ ID NO: 8507 - protein, 7 aa, Artificial Sequence
  Description of Artificial Sequence: Synthetic peptide
SGDPSRI

SEQ ID NO: 8508 - protein, 7 aa, Artificial Sequence
  Description of Artificial Sequence: Synthetic peptide
SASSSEK

SEQ ID NO: 8509 - protein, 7 aa, Artificial Sequence
  Description of Artificial Sequence: Synthetic peptide
SSKTSNN

SEQ ID NO: 8510 - protein, 7 aa, Artificial Sequence
  Description of Artificial Sequence: Synthetic peptide
EGSSSAA

SEQ ID NO: 8511 - protein, 7 aa, Artificial Sequence
  Description of Artificial Sequence: Synthetic peptide
GQIDGHK

SEQ ID NO: 8512 - protein, 7 aa, Artificial Sequence
  Description of Artificial Sequence: Synthetic peptide
GDAKAAY

SEQ ID NO: 8513 - protein, 7 aa, Artificial Sequence
  Description of Artificial Sequence: Synthetic peptide
ERNTASH

SEQ ID NO: 8514 - protein, 7 aa, Artificial Sequence
  Description of Artificial Sequence: Synthetic peptide
NGTAQIS

SEQ ID NO: 8515 - protein, 7 aa, Artificial Sequence
  Description of Artificial Sequence: Synthetic peptide
TTSSGSA

SEQ ID NO: 8516 - protein, 7 aa, Artificial Sequence
  Description of Artificial Sequence: Synthetic peptide
SQGGPSA

SEQ ID NO: 8517 - protein, 7 aa, Artificial Sequence
  Description of Artificial Sequence: Synthetic peptide
ATPSNTG

SEQ ID NO: 8518 - protein, 7 aa, Artificial Sequence
  Description of Artificial Sequence: Synthetic peptide
MNSGSSS

SEQ ID NO: 8519 - protein, 7 aa, Artificial Sequence
  Description of Artificial Sequence: Synthetic peptide
NSNPSIS

SEQ ID NO: 8520 - protein, 7 aa, Artificial Sequence
  Description of Artificial Sequence: Synthetic peptide
SAVSTPS

SEQ ID NO: 8521 - protein, 7 aa, Artificial Sequence
  Description of Artificial Sequence: Synthetic peptide
IGGQGGS

SEQ ID NO: 8522 - protein, 7 aa, Artificial Sequence
  Description of Artificial Sequence: Synthetic peptide
NREGSMV

SEQ ID NO: 8523 - protein, 7 aa, Artificial Sequence
  Description of Artificial Sequence: Synthetic peptide
TRSERSQ

SEQ ID NO: 8524 - protein, 7 aa, Artificial Sequence
  Description of Artificial Sequence: Synthetic peptide
AKPGSSA

SEQ ID NO: 8525 - protein, 7 aa, Artificial Sequence
  Description of Artificial Sequence: Synthetic peptide
SDKTGNV

SEQ ID NO: 8526 - protein, 7 aa, Artificial Sequence
  Description of Artificial Sequence: Synthetic peptide
STHGTKA

SEQ ID NO: 8527 - protein, 7 aa, Artificial Sequence
  Description of Artificial Sequence: Synthetic peptide
SAETSKG

SEQ ID NO: 8528 - protein, 7 aa, Artificial Sequence
  Description of Artificial Sequence: Synthetic peptide
STGTSSR

SEQ ID NO: 8529 - protein, 7 aa, Artificial Sequence
  Description of Artificial Sequence: Synthetic peptide
TGGTPSP

SEQ ID NO: 8530 - protein, 7 aa, Artificial Sequence
  Description of Artificial Sequence: Synthetic peptide
SKTTGPA

SEQ ID NO: 8531 - protein, 7 aa, Artificial Sequence
  Description of Artificial Sequence: Synthetic peptide
SSITGGG

SEQ ID NO: 8532 - protein, 7 aa, Artificial Sequence
  Description of Artificial Sequence: Synthetic peptide
IKSESTG

SEQ ID NO: 8533 - protein, 7 aa, Artificial Sequence
  Description of Artificial Sequence: Synthetic peptide
TSSPSLS

SEQ ID NO: 8534 - protein, 7 aa, Artificial Sequence
  Description of Artificial Sequence: Synthetic peptide
GARDKAN

SEQ ID NO: 8535 - protein, 7 aa, Artificial Sequence
  Description of Artificial Sequence: Synthetic peptide
TPESRSS

SEQ ID NO: 8536 - protein, 7 aa, Artificial Sequence
  Description of Artificial Sequence: Synthetic peptide
MGDKTFA

SEQ ID NO: 8537 - protein, 7 aa, Artificial Sequence
  Description of Artificial Sequence: Synthetic peptide
AQGSHSS

SEQ ID NO: 8538 - protein, 7 aa, Artificial Sequence
  Description of Artificial Sequence: Synthetic peptide
LNDRSPS

SEQ ID NO: 8539 - protein, 7 aa, Artificial Sequence
  Description of Artificial Sequence: Synthetic peptide
LNAGPGS

SEQ ID NO: 8540 - protein, 7 aa, Artificial Sequence
  Description of Artificial Sequence: Synthetic peptide
NRTGTNS

SEQ ID NO: 8541 - protein, 7 aa, Artificial Sequence
  Description of Artificial Sequence: Synthetic peptide
TNSPASS

SEQ ID NO: 8542 - protein, 7 aa, Artificial Sequence
  Description of Artificial Sequence: Synthetic peptide
SNSAKMS

SEQ ID NO: 8543 - protein, 7 aa, Artificial Sequence
  Description of Artificial Sequence: Synthetic peptide
QASGGTS

SEQ ID NO: 8544 - protein, 7 aa, Artificial Sequence
  Description of Artificial Sequence: Synthetic peptide
EQDSTNR

SEQ ID NO: 8545 - protein, 7 aa, Artificial Sequence
  Description of Artificial Sequence: Synthetic peptide
TQAKASA

SEQ ID NO: 8546 - protein, 7 aa, Artificial Sequence
  Description of Artificial Sequence: Synthetic peptide
LASGSPA

SEQ ID NO: 8547 - protein, 7 aa, Artificial Sequence
  Description of Artificial Sequence: Synthetic peptide
DSTGKGS

SEQ ID NO: 8548 - protein, 7 aa, Artificial Sequence
  Description of Artificial Sequence: Synthetic peptide
SSSTSSR

SEQ ID NO: 8549 - protein, 7 aa, Artificial Sequence
  Description of Artificial Sequence: Synthetic peptide
KNSGTTG

SEQ ID NO: 8550 - protein, 7 aa, Artificial Sequence
  Description of Artificial Sequence: Synthetic peptide
LANGATQ

SEQ ID NO: 8551 - protein, 7 aa, Artificial Sequence
  Description of Artificial Sequence: Synthetic peptide
TSGGSST

SEQ ID NO: 8552 - protein, 7 aa, Artificial Sequence
  Description of Artificial Sequence: Synthetic peptide
AQATASA

SEQ ID NO: 8553 - protein, 7 aa, Artificial Sequence
  Description of Artificial Sequence: Synthetic peptide
QGQSSPG

SEQ ID NO: 8554 - protein, 7 aa, Artificial Sequence
  Description of Artificial Sequence: Synthetic peptide
TRTDATV

SEQ ID NO: 8555 - protein, 7 aa, Artificial Sequence
  Description of Artificial Sequence: Synthetic peptide
TESQRNE

SEQ ID NO: 8556 - protein, 7 aa, Artificial Sequence
  Description of Artificial Sequence: Synthetic peptide
RTNAGQG

SEQ ID NO: 8557 - protein, 7 aa, Artificial Sequence
  Description of Artificial Sequence: Synthetic peptide
SPNGQKN

SEQ ID NO: 8558 - protein, 7 aa, Artificial Sequence
  Description of Artificial Sequence: Synthetic peptide
HIGGNAG

SEQ ID NO: 8559 - protein, 7 aa, Artificial Sequence
  Description of Artificial Sequence: Synthetic peptide
DSRPTMV

SEQ ID NO: 8560 - protein, 7 aa, Artificial Sequence
  Description of Artificial Sequence: Synthetic peptide
DGRPTTG

SEQ ID NO: 8561 - protein, 7 aa, Artificial Sequence
  Description of Artificial Sequence: Synthetic peptide
DNKSGNM

SEQ ID NO: 8562 - protein, 7 aa, Artificial Sequence
  Description of Artificial Sequence: Synthetic peptide
AGTSKKD

SEQ ID NO: 8563 - protein, 7 aa, Artificial Sequence
  Description of Artificial Sequence: Synthetic peptide
VQDSSRG

SEQ ID NO: 8564 - protein, 7 aa, Artificial Sequence
  Description of Artificial Sequence: Synthetic peptide
VAGSSPA

SEQ ID NO: 8565 - protein, 7 aa, Artificial Sequence
  Description of Artificial Sequence: Synthetic peptide
QGHGNGG

SEQ ID NO: 8566 - protein, 7 aa, Artificial Sequence
  Description of Artificial Sequence: Synthetic peptide
VKQDAQS

SEQ ID NO: 8567 - protein, 7 aa, Artificial Sequence
  Description of Artificial Sequence: Synthetic peptide
GQSSKPT

SEQ ID NO: 8568 - protein, 7 aa, Artificial Sequence
  Description of Artificial Sequence: Synthetic peptide
DSSKDRT

SEQ ID NO: 8569 - protein, 7 aa, Artificial Sequence
  Description of Artificial Sequence: Synthetic peptide
GTAVPAH

SEQ ID NO: 8570 - protein, 7 aa, Artificial Sequence
  Description of Artificial Sequence: Synthetic peptide
NDTPRMS

SEQ ID NO: 8571 - protein, 7 aa, Artificial Sequence
  Description of Artificial Sequence: Synthetic peptide
EHQSGSA

SEQ ID NO: 8572 - protein, 7 aa, Artificial Sequence
  Description of Artificial Sequence: Synthetic peptide
ASSGSPT

SEQ ID NO: 8573 - protein, 7 aa, Artificial Sequence
  Description of Artificial Sequence: Synthetic peptide
GGAQPSN

SEQ ID NO: 8574 - protein, 7 aa, Artificial Sequence
  Description of Artificial Sequence: Synthetic peptide
TTAGERA

SEQ ID NO: 8575 - protein, 7 aa, Artificial Sequence
  Description of Artificial Sequence: Synthetic peptide
QGKENPL

SEQ ID NO: 8576 - protein, 7 aa, Artificial Sequence
  Description of Artificial Sequence: Synthetic peptide
GSGQSVS

SEQ ID NO: 8577 - protein, 7 aa, Artificial Sequence
  Description of Artificial Sequence: Synthetic peptide
VDGNTPR

SEQ ID NO: 8578 - protein, 7 aa, Artificial Sequence
  Description of Artificial Sequence: Synthetic peptide
NQRDSPA

SEQ ID NO: 8579 - protein, 7 aa, Artificial Sequence
  Description of Artificial Sequence: Synthetic peptide
GITNGDK

SEQ ID NO: 8580 - protein, 7 aa, Artificial Sequence
  Description of Artificial Sequence: Synthetic peptide
LPIKDGN

SEQ ID NO: 8581 - protein, 7 aa, Artificial Sequence
  Description of Artificial Sequence: Synthetic peptide
NSDSRNH

SEQ ID NO: 8582 - protein, 7 aa, Artificial Sequence
  Description of Artificial Sequence: Synthetic peptide
NQGSSLT

SEQ ID NO: 8583 - protein, 7 aa, Artificial Sequence
  Description of Artificial Sequence: Synthetic peptide
INQSPSL

SEQ ID NO: 8584 - protein, 7 aa, Artificial Sequence
  Description of Artificial Sequence: Synthetic peptide
GSVVKPV

SEQ ID NO: 8585 - protein, 7 aa, Artificial Sequence
  Description of Artificial Sequence: Synthetic peptide
GSNVRVS

SEQ ID NO: 8586 - protein, 7 aa, Artificial Sequence
  Description of Artificial Sequence: Synthetic peptide
SLHAPTA

SEQ ID NO: 8587 - protein, 7 aa, Artificial Sequence
  Description of Artificial Sequence: Synthetic peptide
LGSSPVT

SEQ ID NO: 8588 - protein, 7 aa, Artificial Sequence
  Description of Artificial Sequence: Synthetic peptide
GGSSRPS

SEQ ID NO: 8589 - protein, 7 aa, Artificial Sequence
  Description of Artificial Sequence: Synthetic peptide
GVKGNVG

SEQ ID NO: 8590 - protein, 7 aa, Artificial Sequence
  Description of Artificial Sequence: Synthetic peptide
SLSNSKA

SEQ ID NO: 8591 - protein, 7 aa, Artificial Sequence
  Description of Artificial Sequence: Synthetic peptide
KLNASGG

SEQ ID NO: 8592 - protein, 7 aa, Artificial Sequence
  Description of Artificial Sequence: Synthetic peptide
GTVTSHA

SEQ ID NO: 8593 - protein, 7 aa, Artificial Sequence
  Description of Artificial Sequence: Synthetic peptide
DQSIHGK

SEQ ID NO: 8594 - protein, 7 aa, Artificial Sequence
  Description of Artificial Sequence: Synthetic peptide
SGQSKGV

SEQ ID NO: 8595 - protein, 7 aa, Artificial Sequence
  Description of Artificial Sequence: Synthetic peptide
KDGKQTM

SEQ ID NO: 8596 - protein, 7 aa, Artificial Sequence
  Description of Artificial Sequence: Synthetic peptide
SIAKERL

SEQ ID NO: 8597 - protein, 7 aa, Artificial Sequence
  Description of Artificial Sequence: Synthetic peptide
STTKGPN

SEQ ID NO: 8598 - protein, 7 aa, Artificial Sequence
  Description of Artificial Sequence: Synthetic peptide
ERPGGAK

SEQ ID NO: 8599 - protein, 7 aa, Artificial Sequence
  Description of Artificial Sequence: Synthetic peptide
GVAAAPS

SEQ ID NO: 8600 - protein, 7 aa, Artificial Sequence
  Description of Artificial Sequence: Synthetic peptide
VEGSVTK

SEQ ID NO: 8601 - protein, 7 aa, Artificial Sequence
  Description of Artificial Sequence: Synthetic peptide
VGNDTNR

SEQ ID NO: 8602 - protein, 7 aa, Artificial Sequence
  Description of Artificial Sequence: Synthetic peptide
NSSKPST

SEQ ID NO: 8603 - protein, 7 aa, Artificial Sequence
  Description of Artificial Sequence: Synthetic peptide
VTSTPIQ

SEQ ID NO: 8604 - protein, 7 aa, Artificial Sequence
  Description of Artificial Sequence: Synthetic peptide
MSGGNQP

SEQ ID NO: 8605 - protein, 7 aa, Artificial Sequence
  Description of Artificial Sequence: Synthetic peptide
KSGQSAV

SEQ ID NO: 8606 - protein, 7 aa, Artificial Sequence
  Description of Artificial Sequence: Synthetic peptide
SGKEAVK

SEQ ID NO: 8607 - protein, 7 aa, Artificial Sequence
  Description of Artificial Sequence: Synthetic peptide
RSGETHT

SEQ ID NO: 8608 - protein, 7 aa, Artificial Sequence
  Description of Artificial Sequence: Synthetic peptide
DSASKMT

SEQ ID NO: 8609 - protein, 7 aa, Artificial Sequence
  Description of Artificial Sequence: Synthetic peptide
GSAQEPR

SEQ ID NO: 8610 - protein, 7 aa, Artificial Sequence
  Description of Artificial Sequence: Synthetic peptide
SQAKESI

SEQ ID NO: 8611 - protein, 7 aa, Artificial Sequence
  Description of Artificial Sequence: Synthetic peptide
SISSDLK

SEQ ID NO: 8612 - protein, 7 aa, Artificial Sequence
  Description of Artificial Sequence: Synthetic peptide
LPSKANL

SEQ ID NO: 8613 - protein, 7 aa, Artificial Sequence
  Description of Artificial Sequence: Synthetic peptide
HGGQPSS

SEQ ID NO: 8614 - protein, 7 aa, Artificial Sequence
  Description of Artificial Sequence: Synthetic peptide
GGSESRK

SEQ ID NO: 8615 - protein, 7 aa, Artificial Sequence
  Description of Artificial Sequence: Synthetic peptide
MNQTRES

SEQ ID NO: 8616 - protein, 7 aa, Artificial Sequence
  Description of Artificial Sequence: Synthetic peptide
QKTNEAR

SEQ ID NO: 8617 - protein, 7 aa, Artificial Sequence
  Description of Artificial Sequence: Synthetic peptide
HGDNSRQ

SEQ ID NO: 8618 - protein, 7 aa, Artificial Sequence
  Description of Artificial Sequence: Synthetic peptide
VRTNAPE

SEQ ID NO: 8619 - protein, 7 aa, Artificial Sequence
  Description of Artificial Sequence: Synthetic peptide
SADTRSV

SEQ ID NO: 8620 - protein, 7 aa, Artificial Sequence
  Description of Artificial Sequence: Synthetic peptide
SGNHKSQ

SEQ ID NO: 8621 - protein, 7 aa, Artificial Sequence
  Description of Artificial Sequence: Synthetic peptide
QNGGKVS

SEQ ID NO: 8622 - protein, 7 aa, Artificial Sequence
  Description of Artificial Sequence: Synthetic peptide
AGVANPS

SEQ ID NO: 8623 - protein, 7 aa, Artificial Sequence
  Description of Artificial Sequence: Synthetic peptide
NVNVGNT

SEQ ID NO: 8624 - protein, 7 aa, Artificial Sequence
  Description of Artificial Sequence: Synthetic peptide
MRDNHSI

SEQ ID NO: 8625 - protein, 7 aa, Artificial Sequence
  Description of Artificial Sequence: Synthetic peptide
VQGGASR

SEQ ID NO: 8626 - protein, 7 aa, Artificial Sequence
  Description of Artificial Sequence: Synthetic peptide
STVGKPH

SEQ ID NO: 8627 - protein, 7 aa, Artificial Sequence
  Description of Artificial Sequence: Synthetic peptide
ATADTPK

SEQ ID NO: 8628 - protein, 7 aa, Artificial Sequence
  Description of Artificial Sequence: Synthetic peptide
TINAATK

SEQ ID NO: 8629 - protein, 7 aa, Artificial Sequence
  Description of Artificial Sequence: Synthetic peptide
VSGSSPK

SEQ ID NO: 8630 - protein, 7 aa, Artificial Sequence
  Description of Artificial Sequence: Synthetic peptide
SASSKQE

SEQ ID NO: 8631 - protein, 7 aa, Artificial Sequence
  Description of Artificial Sequence: Synthetic peptide
KNGNSVS

SEQ ID NO: 8632 - protein, 7 aa, Artificial Sequence
  Description of Artificial Sequence: Synthetic peptide
SAHNKSV

SEQ ID NO: 8633 - protein, 7 aa, Artificial Sequence
  Description of Artificial Sequence: Synthetic peptide
MSNEKSH

SEQ ID NO: 8634 - protein, 7 aa, Artificial Sequence
  Description of Artificial Sequence: Synthetic peptide
VQAQASL

SEQ ID NO: 8635 - protein, 7 aa, Artificial Sequence
  Description of Artificial Sequence: Synthetic peptide
SVTREHA

SEQ ID NO: 8636 - protein, 7 aa, Artificial Sequence
  Description of Artificial Sequence: Synthetic peptide
ISTKKSE

SEQ ID NO: 8637 - protein, 7 aa, Artificial Sequence
  Description of Artificial Sequence: Synthetic peptide
TNVSTTK

SEQ ID NO: 8638 - protein, 7 aa, Artificial Sequence
  Description of Artificial Sequence: Synthetic peptide
MASGAKP

SEQ ID NO: 8639 - protein, 7 aa, Artificial Sequence
  Description of Artificial Sequence: Synthetic peptide
SSGSKDP

SEQ ID NO: 8640 - protein, 7 aa, Artificial Sequence
  Description of Artificial Sequence: Synthetic peptide
GVGKDQQ

SEQ ID NO: 8641 - protein, 7 aa, Artificial Sequence
  Description of Artificial Sequence: Synthetic peptide
RGQGSPS

SEQ ID NO: 8642 - protein, 7 aa, Artificial Sequence
  Description of Artificial Sequence: Synthetic peptide
EQEKPAS

SEQ ID NO: 8643 - protein, 7 aa, Artificial Sequence
  Description of Artificial Sequence: Synthetic peptide
GSNPSKS

SEQ ID NO: 8644 - protein, 7 aa, Artificial Sequence
  Description of Artificial Sequence: Synthetic peptide
VTSQNAA

SEQ ID NO: 8645 - protein, 7 aa, Artificial Sequence
  Description of Artificial Sequence: Synthetic peptide
HGAGNAV

SEQ ID NO: 8646 - protein, 7 aa, Artificial Sequence
  Description of Artificial Sequence: Synthetic peptide
SSELSGK

SEQ ID NO: 8647 - protein, 7 aa, Artificial Sequence
  Description of Artificial Sequence: Synthetic peptide
EVAKGNM

SEQ ID NO: 8648 - protein, 7 aa, Artificial Sequence
  Description of Artificial Sequence: Synthetic peptide
GSLSEKG

SEQ ID NO: 8649 - protein, 7 aa, Artificial Sequence
  Description of Artificial Sequence: Synthetic peptide
YGSEPGS

SEQ ID NO: 8650 - protein, 7 aa, Artificial Sequence
  Description of Artificial Sequence: Synthetic peptide
SRSEVKT

SEQ ID NO: 8651 - protein, 7 aa, Artificial Sequence
  Description of Artificial Sequence: Synthetic peptide
AKEPKPV

SEQ ID NO: 8652 - protein, 7 aa, Artificial Sequence
  Description of Artificial Sequence: Synthetic peptide
SAVDKAT

SEQ ID NO: 8653 - protein, 7 aa, Artificial Sequence
  Description of Artificial Sequence: Synthetic peptide
SSTAKGN

SEQ ID NO: 8654 - protein, 7 aa, Artificial Sequence
  Description of Artificial Sequence: Synthetic peptide
NAEARSE

SEQ ID NO: 8655 - protein, 7 aa, Artificial Sequence
  Description of Artificial Sequence: Synthetic peptide
DPRSPPI

SEQ ID NO: 8656 - protein, 7 aa, Artificial Sequence
  Description of Artificial Sequence: Synthetic peptide
ATGGTRL

SEQ ID NO: 8657 - protein, 7 aa, Artificial Sequence
  Description of Artificial Sequence: Synthetic peptide
SQMSSPK

SEQ ID NO: 8658 - protein, 7 aa, Artificial Sequence
  Description of Artificial Sequence: Synthetic peptide
QMSNSNT

SEQ ID NO: 8659 - protein, 7 aa, Artificial Sequence
  Description of Artificial Sequence: Synthetic peptide
GVNKPSM

SEQ ID NO: 8660 - protein, 7 aa, Artificial Sequence
  Description of Artificial Sequence: Synthetic peptide
TTTNKLS

SEQ ID NO: 8661 - protein, 7 aa, Artificial Sequence
  Description of Artificial Sequence: Synthetic peptide
HKVGDQG

SEQ ID NO: 8662 - protein, 7 aa, Artificial Sequence
  Description of Artificial Sequence: Synthetic peptide
QSSAQSI

SEQ ID NO: 8663 - protein, 7 aa, Artificial Sequence
  Description of Artificial Sequence: Synthetic peptide
VGSNSVS

SEQ ID NO: 8664 - protein, 7 aa, Artificial Sequence
  Description of Artificial Sequence: Synthetic peptide
KDTGKVG

SEQ ID NO: 8665 - protein, 7 aa, Artificial Sequence
  Description of Artificial Sequence: Synthetic peptide
KPVNNKE

SEQ ID NO: 8666 - protein, 7 aa, Artificial Sequence
  Description of Artificial Sequence: Synthetic peptide
NHNSANS

SEQ ID NO: 8667 - protein, 7 aa, Artificial Sequence
  Description of Artificial Sequence: Synthetic peptide
NGRSNSA

SEQ ID NO: 8668 - protein, 7 aa, Artificial Sequence
  Description of Artificial Sequence: Synthetic peptide
NSGGSTQ

SEQ ID NO: 8669 - protein, 7 aa, Artificial Sequence
  Description of Artificial Sequence: Synthetic peptide
TNNTASG

SEQ ID NO: 8670 - protein, 7 aa, Artificial Sequence
  Description of Artificial Sequence: Synthetic peptide
SRSASNA

SEQ ID NO: 8671 - protein, 7 aa, Artificial Sequence
  Description of Artificial Sequence: Synthetic peptide
SDQVKSN

SEQ ID NO: 8672 - protein, 7 aa, Artificial Sequence
  Description of Artificial Sequence: Synthetic peptide
SASERSL

SEQ ID NO: 8673 - protein, 7 aa, Artificial Sequence
  Description of Artificial Sequence: Synthetic peptide
QSSGSTM

SEQ ID NO: 8674 - protein, 7 aa, Artificial Sequence
  Description of Artificial Sequence: Synthetic peptide
HLGSSNE

SEQ ID NO: 8675 - protein, 7 aa, Artificial Sequence
  Description of Artificial Sequence: Synthetic peptide
LGNSTTS

SEQ ID NO: 8676 - protein, 7 aa, Artificial Sequence
  Description of Artificial Sequence: Synthetic peptide
SPTGKGV

SEQ ID NO: 8677 - protein, 7 aa, Artificial Sequence
  Description of Artificial Sequence: Synthetic peptide
SGSNVPS

SEQ ID NO: 8678 - protein, 7 aa, Artificial Sequence
  Description of Artificial Sequence: Synthetic peptide
SNTPTTV

SEQ ID NO: 8679 - protein, 7 aa, Artificial Sequence
  Description of Artificial Sequence: Synthetic peptide
SRSDPKV

SEQ ID NO: 8680 - protein, 7 aa, Artificial Sequence
  Description of Artificial Sequence: Synthetic peptide
SLAASAN

SEQ ID NO: 8681 - protein, 7 aa, Artificial Sequence
  Description of Artificial Sequence: Synthetic peptide
SGVSSAT

SEQ ID NO: 8682 - protein, 7 aa, Artificial Sequence
  Description of Artificial Sequence: Synthetic peptide
SDSPHNK

SEQ ID NO: 8683 - protein, 7 aa, Artificial Sequence
  Description of Artificial Sequence: Synthetic peptide
GKAGNTT

SEQ ID NO: 8684 - protein, 7 aa, Artificial Sequence
  Description of Artificial Sequence: Synthetic peptide
NQGNQVS

SEQ ID NO: 8685 - protein, 7 aa, Artificial Sequence
  Description of Artificial Sequence: Synthetic peptide
AGSSSPR

SEQ ID NO: 8686 - protein, 7 aa, Artificial Sequence
  Description of Artificial Sequence: Synthetic peptide
KVPPTQG

SEQ ID NO: 8687 - protein, 7 aa, Artificial Sequence
  Description of Artificial Sequence: Synthetic peptide
EGQGTFA

SEQ ID NO: 8688 - protein, 7 aa, Artificial Sequence
  Description of Artificial Sequence: Synthetic peptide
ATNSPSL

SEQ ID NO: 8689 - protein, 7 aa, Artificial Sequence
  Description of Artificial Sequence: Synthetic peptide
SSRQSDG

SEQ ID NO: 8690 - protein, 7 aa, Artificial Sequence
  Description of Artificial Sequence: Synthetic peptide
ALSATPP

SEQ ID NO: 8691 - protein, 7 aa, Artificial Sequence
  Description of Artificial Sequence: Synthetic peptide
VDGGSTG

SEQ ID NO: 8692 - protein, 7 aa, Artificial Sequence
  Description of Artificial Sequence: Synthetic peptide
GSGSSNK

SEQ ID NO: 8693 - protein, 7 aa, Artificial Sequence
  Description of Artificial Sequence: Synthetic peptide
GSATTAS

SEQ ID NO: 8694 - protein, 7 aa, Artificial Sequence
  Description of Artificial Sequence: Synthetic peptide
QSKGAQG

SEQ ID NO: 8695 - protein, 7 aa, Artificial Sequence
  Description of Artificial Sequence: Synthetic peptide
GLDKHSV

SEQ ID NO: 8696 - protein, 7 aa, Artificial Sequence
  Description of Artificial Sequence: Synthetic peptide
GDVSHKN

SEQ ID NO: 8697 - protein, 7 aa, Artificial Sequence
  Description of Artificial Sequence: Synthetic peptide
GVSATPL

SEQ ID NO: 8698 - protein, 7 aa, Artificial Sequence
  Description of Artificial Sequence: Synthetic peptide
TRESQGS

SEQ ID NO: 8699 - protein, 7 aa, Artificial Sequence
  Description of Artificial Sequence: Synthetic peptide
QHNGDRS

SEQ ID NO: 8700 - protein, 7 aa, Artificial Sequence
  Description of Artificial Sequence: Synthetic peptide
NSVKATS

SEQ ID NO: 8701 - protein, 7 aa, Artificial Sequence
  Description of Artificial Sequence: Synthetic peptide
QKNSNSA

SEQ ID NO: 8702 - protein, 7 aa, Artificial Sequence
  Description of Artificial Sequence: Synthetic peptide
RQTDKIS

SEQ ID NO: 8703 - protein, 7 aa, Artificial Sequence
  Description of Artificial Sequence: Synthetic peptide
GGPGSTH

SEQ ID NO: 8704 - protein, 7 aa, Artificial Sequence
  Description of Artificial Sequence: Synthetic peptide
SSGHTSG

SEQ ID NO: 8705 - protein, 7 aa, Artificial Sequence
  Description of Artificial Sequence: Synthetic peptide
SGTSSVS

SEQ ID NO: 8706 - protein, 7 aa, Artificial Sequence
  Description of Artificial Sequence: Synthetic peptide
QASSSNT

SEQ ID NO: 8707 - protein, 7 aa, Artificial Sequence
  Description of Artificial Sequence: Synthetic peptide
GRESGAS

SEQ ID NO: 8708 - protein, 7 aa, Artificial Sequence
  Description of Artificial Sequence: Synthetic peptide
QKSDGFH

SEQ ID NO: 8709 - protein, 7 aa, Artificial Sequence
  Description of Artificial Sequence: Synthetic peptide
ASGSAAS

SEQ ID NO: 8710 - protein, 7 aa, Artificial Sequence
  Description of Artificial Sequence: Synthetic peptide
AAAIPNN

SEQ ID NO: 8711 - protein, 7 aa, Artificial Sequence
  Description of Artificial Sequence: Synthetic peptide
GKGTDAH

SEQ ID NO: 8712 - protein, 7 aa, Artificial Sequence
  Description of Artificial Sequence: Synthetic peptide
NSVQGQG

SEQ ID NO: 8713 - protein, 7 aa, Artificial Sequence
  Description of Artificial Sequence: Synthetic peptide
SSHSPHT

SEQ ID NO: 8714 - protein, 7 aa, Artificial Sequence
  Description of Artificial Sequence: Synthetic peptide
LNRTPNV

SEQ ID NO: 8715 - protein, 7 aa, Artificial Sequence
  Description of Artificial Sequence: Synthetic peptide
AGGTSSV

SEQ ID NO: 8716 - protein, 7 aa, Artificial Sequence
  Description of Artificial Sequence: Synthetic peptide
GTGTNSP

SEQ ID NO: 8717 - protein, 7 aa, Artificial Sequence
  Description of Artificial Sequence: Synthetic peptide
SQDKSAS

SEQ ID NO: 8718 - protein, 7 aa, Artificial Sequence
  Description of Artificial Sequence: Synthetic peptide
NGMTQKV

SEQ ID NO: 8719 - protein, 7 aa, Artificial Sequence
  Description of Artificial Sequence: Synthetic peptide
LADNKST

SEQ ID NO: 8720 - protein, 7 aa, Artificial Sequence
  Description of Artificial Sequence: Synthetic peptide
SATTSGA

SEQ ID NO: 8721 - protein, 7 aa, Artificial Sequence
  Description of Artificial Sequence: Synthetic peptide
NATSTPV

SEQ ID NO: 8722 - protein, 7 aa, Artificial Sequence
  Description of Artificial Sequence: Synthetic peptide
DTASRSH

SEQ ID NO: 8723 - protein, 7 aa, Artificial Sequence
  Description of Artificial Sequence: Synthetic peptide
GTSVPRV

SEQ ID NO: 8724 - protein, 7 aa, Artificial Sequence
  Description of Artificial Sequence: Synthetic peptide
QPKPRTE

SEQ ID NO: 8725 - protein, 7 aa, Artificial Sequence
  Description of Artificial Sequence: Synthetic peptide
IQPGSPK

SEQ ID NO: 8726 - protein, 7 aa, Artificial Sequence
  Description of Artificial Sequence: Synthetic peptide
KQEAPGT

SEQ ID NO: 8727 - protein, 7 aa, Artificial Sequence
  Description of Artificial Sequence: Synthetic peptide
SNSPGPH

SEQ ID NO: 8728 - protein, 7 aa, Artificial Sequence
  Description of Artificial Sequence: Synthetic peptide
SDGSSRV

SEQ ID NO: 8729 - protein, 7 aa, Artificial Sequence
  Description of Artificial Sequence: Synthetic peptide
SAGVAGK

SEQ ID NO: 8730 - protein, 7 aa, Artificial Sequence
  Description of Artificial Sequence: Synthetic peptide
SGGGSSS

SEQ ID NO: 8731 - protein, 7 aa, Artificial Sequence
  Description of Artificial Sequence: Synthetic peptide
HNSTATH

SEQ ID NO: 8732 - protein, 7 aa, Artificial Sequence
  Description of Artificial Sequence: Synthetic peptide
EGSQGAV

SEQ ID NO: 8733 - protein, 7 aa, Artificial Sequence
  Description of Artificial Sequence: Synthetic peptide
ARTTNKE

SEQ ID NO: 8734 - protein, 7 aa, Artificial Sequence
  Description of Artificial Sequence: Synthetic peptide
GGNRGDV

SEQ ID NO: 8735 - protein, 7 aa, Artificial Sequence
  Description of Artificial Sequence: Synthetic peptide
SSGKVPG

SEQ ID NO: 8736 - protein, 7 aa, Artificial Sequence
  Description of Artificial Sequence: Synthetic peptide
MTAKGSV

SEQ ID NO: 8737 - protein, 7 aa, Artificial Sequence
  Description of Artificial Sequence: Synthetic peptide
SGSSSTS

SEQ ID NO: 8738 - protein, 7 aa, Artificial Sequence
  Description of Artificial Sequence: Synthetic peptide
TNTQQYQ

SEQ ID NO: 8739 - protein, 7 aa, Artificial Sequence
  Description of Artificial Sequence: Synthetic peptide
AKQNTTL

SEQ ID NO: 8740 - protein, 7 aa, Artificial Sequence
  Description of Artificial Sequence: Synthetic peptide
GTGSKTV

SEQ ID NO: 8741 - protein, 7 aa, Artificial Sequence
  Description of Artificial Sequence: Synthetic peptide
TGGDPLK

SEQ ID NO: 8742 - protein, 7 aa, Artificial Sequence
  Description of Artificial Sequence: Synthetic peptide
TRVTSPS

SEQ ID NO: 8743 - protein, 7 aa, Artificial Sequence
  Description of Artificial Sequence: Synthetic peptide
QHGNKES

SEQ ID NO: 8744 - protein, 7 aa, Artificial Sequence
  Description of Artificial Sequence: Synthetic peptide
DRSPNPA

SEQ ID NO: 8745 - protein, 7 aa, Artificial Sequence
  Description of Artificial Sequence: Synthetic peptide
NSAKSTF

SEQ ID NO: 8746 - protein, 7 aa, Artificial Sequence
  Description of Artificial Sequence: Synthetic peptide
GQGQPSS

SEQ ID NO: 8747 - protein, 7 aa, Artificial Sequence
  Description of Artificial Sequence: Synthetic peptide
LISDKSA

SEQ ID NO: 8748 - protein, 7 aa, Artificial Sequence
  Description of Artificial Sequence: Synthetic peptide
SVSQSHV

SEQ ID NO: 8749 - protein, 7 aa, Artificial Sequence
  Description of Artificial Sequence: Synthetic peptide
NPAQANQ

SEQ ID NO: 8750 - protein, 7 aa, Artificial Sequence
  Description of Artificial Sequence: Synthetic peptide
HNSTPPV

SEQ ID NO: 8751 - protein, 7 aa, Artificial Sequence
  Description of Artificial Sequence: Synthetic peptide
GKQSQAA

SEQ ID NO: 8752 - protein, 7 aa, Artificial Sequence
  Description of Artificial Sequence: Synthetic peptide
GIQTPSA

SEQ ID NO: 8753 - protein, 7 aa, Artificial Sequence
  Description of Artificial Sequence: Synthetic peptide
ESSNARS

SEQ ID NO: 8754 - protein, 7 aa, Artificial Sequence
  Description of Artificial Sequence: Synthetic peptide
STREQKG

SEQ ID NO: 8755 - protein, 7 aa, Artificial Sequence
  Description of Artificial Sequence: Synthetic peptide
MPSNSSA

SEQ ID NO: 8756 - protein, 7 aa, Artificial Sequence
  Description of Artificial Sequence: Synthetic peptide
DSTTKNT

SEQ ID NO: 8757 - protein, 7 aa, Artificial Sequence
  Description of Artificial Sequence: Synthetic peptide
DVSGSKA

SEQ ID NO: 8758 - protein, 7 aa, Artificial Sequence
  Description of Artificial Sequence: Synthetic peptide
DVPAAKI

SEQ ID NO: 8759 - protein, 7 aa, Artificial Sequence
  Description of Artificial Sequence: Synthetic peptide
AGGNKES

SEQ ID NO: 8760 - protein, 7 aa, Artificial Sequence
  Description of Artificial Sequence: Synthetic peptide
ANQAGSQ

SEQ ID NO: 8761 - protein, 7 aa, Artificial Sequence
  Description of Artificial Sequence: Synthetic peptide
GRGDNVG

SEQ ID NO: 8762 - protein, 7 aa, Artificial Sequence
  Description of Artificial Sequence: Synthetic peptide
SGDSRVH

SEQ ID NO: 8763 - protein, 7 aa, Artificial Sequence
  Description of Artificial Sequence: Synthetic peptide
NGSNNTT

SEQ ID NO: 8764 - protein, 7 aa, Artificial Sequence
  Description of Artificial Sequence: Synthetic peptide
NSRTPPN

SEQ ID NO: 8765 - protein, 7 aa, Artificial Sequence
  Description of Artificial Sequence: Synthetic peptide
TPSSETR

SEQ ID NO: 8766 - protein, 7 aa, Artificial Sequence
  Description of Artificial Sequence: Synthetic peptide
TNSAGAA

SEQ ID NO: 8767 - protein, 7 aa, Artificial Sequence
  Description of Artificial Sequence: Synthetic peptide
TSRDAQK

SEQ ID NO: 8768 - protein, 7 aa, Artificial Sequence
  Description of Artificial Sequence: Synthetic peptide
GLESPRK

SEQ ID NO: 8769 - protein, 7 aa, Artificial Sequence
  Description of Artificial Sequence: Synthetic peptide
GSNTSVA

SEQ ID NO: 8770 - protein, 7 aa, Artificial Sequence
  Description of Artificial Sequence: Synthetic peptide
KGLSSST

SEQ ID NO: 8771 - protein, 7 aa, Artificial Sequence
  Description of Artificial Sequence: Synthetic peptide
SSGGQHQ

SEQ ID NO: 8772 - protein, 7 aa, Artificial Sequence
  Description of Artificial Sequence: Synthetic peptide
QSTKELA

SEQ ID NO: 8773 - protein, 7 aa, Artificial Sequence
  Description of Artificial Sequence: Synthetic peptide
AKANLST

SEQ ID NO: 8774 - protein, 7 aa, Artificial Sequence
  Description of Artificial Sequence: Synthetic peptide
ATTSPST

SEQ ID NO: 8775 - protein, 7 aa, Artificial Sequence
  Description of Artificial Sequence: Synthetic peptide
SGSPSSG

SEQ ID NO: 8776 - protein, 7 aa, Artificial Sequence
  Description of Artificial Sequence: Synthetic peptide
EPKPSST

SEQ ID NO: 8777 - protein, 7 aa, Artificial Sequence
  Description of Artificial Sequence: Synthetic peptide
SGSGQNQ

SEQ ID NO: 8778 - protein, 7 aa, Artificial Sequence
  Description of Artificial Sequence: Synthetic peptide
VGTNAPQ

SEQ ID NO: 8779 - protein, 7 aa, Artificial Sequence
  Description of Artificial Sequence: Synthetic peptide
TSSKEAV

SEQ ID NO: 8780 - protein, 7 aa, Artificial Sequence
  Description of Artificial Sequence: Synthetic peptide
SAGTKQT

SEQ ID NO: 8781 - protein, 7 aa, Artificial Sequence
  Description of Artificial Sequence: Synthetic peptide
ITAASST

SEQ ID NO: 8782 - protein, 7 aa, Artificial Sequence
  Description of Artificial Sequence: Synthetic peptide
TSDKGPR

SEQ ID NO: 8783 - protein, 7 aa, Artificial Sequence
  Description of Artificial Sequence: Synthetic peptide
TDPPSRS

SEQ ID NO: 8784 - protein, 7 aa, Artificial Sequence
  Description of Artificial Sequence: Synthetic peptide
SKMNSSV

SEQ ID NO: 8785 - protein, 7 aa, Artificial Sequence
  Description of Artificial Sequence: Synthetic peptide
SSSKPGL

SEQ ID NO: 8786 - protein, 7 aa, Artificial Sequence
  Description of Artificial Sequence: Synthetic peptide
DTGPAHT

SEQ ID NO: 8787 - protein, 7 aa, Artificial Sequence
  Description of Artificial Sequence: Synthetic peptide
EPTRGSS

SEQ ID NO: 8788 - protein, 7 aa, Artificial Sequence
  Description of Artificial Sequence: Synthetic peptide
ATSTDKN

SEQ ID NO: 8789 - protein, 7 aa, Artificial Sequence
  Description of Artificial Sequence: Synthetic peptide
GEHGSSG

SEQ ID NO: 8790 - protein, 7 aa, Artificial Sequence
  Description of Artificial Sequence: Synthetic peptide
GGHNVSN

SEQ ID NO: 8791 - protein, 7 aa, Artificial Sequence
  Description of Artificial Sequence: Synthetic peptide
GSTAGER

SEQ ID NO: 8792 - protein, 7 aa, Artificial Sequence
  Description of Artificial Sequence: Synthetic peptide
VGDMTKA

SEQ ID NO: 8793 - protein, 7 aa, Artificial Sequence
  Description of Artificial Sequence: Synthetic peptide
VKGGATN

SEQ ID NO: 8794 - protein, 7 aa, Artificial Sequence
  Description of Artificial Sequence: Synthetic peptide
LGNGIAN

SEQ ID NO: 8795 - protein, 7 aa, Artificial Sequence
  Description of Artificial Sequence: Synthetic peptide
TLAPTNA

SEQ ID NO: 8796 - protein, 7 aa, Artificial Sequence
  Description of Artificial Sequence: Synthetic peptide
GGTTSPK

SEQ ID NO: 8797 - protein, 7 aa, Artificial Sequence
  Description of Artificial Sequence: Synthetic peptide
QSQKVPA

SEQ ID NO: 8798 - protein, 7 aa, Artificial Sequence
  Description of Artificial Sequence: Synthetic peptide
TSGSNRG

SEQ ID NO: 8799 - protein, 7 aa, Artificial Sequence
  Description of Artificial Sequence: Synthetic peptide
GIDPKLA

SEQ ID NO: 8800 - protein, 7 aa, Artificial Sequence
  Description of Artificial Sequence: Synthetic peptide
LSGSTNS

SEQ ID NO: 8801 - protein, 7 aa, Artificial Sequence
  Description of Artificial Sequence: Synthetic peptide
GTTSGMK

SEQ ID NO: 8802 - protein, 7 aa, Artificial Sequence
  Description of Artificial Sequence: Synthetic peptide
SIKSPSD

SEQ ID NO: 8803 - protein, 7 aa, Artificial Sequence
  Description of Artificial Sequence: Synthetic peptide
SPSPSGG

SEQ ID NO: 8804 - protein, 7 aa, Artificial Sequence
  Description of Artificial Sequence: Synthetic peptide
MPGTSKS

SEQ ID NO: 8805 - protein, 7 aa, Artificial Sequence
  Description of Artificial Sequence: Synthetic peptide
HQATTSQ

SEQ ID NO: 8806 - protein, 7 aa, Artificial Sequence
  Description of Artificial Sequence: Synthetic peptide
AAVAGNG

SEQ ID NO: 8807 - protein, 7 aa, Artificial Sequence
  Description of Artificial Sequence: Synthetic peptide
SDHKSGV

SEQ ID NO: 8808 - protein, 7 aa, Artificial Sequence
  Description of Artificial Sequence: Synthetic peptide
SSSNAAN

SEQ ID NO: 8809 - protein, 7 aa, Artificial Sequence
  Description of Artificial Sequence: Synthetic peptide
DSRGSPK

SEQ ID NO: 8810 - protein, 7 aa, Artificial Sequence
  Description of Artificial Sequence: Synthetic peptide
RQDNRGG

SEQ ID NO: 8811 - protein, 7 aa, Artificial Sequence
  Description of Artificial Sequence: Synthetic peptide
SSGSKLG

SEQ ID NO: 8812 - protein, 7 aa, Artificial Sequence
  Description of Artificial Sequence: Synthetic peptide
GSGGNQN

SEQ ID NO: 8813 - protein, 7 aa, Artificial Sequence
  Description of Artificial Sequence: Synthetic peptide
VASQPTS

SEQ ID NO: 8814 - protein, 7 aa, Artificial Sequence
  Description of Artificial Sequence: Synthetic peptide
AKASGLS

SEQ ID NO: 8815 - protein, 7 aa, Artificial Sequence
  Description of Artificial Sequence: Synthetic peptide
AVSQEKQ

SEQ ID NO: 8816 - protein, 7 aa, Artificial Sequence
  Description of Artificial Sequence: Synthetic peptide
AKGEANG

SEQ ID NO: 8817 - protein, 7 aa, Artificial Sequence
  Description of Artificial Sequence: Synthetic peptide
GTGNSRT

SEQ ID NO: 8818 - protein, 7 aa, Artificial Sequence
  Description of Artificial Sequence: Synthetic peptide
SGLGNSV

SEQ ID NO: 8819 - protein, 7 aa, Artificial Sequence
  Description of Artificial Sequence: Synthetic peptide
CDSKSCS

SEQ ID NO: 8820 - protein, 7 aa, Artificial Sequence
  Description of Artificial Sequence: Synthetic peptide
EPKPANT

SEQ ID NO: 8821 - protein, 7 aa, Artificial Sequence
  Description of Artificial Sequence: Synthetic peptide
GSSQASL

SEQ ID NO: 8822 - protein, 7 aa, Artificial Sequence
  Description of Artificial Sequence: Synthetic peptide
TQSSPTS

SEQ ID NO: 8823 - protein, 7 aa, Artificial Sequence
  Description of Artificial Sequence: Synthetic peptide
TNGQKFS

SEQ ID NO: 8824 - protein, 7 aa, Artificial Sequence
  Description of Artificial Sequence: Synthetic peptide
RSDEKRL

SEQ ID NO: 8825 - protein, 7 aa, Artificial Sequence
  Description of Artificial Sequence: Synthetic peptide
SMQKEQT

SEQ ID NO: 8826 - protein, 7 aa, Artificial Sequence
  Description of Artificial Sequence: Synthetic peptide
SGAGSVG

SEQ ID NO: 8827 - protein, 7 aa, Artificial Sequence
  Description of Artificial Sequence: Synthetic peptide
EMPTRNG

SEQ ID NO: 8828 - protein, 7 aa, Artificial Sequence
  Description of Artificial Sequence: Synthetic peptide
DAITTKG

SEQ ID NO: 8829 - protein, 7 aa, Artificial Sequence
  Description of Artificial Sequence: Synthetic peptide
EATKSPS

SEQ ID NO: 8830 - protein, 7 aa, Artificial Sequence
  Description of Artificial Sequence: Synthetic peptide
DTMATSK

SEQ ID NO: 8831 - protein, 7 aa, Artificial Sequence
  Description of Artificial Sequence: Synthetic peptide
AGGNAGL

SEQ ID NO: 8832 - protein, 7 aa, Artificial Sequence
  Description of Artificial Sequence: Synthetic peptide
GVNGPNS

SEQ ID NO: 8833 - protein, 7 aa, Artificial Sequence
  Description of Artificial Sequence: Synthetic peptide
VSPGPKS

SEQ ID NO: 8834 - protein, 7 aa, Artificial Sequence
  Description of Artificial Sequence: Synthetic peptide
VTANMNT

SEQ ID NO: 8835 - protein, 7 aa, Artificial Sequence
  Description of Artificial Sequence: Synthetic peptide
LGNNTTA

SEQ ID NO: 8836 - protein, 7 aa, Artificial Sequence
  Description of Artificial Sequence: Synthetic peptide
GATSHTS

SEQ ID NO: 8837 - protein, 7 aa, Artificial Sequence
  Description of Artificial Sequence: Synthetic peptide
SPSVTST

SEQ ID NO: 8838 - protein, 7 aa, Artificial Sequence
  Description of Artificial Sequence: Synthetic peptide
GNATANS

SEQ ID NO: 8839 - protein, 7 aa, Artificial Sequence
  Description of Artificial Sequence: Synthetic peptide
NNKVKPE

SEQ ID NO: 8840 - protein, 7 aa, Artificial Sequence
  Description of Artificial Sequence: Synthetic peptide
QASSHPS

SEQ ID NO: 8841 - protein, 7 aa, Artificial Sequence
  Description of Artificial Sequence: Synthetic peptide
GLVDHKE

SEQ ID NO: 8842 - protein, 7 aa, Artificial Sequence
  Description of Artificial Sequence: Synthetic peptide
SANSGNV

SEQ ID NO: 8843 - protein, 7 aa, Artificial Sequence
  Description of Artificial Sequence: Synthetic peptide
SNNDPRR

SEQ ID NO: 8844 - protein, 7 aa, Artificial Sequence
  Description of Artificial Sequence: Synthetic peptide
EGNTRGT

SEQ ID NO: 8845 - protein, 7 aa, Artificial Sequence
  Description of Artificial Sequence: Synthetic peptide
ANSGGSS

SEQ ID NO: 8846 - protein, 7 aa, Artificial Sequence
  Description of Artificial Sequence: Synthetic peptide
GSTSTPV

SEQ ID NO: 8847 - protein, 7 aa, Artificial Sequence
  Description of Artificial Sequence: Synthetic peptide
GHGEANT

SEQ ID NO: 8848 - protein, 7 aa, Artificial Sequence
  Description of Artificial Sequence: Synthetic peptide
GNVAKPS

SEQ ID NO: 8849 - protein, 7 aa, Artificial Sequence
  Description of Artificial Sequence: Synthetic peptide
TLSNPVA

SEQ ID NO: 8850 - protein, 7 aa, Artificial Sequence
  Description of Artificial Sequence: Synthetic peptide
SLAGNRT

SEQ ID NO: 8851 - protein, 7 aa, Artificial Sequence
  Description of Artificial Sequence: Synthetic peptide
SDGARST

SEQ ID NO: 8852 - protein, 7 aa, Artificial Sequence
  Description of Artificial Sequence: Synthetic peptide
MGTNTPA

SEQ ID NO: 8853 - protein, 7 aa, Artificial Sequence
  Description of Artificial Sequence: Synthetic peptide
LGQSSTN

SEQ ID NO: 8854 - protein, 7 aa, Artificial Sequence
  Description of Artificial Sequence: Synthetic peptide
GLDSSVK

SEQ ID NO: 8855 - protein, 7 aa, Artificial Sequence
  Description of Artificial Sequence: Synthetic peptide
GERVGNR

SEQ ID NO: 8856 - protein, 7 aa, Artificial Sequence
  Description of Artificial Sequence: Synthetic peptide
VQGQASH

SEQ ID NO: 8857 - protein, 7 aa, Artificial Sequence
  Description of Artificial Sequence: Synthetic peptide
STRSPTI

SEQ ID NO: 8858 - protein, 7 aa, Artificial Sequence
  Description of Artificial Sequence: Synthetic peptide
LQNSTTL

SEQ ID NO: 8859 - protein, 7 aa, Artificial Sequence
  Description of Artificial Sequence: Synthetic peptide
HATKATT

SEQ ID NO: 8860 - protein, 7 aa, Artificial Sequence
  Description of Artificial Sequence: Synthetic peptide
TVQRDNQ

SEQ ID NO: 8861 - protein, 7 aa, Artificial Sequence
  Description of Artificial Sequence: Synthetic peptide
LKSGSTG

SEQ ID NO: 8862 - protein, 7 aa, Artificial Sequence
  Description of Artificial Sequence: Synthetic peptide
SSETRTA

SEQ ID NO: 8863 - protein, 7 aa, Artificial Sequence
  Description of Artificial Sequence: Synthetic peptide
NRVSSAN

SEQ ID NO: 8864 - protein, 7 aa, Artificial Sequence
  Description of Artificial Sequence: Synthetic peptide
TPNGQMT

SEQ ID NO: 8865 - protein, 7 aa, Artificial Sequence
  Description of Artificial Sequence: Synthetic peptide
TGTRSMQ

SEQ ID NO: 8866 - protein, 7 aa, Artificial Sequence
  Description of Artificial Sequence: Synthetic peptide
SVGQLPK

SEQ ID NO: 8867 - protein, 7 aa, Artificial Sequence
  Description of Artificial Sequence: Synthetic peptide
SATNQMS

SEQ ID NO: 8868 - protein, 7 aa, Artificial Sequence
  Description of Artificial Sequence: Synthetic peptide
KGVDSHG

SEQ ID NO: 8869 - protein, 7 aa, Artificial Sequence
  Description of Artificial Sequence: Synthetic peptide
NQHKPSE

SEQ ID NO: 8870 - protein, 7 aa, Artificial Sequence
  Description of Artificial Sequence: Synthetic peptide
SAQSSPL

SEQ ID NO: 8871 - protein, 7 aa, Artificial Sequence
  Description of Artificial Sequence: Synthetic peptide
SGISGVA

SEQ ID NO: 8872 - protein, 7 aa, Artificial Sequence
  Description of Artificial Sequence: Synthetic peptide
HGQSSVV

SEQ ID NO: 8873 - protein, 7 aa, Artificial Sequence
  Description of Artificial Sequence: Synthetic peptide
VPSNPPN

SEQ ID NO: 8874 - protein, 7 aa, Artificial Sequence
  Description of Artificial Sequence: Synthetic peptide
STKTAPT

SEQ ID NO: 8875 - protein, 7 aa, Artificial Sequence
  Description of Artificial Sequence: Synthetic peptide
NRESAST

SEQ ID NO: 8876 - protein, 7 aa, Artificial Sequence
  Description of Artificial Sequence: Synthetic peptide
NGSGAQI

SEQ ID NO: 8877 - protein, 7 aa, Artificial Sequence
  Description of Artificial Sequence: Synthetic peptide
TLGSTPV

SEQ ID NO: 8878 - protein, 7 aa, Artificial Sequence
  Description of Artificial Sequence: Synthetic peptide
SPGNRSG

SEQ ID NO: 8879 - protein, 7 aa, Artificial Sequence
  Description of Artificial Sequence: Synthetic peptide
RGQGANV

SEQ ID NO: 8880 - protein, 7 aa, Artificial Sequence
  Description of Artificial Sequence: Synthetic peptide
DRTKTNV

SEQ ID NO: 8881 - protein, 7 aa, Artificial Sequence
  Description of Artificial Sequence: Synthetic peptide
RSESSAV

SEQ ID NO: 8882 - protein, 7 aa, Artificial Sequence
  Description of Artificial Sequence: Synthetic peptide
LDSNKAP

SEQ ID NO: 8883 - protein, 7 aa, Artificial Sequence
  Description of Artificial Sequence: Synthetic peptide
KGESGGV

SEQ ID NO: 8884 - protein, 7 aa, Artificial Sequence
  Description of Artificial Sequence: Synthetic peptide
NAENSRL

SEQ ID NO: 8885 - protein, 7 aa, Artificial Sequence
  Description of Artificial Sequence: Synthetic peptide
DGQRTSS

SEQ ID NO: 8886 - protein, 7 aa, Artificial Sequence
  Description of Artificial Sequence: Synthetic peptide
ASSPGGM

SEQ ID NO: 8887 - protein, 7 aa, Artificial Sequence
  Description of Artificial Sequence: Synthetic peptide
TGSTGIK

SEQ ID NO: 8888 - protein, 7 aa, Artificial Sequence
  Description of Artificial Sequence: Synthetic peptide
TLGGTNS

SEQ ID NO: 8889 - protein, 7 aa, Artificial Sequence
  Description of Artificial Sequence: Synthetic peptide
IGSSTGG

SEQ ID NO: 8890 - protein, 7 aa, Artificial Sequence
  Description of Artificial Sequence: Synthetic peptide
SSLHKDG

SEQ ID NO: 8891 - protein, 7 aa, Artificial Sequence
  Description of Artificial Sequence: Synthetic peptide
NSGSKAS

SEQ ID NO: 8892 - protein, 7 aa, Artificial Sequence
  Description of Artificial Sequence: Synthetic peptide
SGAQSNR

SEQ ID NO: 8893 - protein, 7 aa, Artificial Sequence
  Description of Artificial Sequence: Synthetic peptide
TDEHKAY

SEQ ID NO: 8894 - protein, 7 aa, Artificial Sequence
  Description of Artificial Sequence: Synthetic peptide
QGENSTK

SEQ ID NO: 8895 - protein, 7 aa, Artificial Sequence
  Description of Artificial Sequence: Synthetic peptide
GMDPKAS

SEQ ID NO: 8896 - protein, 7 aa, Artificial Sequence
  Description of Artificial Sequence: Synthetic peptide
DGATGTQ

SEQ ID NO: 8897 - protein, 7 aa, Artificial Sequence
  Description of Artificial Sequence: Synthetic peptide
TQANGGK

SEQ ID NO: 8898 - protein, 7 aa, Artificial Sequence
  Description of Artificial Sequence: Synthetic peptide
GNGHNAI

SEQ ID NO: 8899 - protein, 7 aa, Artificial Sequence
  Description of Artificial Sequence: Synthetic peptide
GPSGQER

SEQ ID NO: 8900 - protein, 7 aa, Artificial Sequence
  Description of Artificial Sequence: Synthetic peptide
NGTSSHM

SEQ ID NO: 8901 - protein, 7 aa, Artificial Sequence
  Description of Artificial Sequence: Synthetic peptide
DVPKTGS

SEQ ID NO: 8902 - protein, 7 aa, Artificial Sequence
  Description of Artificial Sequence: Synthetic peptide
GAVPGQT

SEQ ID NO: 8903 - protein, 7 aa, Artificial Sequence
  Description of Artificial Sequence: Synthetic peptide
DRPPPGS

SEQ ID NO: 8904 - protein, 7 aa, Artificial Sequence
  Description of Artificial Sequence: Synthetic peptide
TRETSSG

SEQ ID NO: 8905 - protein, 7 aa, Artificial Sequence
  Description of Artificial Sequence: Synthetic peptide
RSGADPA

SEQ ID NO: 8906 - protein, 7 aa, Artificial Sequence
  Description of Artificial Sequence: Synthetic peptide
LTSQPAN

SEQ ID NO: 8907 - protein, 7 aa, Artificial Sequence
  Description of Artificial Sequence: Synthetic peptide
SLTTATK

SEQ ID NO: 8908 - protein, 7 aa, Artificial Sequence
  Description of Artificial Sequence: Synthetic peptide
DPDRSAK

SEQ ID NO: 8909 - protein, 7 aa, Artificial Sequence
  Description of Artificial Sequence: Synthetic peptide
SPSGSLS

SEQ ID NO: 8910 - protein, 7 aa, Artificial Sequence
  Description of Artificial Sequence: Synthetic peptide
STSGTSS

SEQ ID NO: 8911 - protein, 7 aa, Artificial Sequence
  Description of Artificial Sequence: Synthetic peptide
LTGATSS

SEQ ID NO: 8912 - protein, 7 aa, Artificial Sequence
  Description of Artificial Sequence: Synthetic peptide
LSNSPSA

SEQ ID NO: 8913 - protein, 7 aa, Artificial Sequence
  Description of Artificial Sequence: Synthetic peptide
ITGSGPA

SEQ ID NO: 8914 - protein, 7 aa, Artificial Sequence
  Description of Artificial Sequence: Synthetic peptide
GGGNASG

SEQ ID NO: 8915 - protein, 7 aa, Artificial Sequence
  Description of Artificial Sequence: Synthetic peptide
GTNSSLN

SEQ ID NO: 8916 - protein, 7 aa, Artificial Sequence
  Description of Artificial Sequence: Synthetic peptide
TMDSRSA

SEQ ID NO: 8917 - protein, 7 aa, Artificial Sequence
  Description of Artificial Sequence: Synthetic peptide
QRNGSPL

SEQ ID NO: 8918 - protein, 7 aa, Artificial Sequence
  Description of Artificial Sequence: Synthetic peptide
NNASAKS

SEQ ID NO: 8919 - protein, 7 aa, Artificial Sequence
  Description of Artificial Sequence: Synthetic peptide
KPQDNSS

SEQ ID NO: 8920 - protein, 7 aa, Artificial Sequence
  Description of Artificial Sequence: Synthetic peptide
IAGGKTV

SEQ ID NO: 8921 - protein, 7 aa, Artificial Sequence
  Description of Artificial Sequence: Synthetic peptide
LLSGDSR

SEQ ID NO: 8922 - protein, 7 aa, Artificial Sequence
  Description of Artificial Sequence: Synthetic peptide
GVQVSSG

SEQ ID NO: 8923 - protein, 7 aa, Artificial Sequence
  Description of Artificial Sequence: Synthetic peptide
VQNTGGG

SEQ ID NO: 8924 - protein, 7 aa, Artificial Sequence
  Description of Artificial Sequence: Synthetic peptide
SRNQSNS

SEQ ID NO: 8925 - protein, 7 aa, Artificial Sequence
  Description of Artificial Sequence: Synthetic peptide
AGIKPSQ

SEQ ID NO: 8926 - protein, 7 aa, Artificial Sequence
  Description of Artificial Sequence: Synthetic peptide
ASQPAGS

SEQ ID NO: 8927 - protein, 7 aa, Artificial Sequence
  Description of Artificial Sequence: Synthetic peptide
KANPSPA

SEQ ID NO: 8928 - protein, 7 aa, Artificial Sequence
  Description of Artificial Sequence: Synthetic peptide
KDQPSTN

SEQ ID NO: 8929 - protein, 7 aa, Artificial Sequence
  Description of Artificial Sequence: Synthetic peptide
MVGKSSS

SEQ ID NO: 8930 - protein, 7 aa, Artificial Sequence
  Description of Artificial Sequence: Synthetic peptide
QSTGSPT

SEQ ID NO: 8931 - protein, 7 aa, Artificial Sequence
  Description of Artificial Sequence: Synthetic peptide
LPSPSTL

SEQ ID NO: 8932 - protein, 7 aa, Artificial Sequence
  Description of Artificial Sequence: Synthetic peptide
DAISSKR

SEQ ID NO: 8933 - protein, 7 aa, Artificial Sequence
  Description of Artificial Sequence: Synthetic peptide
CSVPSLG

SEQ ID NO: 8934 - protein, 7 aa, Artificial Sequence
  Description of Artificial Sequence: Synthetic peptide
VRDSSTL

SEQ ID NO: 8935 - protein, 7 aa, Artificial Sequence
  Description of Artificial Sequence: Synthetic peptide
GVGDGKL

SEQ ID NO: 8936 - protein, 7 aa, Artificial Sequence
  Description of Artificial Sequence: Synthetic peptide
MQDNKAM

SEQ ID NO: 8937 - protein, 7 aa, Artificial Sequence
  Description of Artificial Sequence: Synthetic peptide
ASDSVPK

SEQ ID NO: 8938 - protein, 7 aa, Artificial Sequence
  Description of Artificial Sequence: Synthetic peptide
SGNDARR

SEQ ID NO: 8939 - protein, 7 aa, Artificial Sequence
  Description of Artificial Sequence: Synthetic peptide
TAGNSSQ

SEQ ID NO: 8940 - protein, 7 aa, Artificial Sequence
  Description of Artificial Sequence: Synthetic peptide
EKARQSA

SEQ ID NO: 8941 - protein, 7 aa, Artificial Sequence
  Description of Artificial Sequence: Synthetic peptide
AGKESNR

SEQ ID NO: 8942 - protein, 7 aa, Artificial Sequence
  Description of Artificial Sequence: Synthetic peptide
AHGNPSG

SEQ ID NO: 8943 - protein, 7 aa, Artificial Sequence
  Description of Artificial Sequence: Synthetic peptide
VGSSSAK

SEQ ID NO: 8944 - protein, 7 aa, Artificial Sequence
  Description of Artificial Sequence: Synthetic peptide
SLTKAQA

SEQ ID NO: 8945 - protein, 7 aa, Artificial Sequence
  Description of Artificial Sequence: Synthetic peptide
TASNAST

SEQ ID NO: 8946 - protein, 7 aa, Artificial Sequence
  Description of Artificial Sequence: Synthetic peptide
RNEGSPN

SEQ ID NO: 8947 - protein, 7 aa, Artificial Sequence
  Description of Artificial Sequence: Synthetic peptide
QSKEATS

SEQ ID NO: 8948 - protein, 7 aa, Artificial Sequence
  Description of Artificial Sequence: Synthetic peptide
HGLPNAK

SEQ ID NO: 8949 - protein, 7 aa, Artificial Sequence
  Description of Artificial Sequence: Synthetic peptide
SGAANPA

SEQ ID NO: 8950 - protein, 7 aa, Artificial Sequence
  Description of Artificial Sequence: Synthetic peptide
GLGSENH

SEQ ID NO: 8951 - protein, 7 aa, Artificial Sequence
  Description of Artificial Sequence: Synthetic peptide
SSNSDVR

SEQ ID NO: 8952 - protein, 7 aa, Artificial Sequence
  Description of Artificial Sequence: Synthetic peptide
SATGSNR

SEQ ID NO: 8953 - protein, 7 aa, Artificial Sequence
  Description of Artificial Sequence: Synthetic peptide
SRTDRPV

SEQ ID NO: 8954 - protein, 7 aa, Artificial Sequence
  Description of Artificial Sequence: Synthetic peptide
NSQKVNM

SEQ ID NO: 8955 - protein, 7 aa, Artificial Sequence
  Description of Artificial Sequence: Synthetic peptide
NGETGPK

SEQ ID NO: 8956 - protein, 7 aa, Artificial Sequence
  Description of Artificial Sequence: Synthetic peptide
SQVQTSK

SEQ ID NO: 8957 - protein, 7 aa, Artificial Sequence
  Description of Artificial Sequence: Synthetic peptide
GGQPSKD

SEQ ID NO: 8958 - protein, 7 aa, Artificial Sequence
  Description of Artificial Sequence: Synthetic peptide
GGVAPNQ

SEQ ID NO: 8959 - protein, 7 aa, Artificial Sequence
  Description of Artificial Sequence: Synthetic peptide
VTKGSQS

SEQ ID NO: 8960 - protein, 7 aa, Artificial Sequence
  Description of Artificial Sequence: Synthetic peptide
EMSATNS

SEQ ID NO: 8961 - protein, 7 aa, Artificial Sequence
  Description of Artificial Sequence: Synthetic peptide
DLQIAKG

SEQ ID NO: 8962 - protein, 7 aa, Artificial Sequence
  Description of Artificial Sequence: Synthetic peptide
ANNSSMQ

SEQ ID NO: 8963 - protein, 7 aa, Artificial Sequence
  Description of Artificial Sequence: Synthetic peptide
SQVAATV

SEQ ID NO: 8964 - protein, 7 aa, Artificial Sequence
  Description of Artificial Sequence: Synthetic peptide
LVKGSSS

SEQ ID NO: 8965 - protein, 7 aa, Artificial Sequence
  Description of Artificial Sequence: Synthetic peptide
DVSSKVP

SEQ ID NO: 8966 - protein, 7 aa, Artificial Sequence
  Description of Artificial Sequence: Synthetic peptide
FPNGNST

SEQ ID NO: 8967 - protein, 7 aa, Artificial Sequence
  Description of Artificial Sequence: Synthetic peptide
RNSTPST

SEQ ID NO: 8968 - protein, 7 aa, Artificial Sequence
  Description of Artificial Sequence: Synthetic peptide
SVLDGKS

SEQ ID NO: 8969 - protein, 7 aa, Artificial Sequence
  Description of Artificial Sequence: Synthetic peptide
DRQNASS

SEQ ID NO: 8970 - protein, 7 aa, Artificial Sequence
  Description of Artificial Sequence: Synthetic peptide
DGGSSLR

SEQ ID NO: 8971 - protein, 7 aa, Artificial Sequence
  Description of Artificial Sequence: Synthetic peptide
MPTKTST

SEQ ID NO: 8972 - protein, 7 aa, Artificial Sequence
  Description of Artificial Sequence: Synthetic peptide
SPDTAPR

SEQ ID NO: 8973 - protein, 7 aa, Artificial Sequence
  Description of Artificial Sequence: Synthetic peptide
TKSQSIM

SEQ ID NO: 8974 - protein, 7 aa, Artificial Sequence
  Description of Artificial Sequence: Synthetic peptide
RGNGAPA

SEQ ID NO: 8975 - protein, 7 aa, Artificial Sequence
  Description of Artificial Sequence: Synthetic peptide
QGSTSSR

SEQ ID NO: 8976 - protein, 7 aa, Artificial Sequence
  Description of Artificial Sequence: Synthetic peptide
TDPAPKH

SEQ ID NO: 8977 - protein, 7 aa, Artificial Sequence
  Description of Artificial Sequence: Synthetic peptide
SATSPNR

SEQ ID NO: 8978 - protein, 7 aa, Artificial Sequence
  Description of Artificial Sequence: Synthetic peptide
SVNSSPH

SEQ ID NO: 8979 - protein, 7 aa, Artificial Sequence
  Description of Artificial Sequence: Synthetic peptide
DVGDRPV

SEQ ID NO: 8980 - protein, 7 aa, Artificial Sequence
  Description of Artificial Sequence: Synthetic peptide
MSGASTA

SEQ ID NO: 8981 - protein, 7 aa, Artificial Sequence
  Description of Artificial Sequence: Synthetic peptide
LPAGKLA

SEQ ID NO: 8982 - protein, 7 aa, Artificial Sequence
  Description of Artificial Sequence: Synthetic peptide
SSLNGNS

SEQ ID NO: 8983 - protein, 7 aa, Artificial Sequence
  Description of Artificial Sequence: Synthetic peptide
DSMGTRN

SEQ ID NO: 8984 - protein, 7 aa, Artificial Sequence
  Description of Artificial Sequence: Synthetic peptide
NANGSLG

SEQ ID NO: 8985 - protein, 7 aa, Artificial Sequence
  Description of Artificial Sequence: Synthetic peptide
NPDVSGK

SEQ ID NO: 8986 - protein, 7 aa, Artificial Sequence
  Description of Artificial Sequence: Synthetic peptide
NATTPTN

SEQ ID NO: 8987 - protein, 7 aa, Artificial Sequence
  Description of Artificial Sequence: Synthetic peptide
TTNKQLA

SEQ ID NO: 8988 - protein, 7 aa, Artificial Sequence
  Description of Artificial Sequence: Synthetic peptide
TTQSTAQ

SEQ ID NO: 8989 - protein, 7 aa, Artificial Sequence
  Description of Artificial Sequence: Synthetic peptide
TGSNQPG

SEQ ID NO: 8990 - protein, 7 aa, Artificial Sequence
  Description of Artificial Sequence: Synthetic peptide
TNSNPSL

SEQ ID NO: 8991 - protein, 7 aa, Artificial Sequence
  Description of Artificial Sequence: Synthetic peptide
TTGATMS

SEQ ID NO: 8992 - protein, 7 aa, Artificial Sequence
  Description of Artificial Sequence: Synthetic peptide
THGDSKS

SEQ ID NO: 8993 - protein, 7 aa, Artificial Sequence
  Description of Artificial Sequence: Synthetic peptide
SSGATAV

SEQ ID NO: 8994 - protein, 7 aa, Artificial Sequence
  Description of Artificial Sequence: Synthetic peptide
SGGHTTA

SEQ ID NO: 8995 - protein, 7 aa, Artificial Sequence
  Description of Artificial Sequence: Synthetic peptide
RNAQPMT

SEQ ID NO: 8996 - protein, 7 aa, Artificial Sequence
  Description of Artificial Sequence: Synthetic peptide
RESQKSL

SEQ ID NO: 8997 - protein, 7 aa, Artificial Sequence
  Description of Artificial Sequence: Synthetic peptide
SKTSNNA

SEQ ID NO: 8998 - protein, 7 aa, Artificial Sequence
  Description of Artificial Sequence: Synthetic peptide
SKQPGGI

SEQ ID NO: 8999 - protein, 7 aa, Artificial Sequence
  Description of Artificial Sequence: Synthetic peptide
STGATMS

SEQ ID NO: 9000 - protein, 7 aa, Artificial Sequence
  Description of Artificial Sequence: Synthetic peptide
MAQSGTG

SEQ ID NO: 9001 - protein, 7 aa, Artificial Sequence
  Description of Artificial Sequence: Synthetic peptide
MGGVSSS

SEQ ID NO: 9002 - protein, 7 aa, Artificial Sequence
  Description of Artificial Sequence: Synthetic peptide
QTSRDSS

SEQ ID NO: 9003 - protein, 7 aa, Artificial Sequence
  Description of Artificial Sequence: Synthetic peptide
QGKSITG

SEQ ID NO: 9004 - protein, 7 aa, Artificial Sequence
  Description of Artificial Sequence: Synthetic peptide
HKSANVG

SEQ ID NO: 9005 - protein, 7 aa, Artificial Sequence
  Description of Artificial Sequence: Synthetic peptide
HTAKSSL

SEQ ID NO: 9006 - protein, 7 aa, Artificial Sequence
  Description of Artificial Sequence: Synthetic peptide
HQNQRDG

SEQ ID NO: 9007 - protein, 7 aa, Artificial Sequence
  Description of Artificial Sequence: Synthetic peptide
QEGTHTA

SEQ ID NO: 9008 - protein, 7 aa, Artificial Sequence
  Description of Artificial Sequence: Synthetic peptide
QDKGNTG

SEQ ID NO: 9009 - protein, 7 aa, Artificial Sequence
  Description of Artificial Sequence: Synthetic peptide
QVGSTPA

SEQ ID NO: 9010 - protein, 7 aa, Artificial Sequence
  Description of Artificial Sequence: Synthetic peptide
RGESKAN

SEQ ID NO: 9011 - protein, 7 aa, Artificial Sequence
  Description of Artificial Sequence: Synthetic peptide
LTTSGSQ

SEQ ID NO: 9012 - protein, 7 aa, Artificial Sequence
  Description of Artificial Sequence: Synthetic peptide
LSTSQPS

SEQ ID NO: 9013 - protein, 7 aa, Artificial Sequence
  Description of Artificial Sequence: Synthetic peptide
LQDRKAS

SEQ ID NO: 9014 - protein, 7 aa, Artificial Sequence
  Description of Artificial Sequence: Synthetic peptide
LANPPAG

SEQ ID NO: 9015 - protein, 7 aa, Artificial Sequence
  Description of Artificial Sequence: Synthetic peptide
EGPSGTH

SEQ ID NO: 9016 - protein, 7 aa, Artificial Sequence
  Description of Artificial Sequence: Synthetic peptide
EGGQSRV

SEQ ID NO: 9017 - protein, 7 aa, Artificial Sequence
  Description of Artificial Sequence: Synthetic peptide
DTTPRSS

SEQ ID NO: 9018 - protein, 7 aa, Artificial Sequence
  Description of Artificial Sequence: Synthetic peptide
DGTQAPV

SEQ ID NO: 9019 - protein, 7 aa, Artificial Sequence
  Description of Artificial Sequence: Synthetic peptide
DGRNHSA

SEQ ID NO: 9020 - protein, 7 aa, Artificial Sequence
  Description of Artificial Sequence: Synthetic peptide
DGGSAAR

SEQ ID NO: 9021 - protein, 7 aa, Artificial Sequence
  Description of Artificial Sequence: Synthetic peptide
EQGASSH

SEQ ID NO: 9022 - protein, 7 aa, Artificial Sequence
  Description of Artificial Sequence: Synthetic peptide
DTAPSNH

SEQ ID NO: 9023 - protein, 7 aa, Artificial Sequence
  Description of Artificial Sequence: Synthetic peptide
DRSGTPL

SEQ ID NO: 9024 - protein, 7 aa, Artificial Sequence
  Description of Artificial Sequence: Synthetic peptide
AKSNGSR

SEQ ID NO: 9025 - protein, 7 aa, Artificial Sequence
  Description of Artificial Sequence: Synthetic peptide
ADARNAG

SEQ ID NO: 9026 - protein, 7 aa, Artificial Sequence
  Description of Artificial Sequence: Synthetic peptide
APTDNRS

SEQ ID NO: 9027 - protein, 7 aa, Artificial Sequence
  Description of Artificial Sequence: Synthetic peptide
AVESRNV

SEQ ID NO: 9028 - protein, 7 aa, Artificial Sequence
  Description of Artificial Sequence: Synthetic peptide
GSTGQGR

SEQ ID NO: 9029 - protein, 7 aa, Artificial Sequence
  Description of Artificial Sequence: Synthetic peptide
GSENSPR

SEQ ID NO: 9030 - protein, 7 aa, Artificial Sequence
  Description of Artificial Sequence: Synthetic peptide
GHDRVAS

SEQ ID NO: 9031 - protein, 7 aa, Artificial Sequence
  Description of Artificial Sequence: Synthetic peptide
GLGEPRA

SEQ ID NO: 9032 - protein, 7 aa, Artificial Sequence
  Description of Artificial Sequence: Synthetic peptide
GMAQAGG

SEQ ID NO: 9033 - protein, 7 aa, Artificial Sequence
  Description of Artificial Sequence: Synthetic peptide
GPERAAL

SEQ ID NO: 9034 - protein, 7 aa, Artificial Sequence
  Description of Artificial Sequence: Synthetic peptide
GLGGKVN

SEQ ID NO: 9035 - protein, 7 aa, Artificial Sequence
  Description of Artificial Sequence: Synthetic peptide
GATTQST

SEQ ID NO: 9036 - protein, 7 aa, Artificial Sequence
  Description of Artificial Sequence: Synthetic peptide
GVGGSTS

SEQ ID NO: 9037 - protein, 7 aa, Artificial Sequence
  Description of Artificial Sequence: Synthetic peptide
GQNSGMT

SEQ ID NO: 9038 - protein, 7 aa, Artificial Sequence
  Description of Artificial Sequence: Synthetic peptide
GPSQSGG

SEQ ID NO: 9039 - protein, 7 aa, Artificial Sequence
  Description of Artificial Sequence: Synthetic peptide
VSTNKTP

SEQ ID NO: 9040 - protein, 7 aa, Artificial Sequence
  Description of Artificial Sequence: Synthetic peptide
VSESRPG

SEQ ID NO: 9041 - protein, 7 aa, Artificial Sequence
  Description of Artificial Sequence: Synthetic peptide
VAKASNT

SEQ ID NO: 9042 - protein, 7 aa, Artificial Sequence
  Description of Artificial Sequence: Synthetic peptide
VASDSSK

SEQ ID NO: 9043 - protein, 7 aa, Artificial Sequence
  Description of Artificial Sequence: Synthetic peptide
VGSATVI

SEQ ID NO: 9044 - protein, 7 aa, Artificial Sequence
  Description of Artificial Sequence: Synthetic peptide
SQSPQER

SEQ ID NO: 9045 - protein, 7 aa, Artificial Sequence
  Description of Artificial Sequence: Synthetic peptide
SGPTNRE

SEQ ID NO: 9046 - protein, 7 aa, Artificial Sequence
  Description of Artificial Sequence: Synthetic peptide
SGVEHTN

SEQ ID NO: 9047 - protein, 7 aa, Artificial Sequence
  Description of Artificial Sequence: Synthetic peptide
FGATAPG

SEQ ID NO: 9048 - protein, 7 aa, Artificial Sequence
  Description of Artificial Sequence: Synthetic peptide
SVTSGTG

SEQ ID NO: 9049 - protein, 7 aa, Artificial Sequence
  Description of Artificial Sequence: Synthetic peptide
TNGSTMS

SEQ ID NO: 9050 - protein, 7 aa, Artificial Sequence
  Description of Artificial Sequence: Synthetic peptide
GSLSNSG

SEQ ID NO: 9051 - protein, 7 aa, Artificial Sequence
  Description of Artificial Sequence: Synthetic peptide
RNQSPSI

SEQ ID NO: 9052 - protein, 7 aa, Artificial Sequence
  Description of Artificial Sequence: Synthetic peptide
TGTNNPT

SEQ ID NO: 9053 - protein, 7 aa, Artificial Sequence
  Description of Artificial Sequence: Synthetic peptide
TSAQPTT

SEQ ID NO: 9054 - protein, 7 aa, Artificial Sequence
  Description of Artificial Sequence: Synthetic peptide
LTTAKDP

SEQ ID NO: 9055 - protein, 7 aa, Artificial Sequence
  Description of Artificial Sequence: Synthetic peptide
STGTTTQ

SEQ ID NO: 9056 - protein, 7 aa, Artificial Sequence
  Description of Artificial Sequence: Synthetic peptide
RNGTSTN

SEQ ID NO: 9057 - protein, 7 aa, Artificial Sequence
  Description of Artificial Sequence: Synthetic peptide
DQIRSTH

SEQ ID NO: 9058 - protein, 7 aa, Artificial Sequence
  Description of Artificial Sequence: Synthetic peptide
DDGKPGT

SEQ ID NO: 9059 - protein, 7 aa, Artificial Sequence
  Description of Artificial Sequence: Synthetic peptide
VASNSSV

SEQ ID NO: 9060 - protein, 7 aa, Artificial Sequence
  Description of Artificial Sequence: Synthetic peptide
LTEPKLI

SEQ ID NO: 9061 - protein, 7 aa, Artificial Sequence
  Description of Artificial Sequence: Synthetic peptide
SPSNNKA

SEQ ID NO: 9062 - protein, 7 aa, Artificial Sequence
  Description of Artificial Sequence: Synthetic peptide
DANGKSS

SEQ ID NO: 9063 - protein, 7 aa, Artificial Sequence
  Description of Artificial Sequence: Synthetic peptide
SHNDKHV

SEQ ID NO: 9064 - protein, 7 aa, Artificial Sequence
  Description of Artificial Sequence: Synthetic peptide
SRVTVNE

SEQ ID NO: 9065 - protein, 7 aa, Artificial Sequence
  Description of Artificial Sequence: Synthetic peptide
RTTSGPT

SEQ ID NO: 9066 - protein, 7 aa, Artificial Sequence
  Description of Artificial Sequence: Synthetic peptide
DNGKKVV

SEQ ID NO: 9067 - protein, 7 aa, Artificial Sequence
  Description of Artificial Sequence: Synthetic peptide
SNNGAMA

SEQ ID NO: 9068 - protein, 7 aa, Artificial Sequence
  Description of Artificial Sequence: Synthetic peptide
TTHTAAK

SEQ ID NO: 9069 - protein, 7 aa, Artificial Sequence
  Description of Artificial Sequence: Synthetic peptide
MNSSAST

SEQ ID NO: 9070 - protein, 7 aa, Artificial Sequence
  Description of Artificial Sequence: Synthetic peptide
MSTDKIT

SEQ ID NO: 9071 - protein, 7 aa, Artificial Sequence
  Description of Artificial Sequence: Synthetic peptide
MGVNGTS

SEQ ID NO: 9072 - protein, 7 aa, Artificial Sequence
  Description of Artificial Sequence: Synthetic peptide
DSNSKMV

SEQ ID NO: 9073 - protein, 7 aa, Artificial Sequence
  Description of Artificial Sequence: Synthetic peptide
STGGDRS

SEQ ID NO: 9074 - protein, 7 aa, Artificial Sequence
  Description of Artificial Sequence: Synthetic peptide
LKNGNTN

SEQ ID NO: 9075 - protein, 7 aa, Artificial Sequence
  Description of Artificial Sequence: Synthetic peptide
GTSNHDK

SEQ ID NO: 9076 - protein, 7 aa, Artificial Sequence
  Description of Artificial Sequence: Synthetic peptide
KDGSTSL

SEQ ID NO: 9077 - protein, 7 aa, Artificial Sequence
  Description of Artificial Sequence: Synthetic peptide
KGVSQTS

SEQ ID NO: 9078 - protein, 7 aa, Artificial Sequence
  Description of Artificial Sequence: Synthetic peptide
SSNRDTM

SEQ ID NO: 9079 - protein, 7 aa, Artificial Sequence
  Description of Artificial Sequence: Synthetic peptide
TKGSEPH

SEQ ID NO: 9080 - protein, 7 aa, Artificial Sequence
  Description of Artificial Sequence: Synthetic peptide
STQKGAM

SEQ ID NO: 9081 - protein, 7 aa, Artificial Sequence
  Description of Artificial Sequence: Synthetic peptide
SGIPAGV

SEQ ID NO: 9082 - protein, 7 aa, Artificial Sequence
  Description of Artificial Sequence: Synthetic peptide
SGHPSNL

SEQ ID NO: 9083 - protein, 7 aa, Artificial Sequence
  Description of Artificial Sequence: Synthetic peptide
DNNNSRG

SEQ ID NO: 9084 - protein, 7 aa, Artificial Sequence
  Description of Artificial Sequence: Synthetic peptide
GSSQARE

SEQ ID NO: 9085 - protein, 7 aa, Artificial Sequence
  Description of Artificial Sequence: Synthetic peptide
RTGTGTE

SEQ ID NO: 9086 - protein, 7 aa, Artificial Sequence
  Description of Artificial Sequence: Synthetic peptide
GTGSKSV

SEQ ID NO: 9087 - protein, 7 aa, Artificial Sequence
  Description of Artificial Sequence: Synthetic peptide
QTANQNA

SEQ ID NO: 9088 - protein, 7 aa, Artificial Sequence
  Description of Artificial Sequence: Synthetic peptide
VSGSSTG

SEQ ID NO: 9089 - protein, 7 aa, Artificial Sequence
  Description of Artificial Sequence: Synthetic peptide
QDKSGSM

SEQ ID NO: 9090 - protein, 7 aa, Artificial Sequence
  Description of Artificial Sequence: Synthetic peptide
GQGHERA

SEQ ID NO: 9091 - protein, 7 aa, Artificial Sequence
  Description of Artificial Sequence: Synthetic peptide
SNNGSIS

SEQ ID NO: 9092 - protein, 7 aa, Artificial Sequence
  Description of Artificial Sequence: Synthetic peptide
TPNTGSS

SEQ ID NO: 9093 - protein, 7 aa, Artificial Sequence
  Description of Artificial Sequence: Synthetic peptide
QRTKTPE

SEQ ID NO: 9094 - protein, 7 aa, Artificial Sequence
  Description of Artificial Sequence: Synthetic peptide
AGVSNTG

SEQ ID NO: 9095 - protein, 7 aa, Artificial Sequence
  Description of Artificial Sequence: Synthetic peptide
GTGPVTS

SEQ ID NO: 9096 - protein, 7 aa, Artificial Sequence
  Description of Artificial Sequence: Synthetic peptide
GGVASNG

SEQ ID NO: 9097 - protein, 7 aa, Artificial Sequence
  Description of Artificial Sequence: Synthetic peptide
SGHNSST

SEQ ID NO: 9098 - protein, 7 aa, Artificial Sequence
  Description of Artificial Sequence: Synthetic peptide
DGTRAPS

SEQ ID NO: 9099 - protein, 7 aa, Artificial Sequence
  Description of Artificial Sequence: Synthetic peptide
LPSDPRS

SEQ ID NO: 9100 - protein, 7 aa, Artificial Sequence
  Description of Artificial Sequence: Synthetic peptide
QNTSKVL

SEQ ID NO: 9101 - protein, 7 aa, Artificial Sequence
  Description of Artificial Sequence: Synthetic peptide
GGSRDQT

SEQ ID NO: 9102 - protein, 7 aa, Artificial Sequence
  Description of Artificial Sequence: Synthetic peptide
MPSKGSQ

SEQ ID NO: 9103 - protein, 7 aa, Artificial Sequence
  Description of Artificial Sequence: Synthetic peptide
NVGSTSN

SEQ ID NO: 9104 - protein, 7 aa, Artificial Sequence
  Description of Artificial Sequence: Synthetic peptide
NSSGQVH

SEQ ID NO: 9105 - protein, 7 aa, Artificial Sequence
  Description of Artificial Sequence: Synthetic peptide
TQNHESK

SEQ ID NO: 9106 - protein, 7 aa, Artificial Sequence
  Description of Artificial Sequence: Synthetic peptide
QVTGTLG

SEQ ID NO: 9107 - protein, 7 aa, Artificial Sequence
  Description of Artificial Sequence: Synthetic peptide
AISGNSK

SEQ ID NO: 9108 - protein, 7 aa, Artificial Sequence
  Description of Artificial Sequence: Synthetic peptide
TMAKSGG

SEQ ID NO: 9109 - protein, 7 aa, Artificial Sequence
  Description of Artificial Sequence: Synthetic peptide
SKVDKPM

SEQ ID NO: 9110 - protein, 7 aa, Artificial Sequence
  Description of Artificial Sequence: Synthetic peptide
NSSPSLT

SEQ ID NO: 9111 - protein, 7 aa, Artificial Sequence
  Description of Artificial Sequence: Synthetic peptide
SLQSESK

SEQ ID NO: 9112 - protein, 7 aa, Artificial Sequence
  Description of Artificial Sequence: Synthetic peptide
SGAATAS

SEQ ID NO: 9113 - protein, 7 aa, Artificial Sequence
  Description of Artificial Sequence: Synthetic peptide
NQNKETL

SEQ ID NO: 9114 - protein, 7 aa, Artificial Sequence
  Description of Artificial Sequence: Synthetic peptide
SSTGAPG

SEQ ID NO: 9115 - protein, 7 aa, Artificial Sequence
  Description of Artificial Sequence: Synthetic peptide
HGATGGA

SEQ ID NO: 9116 - protein, 7 aa, Artificial Sequence
  Description of Artificial Sequence: Synthetic peptide
ETPGAGR

SEQ ID NO: 9117 - protein, 7 aa, Artificial Sequence
  Description of Artificial Sequence: Synthetic peptide
GSHDMKK

SEQ ID NO: 9118 - protein, 7 aa, Artificial Sequence
  Description of Artificial Sequence: Synthetic peptide
VISSDPK

SEQ ID NO: 9119 - protein, 7 aa, Artificial Sequence
  Description of Artificial Sequence: Synthetic peptide
SPGVTPG

SEQ ID NO: 9120 - protein, 7 aa, Artificial Sequence
  Description of Artificial Sequence: Synthetic peptide
HGSSPTT

SEQ ID NO: 9121 - protein, 7 aa, Artificial Sequence
  Description of Artificial Sequence: Synthetic peptide
DKNTKSS

SEQ ID NO: 9122 - protein, 7 aa, Artificial Sequence
  Description of Artificial Sequence: Synthetic peptide
NGSKTSL

SEQ ID NO: 9123 - protein, 7 aa, Artificial Sequence
  Description of Artificial Sequence: Synthetic peptide
TGAPSNS

SEQ ID NO: 9124 - protein, 7 aa, Artificial Sequence
  Description of Artificial Sequence: Synthetic peptide
APSSGLG

SEQ ID NO: 9125 - protein, 7 aa, Artificial Sequence
  Description of Artificial Sequence: Synthetic peptide
GQTSTPY

SEQ ID NO: 9126 - protein, 7 aa, Artificial Sequence
  Description of Artificial Sequence: Synthetic peptide
HSSTVSQ

SEQ ID NO: 9127 - protein, 7 aa, Artificial Sequence
  Description of Artificial Sequence: Synthetic peptide
HQGNGSH

SEQ ID NO: 9128 - protein, 7 aa, Artificial Sequence
  Description of Artificial Sequence: Synthetic peptide
LGLGKTE

SEQ ID NO: 9129 - protein, 7 aa, Artificial Sequence
  Description of Artificial Sequence: Synthetic peptide
SGLATPT

SEQ ID NO: 9130 - protein, 7 aa, Artificial Sequence
  Description of Artificial Sequence: Synthetic peptide
TPDSTPQ

SEQ ID NO: 9131 - protein, 7 aa, Artificial Sequence
  Description of Artificial Sequence: Synthetic peptide
TLSQNPT

SEQ ID NO: 9132 - protein, 7 aa, Artificial Sequence
  Description of Artificial Sequence: Synthetic peptide
GKGQTPS

SEQ ID NO: 9133 - protein, 7 aa, Artificial Sequence
  Description of Artificial Sequence: Synthetic peptide
GSVQANK

SEQ ID NO: 9134 - protein, 7 aa, Artificial Sequence
  Description of Artificial Sequence: Synthetic peptide
GNSDHKN

SEQ ID NO: 9135 - protein, 7 aa, Artificial Sequence
  Description of Artificial Sequence: Synthetic peptide
TPQSTHA

SEQ ID NO: 9136 - protein, 7 aa, Artificial Sequence
  Description of Artificial Sequence: Synthetic peptide
HSGKGSS

SEQ ID NO: 9137 - protein, 7 aa, Artificial Sequence
  Description of Artificial Sequence: Synthetic peptide
LSQKSAN

SEQ ID NO: 9138 - protein, 7 aa, Artificial Sequence
  Description of Artificial Sequence: Synthetic peptide
AAGGTSR

SEQ ID NO: 9139 - protein, 7 aa, Artificial Sequence
  Description of Artificial Sequence: Synthetic peptide
SRGATTS

SEQ ID NO: 9140 - protein, 7 aa, Artificial Sequence
  Description of Artificial Sequence: Synthetic peptide
GSNAQTV

SEQ ID NO: 9141 - protein, 7 aa, Artificial Sequence
  Description of Artificial Sequence: Synthetic peptide
QNSTTSA

SEQ ID NO: 9142 - protein, 7 aa, Artificial Sequence
  Description of Artificial Sequence: Synthetic peptide
LGSGNSH

SEQ ID NO: 9143 - protein, 7 aa, Artificial Sequence
  Description of Artificial Sequence: Synthetic peptide
DGGNAGR

SEQ ID NO: 9144 - protein, 7 aa, Artificial Sequence
  Description of Artificial Sequence: Synthetic peptide
DNDKTNS

SEQ ID NO: 9145 - protein, 7 aa, Artificial Sequence
  Description of Artificial Sequence: Synthetic peptide
NSATSVS

SEQ ID NO: 9146 - protein, 7 aa, Artificial Sequence
  Description of Artificial Sequence: Synthetic peptide
TDSQQGR

SEQ ID NO: 9147 - protein, 7 aa, Artificial Sequence
  Description of Artificial Sequence: Synthetic peptide
NMGASSS

SEQ ID NO: 9148 - protein, 7 aa, Artificial Sequence
  Description of Artificial Sequence: Synthetic peptide
MNTPKDG

SEQ ID NO: 9149 - protein, 7 aa, Artificial Sequence
  Description of Artificial Sequence: Synthetic peptide
QLSNSSA

SEQ ID NO: 9150 - protein, 7 aa, Artificial Sequence
  Description of Artificial Sequence: Synthetic peptide
VTSNSSS

SEQ ID NO: 9151 - protein, 7 aa, Artificial Sequence
  Description of Artificial Sequence: Synthetic peptide
SQTTPSL

SEQ ID NO: 9152 - protein, 7 aa, Artificial Sequence
  Description of Artificial Sequence: Synthetic peptide
TGNAPSH

SEQ ID NO: 9153 - protein, 7 aa, Artificial Sequence
  Description of Artificial Sequence: Synthetic peptide
TTADRKG

SEQ ID NO: 9154 - protein, 7 aa, Artificial Sequence
  Description of Artificial Sequence: Synthetic peptide
TGGSGSH

SEQ ID NO: 9155 - protein, 7 aa, Artificial Sequence
  Description of Artificial Sequence: Synthetic peptide
LKSAQDA

SEQ ID NO: 9156 - protein, 7 aa, Artificial Sequence
  Description of Artificial Sequence: Synthetic peptide
LVGTSSA

SEQ ID NO: 9157 - protein, 7 aa, Artificial Sequence
  Description of Artificial Sequence: Synthetic peptide
DDLSKPR

SEQ ID NO: 9158 - protein, 7 aa, Artificial Sequence
  Description of Artificial Sequence: Synthetic peptide
ASDQASK

SEQ ID NO: 9159 - protein, 7 aa, Artificial Sequence
  Description of Artificial Sequence: Synthetic peptide
AHSSNSV

SEQ ID NO: 9160 - protein, 7 aa, Artificial Sequence
  Description of Artificial Sequence: Synthetic peptide
YNASGIQ

SEQ ID NO: 9161 - protein, 7 aa, Artificial Sequence
  Description of Artificial Sequence: Synthetic peptide
DNGKSTV

SEQ ID NO: 9162 - protein, 7 aa, Artificial Sequence
  Description of Artificial Sequence: Synthetic peptide
STQSNPP

SEQ ID NO: 9163 - protein, 7 aa, Artificial Sequence
  Description of Artificial Sequence: Synthetic peptide
SLGTPTR

SEQ ID NO: 9164 - protein, 7 aa, Artificial Sequence
  Description of Artificial Sequence: Synthetic peptide
RNGSPSV

SEQ ID NO: 9165 - protein, 7 aa, Artificial Sequence
  Description of Artificial Sequence: Synthetic peptide
GSDGSRG

SEQ ID NO: 9166 - protein, 7 aa, Artificial Sequence
  Description of Artificial Sequence: Synthetic peptide
LGKGENN

SEQ ID NO: 9167 - protein, 7 aa, Artificial Sequence
  Description of Artificial Sequence: Synthetic peptide
DVNSSKV

SEQ ID NO: 9168 - protein, 7 aa, Artificial Sequence
  Description of Artificial Sequence: Synthetic peptide
ASTHTNN

SEQ ID NO: 9169 - protein, 7 aa, Artificial Sequence
  Description of Artificial Sequence: Synthetic peptide
ESGSTAT

SEQ ID NO: 9170 - protein, 7 aa, Artificial Sequence
  Description of Artificial Sequence: Synthetic peptide
SPSNNAV

SEQ ID NO: 9171 - protein, 7 aa, Artificial Sequence
  Description of Artificial Sequence: Synthetic peptide
NSSDAKA

SEQ ID NO: 9172 - protein, 7 aa, Artificial Sequence
  Description of Artificial Sequence: Synthetic peptide
SHTSSPA

SEQ ID NO: 9173 - protein, 7 aa, Artificial Sequence
  Description of Artificial Sequence: Synthetic peptide
ETSKTRA

SEQ ID NO: 9174 - protein, 7 aa, Artificial Sequence
  Description of Artificial Sequence: Synthetic peptide
VAGATTS

SEQ ID NO: 9175 - protein, 7 aa, Artificial Sequence
  Description of Artificial Sequence: Synthetic peptide
SHQGNNT

SEQ ID NO: 9176 - protein, 7 aa, Artificial Sequence
  Description of Artificial Sequence: Synthetic peptide
TATSSTE

SEQ ID NO: 9177 - protein, 7 aa, Artificial Sequence
  Description of Artificial Sequence: Synthetic peptide
HTQNTNS

SEQ ID NO: 9178 - protein, 7 aa, Artificial Sequence
  Description of Artificial Sequence: Synthetic peptide
SAERSPN

SEQ ID NO: 9179 - protein, 7 aa, Artificial Sequence
  Description of Artificial Sequence: Synthetic peptide
SNSSGLT

SEQ ID NO: 9180 - protein, 7 aa, Artificial Sequence
  Description of Artificial Sequence: Synthetic peptide
MNQKESS

SEQ ID NO: 9181 - protein, 7 aa, Artificial Sequence
  Description of Artificial Sequence: Synthetic peptide
SNGTPMV

SEQ ID NO: 9182 - protein, 7 aa, Artificial Sequence
  Description of Artificial Sequence: Synthetic peptide
QQHKASV

SEQ ID NO: 9183 - protein, 7 aa, Artificial Sequence
  Description of Artificial Sequence: Synthetic peptide
SRNSKDL

SEQ ID NO: 9184 - protein, 7 aa, Artificial Sequence
  Description of Artificial Sequence: Synthetic peptide
ASQTVNT

SEQ ID NO: 9185 - protein, 7 aa, Artificial Sequence
  Description of Artificial Sequence: Synthetic peptide
LPREGSG

SEQ ID NO: 9186 - protein, 7 aa, Artificial Sequence
  Description of Artificial Sequence: Synthetic peptide
AASASPS

SEQ ID NO: 9187 - protein, 7 aa, Artificial Sequence
  Description of Artificial Sequence: Synthetic peptide
GIGSSSG

SEQ ID NO: 9188 - protein, 7 aa, Artificial Sequence
  Description of Artificial Sequence: Synthetic peptide
GQKGAQL

SEQ ID NO: 9189 - protein, 7 aa, Artificial Sequence
  Description of Artificial Sequence: Synthetic peptide
VATTKAS

SEQ ID NO: 9190 - protein, 7 aa, Artificial Sequence
  Description of Artificial Sequence: Synthetic peptide
HQSTPSS

SEQ ID NO: 9191 - protein, 7 aa, Artificial Sequence
  Description of Artificial Sequence: Synthetic peptide
SSSSQPV

SEQ ID NO: 9192 - protein, 7 aa, Artificial Sequence
  Description of Artificial Sequence: Synthetic peptide
MPSGQNL

SEQ ID NO: 9193 - protein, 7 aa, Artificial Sequence
  Description of Artificial Sequence: Synthetic peptide
DPTRIGA

SEQ ID NO: 9194 - protein, 7 aa, Artificial Sequence
  Description of Artificial Sequence: Synthetic peptide
GSGGTNQ

SEQ ID NO: 9195 - protein, 7 aa, Artificial Sequence
  Description of Artificial Sequence: Synthetic peptide
GQAGSNP

SEQ ID NO: 9196 - protein, 7 aa, Artificial Sequence
  Description of Artificial Sequence: Synthetic peptide
VGSTSVL

SEQ ID NO: 9197 - protein, 7 aa, Artificial Sequence
  Description of Artificial Sequence: Synthetic peptide
SAGSKTG

SEQ ID NO: 9198 - protein, 7 aa, Artificial Sequence
  Description of Artificial Sequence: Synthetic peptide
SASTNHA

SEQ ID NO: 9199 - protein, 7 aa, Artificial Sequence
  Description of Artificial Sequence: Synthetic peptide
SSTQAKG

SEQ ID NO: 9200 - protein, 7 aa, Artificial Sequence
  Description of Artificial Sequence: Synthetic peptide
TTKSAST

SEQ ID NO: 9201 - protein, 7 aa, Artificial Sequence
  Description of Artificial Sequence: Synthetic peptide
HPPSNGT

SEQ ID NO: 9202 - protein, 7 aa, Artificial Sequence
  Description of Artificial Sequence: Synthetic peptide
EGYDKTN

SEQ ID NO: 9203 - protein, 7 aa, Artificial Sequence
  Description of Artificial Sequence: Synthetic peptide
GAGGQNQ

SEQ ID NO: 9204 - protein, 7 aa, Artificial Sequence
  Description of Artificial Sequence: Synthetic peptide
GLGGNAP

SEQ ID NO: 9205 - protein, 7 aa, Artificial Sequence
  Description of Artificial Sequence: Synthetic peptide
SPATHSS

SEQ ID NO: 9206 - protein, 7 aa, Artificial Sequence
  Description of Artificial Sequence: Synthetic peptide
DSSAGSK

SEQ ID NO: 9207 - protein, 7 aa, Artificial Sequence
  Description of Artificial Sequence: Synthetic peptide
GGSSSTL

SEQ ID NO: 9208 - protein, 7 aa, Artificial Sequence
  Description of Artificial Sequence: Synthetic peptide
SPVDSKM

SEQ ID NO: 9209 - protein, 7 aa, Artificial Sequence
  Description of Artificial Sequence: Synthetic peptide
ASTSHTS

SEQ ID NO: 9210 - protein, 7 aa, Artificial Sequence
  Description of Artificial Sequence: Synthetic peptide
GSTVNMG

SEQ ID NO: 9211 - protein, 7 aa, Artificial Sequence
  Description of Artificial Sequence: Synthetic peptide
NPSDALK

SEQ ID NO: 9212 - protein, 7 aa, Artificial Sequence
  Description of Artificial Sequence: Synthetic peptide
NSSQQAR

SEQ ID NO: 9213 - protein, 7 aa, Artificial Sequence
  Description of Artificial Sequence: Synthetic peptide
TSAKAAQ

SEQ ID NO: 9214 - protein, 7 aa, Artificial Sequence
  Description of Artificial Sequence: Synthetic peptide
SAASAPL

SEQ ID NO: 9215 - protein, 7 aa, Artificial Sequence
  Description of Artificial Sequence: Synthetic peptide
SNEKTMN

SEQ ID NO: 9216 - protein, 7 aa, Artificial Sequence
  Description of Artificial Sequence: Synthetic peptide
MRGNEGS

SEQ ID NO: 9217 - protein, 7 aa, Artificial Sequence
  Description of Artificial Sequence: Synthetic peptide
MVNDKPS

SEQ ID NO: 9218 - protein, 7 aa, Artificial Sequence
  Description of Artificial Sequence: Synthetic peptide
QQPEMKR

SEQ ID NO: 9219 - protein, 7 aa, Artificial Sequence
  Description of Artificial Sequence: Synthetic peptide
ETSGSPH

SEQ ID NO: 9220 - protein, 7 aa, Artificial Sequence
  Description of Artificial Sequence: Synthetic peptide
GTATGRG

SEQ ID NO: 9221 - protein, 7 aa, Artificial Sequence
  Description of Artificial Sequence: Synthetic peptide
SAGTKSS

SEQ ID NO: 9222 - protein, 7 aa, Artificial Sequence
  Description of Artificial Sequence: Synthetic peptide
QTDSSPR

SEQ ID NO: 9223 - protein, 7 aa, Artificial Sequence
  Description of Artificial Sequence: Synthetic peptide
NVGTSSA

SEQ ID NO: 9224 - protein, 7 aa, Artificial Sequence
  Description of Artificial Sequence: Synthetic peptide
KVTSSPE

SEQ ID NO: 9225 - protein, 7 aa, Artificial Sequence
  Description of Artificial Sequence: Synthetic peptide
ESKQQPS

SEQ ID NO: 9226 - protein, 7 aa, Artificial Sequence
  Description of Artificial Sequence: Synthetic peptide
QGSQTRE

SEQ ID NO: 9227 - protein, 7 aa, Artificial Sequence
  Description of Artificial Sequence: Synthetic peptide
ESTSDHR

SEQ ID NO: 9228 - protein, 7 aa, Artificial Sequence
  Description of Artificial Sequence: Synthetic peptide
DAKSVPT

SEQ ID NO: 9229 - protein, 7 aa, Artificial Sequence
  Description of Artificial Sequence: Synthetic peptide
TSTNAVS

SEQ ID NO: 9230 - protein, 7 aa, Artificial Sequence
  Description of Artificial Sequence: Synthetic peptide
SSHGVSG

SEQ ID NO: 9231 - protein, 7 aa, Artificial Sequence
  Description of Artificial Sequence: Synthetic peptide
SSGGLDK

SEQ ID NO: 9232 - protein, 7 aa, Artificial Sequence
  Description of Artificial Sequence: Synthetic peptide
SVSKSSG

SEQ ID NO: 9233 - protein, 7 aa, Artificial Sequence
  Description of Artificial Sequence: Synthetic peptide
SQKGNGA

SEQ ID NO: 9234 - protein, 7 aa, Artificial Sequence
  Description of Artificial Sequence: Synthetic peptide
HREGSGH

SEQ ID NO: 9235 - protein, 7 aa, Artificial Sequence
  Description of Artificial Sequence: Synthetic peptide
LANSSQV

SEQ ID NO: 9236 - protein, 7 aa, Artificial Sequence
  Description of Artificial Sequence: Synthetic peptide
DGRTPPT

SEQ ID NO: 9237 - protein, 7 aa, Artificial Sequence
  Description of Artificial Sequence: Synthetic peptide
AGASAVA

SEQ ID NO: 9238 - protein, 7 aa, Artificial Sequence
  Description of Artificial Sequence: Synthetic peptide
KGAKDSG

SEQ ID NO: 9239 - protein, 7 aa, Artificial Sequence
  Description of Artificial Sequence: Synthetic peptide
SASSDNR

SEQ ID NO: 9240 - protein, 7 aa, Artificial Sequence
  Description of Artificial Sequence: Synthetic peptide
HGNEPIK

SEQ ID NO: 9241 - protein, 7 aa, Artificial Sequence
  Description of Artificial Sequence: Synthetic peptide
GTGRSPM

SEQ ID NO: 9242 - protein, 7 aa, Artificial Sequence
  Description of Artificial Sequence: Synthetic peptide
VSSKDSA

SEQ ID NO: 9243 - protein, 7 aa, Artificial Sequence
  Description of Artificial Sequence: Synthetic peptide
SGGPSTL

SEQ ID NO: 9244 - protein, 7 aa, Artificial Sequence
  Description of Artificial Sequence: Synthetic peptide
RNNAHSV

SEQ ID NO: 9245 - protein, 7 aa, Artificial Sequence
  Description of Artificial Sequence: Synthetic peptide
ADDKNRA

SEQ ID NO: 9246 - protein, 7 aa, Artificial Sequence
  Description of Artificial Sequence: Synthetic peptide
LTSSNGS

SEQ ID NO: 9247 - protein, 7 aa, Artificial Sequence
  Description of Artificial Sequence: Synthetic peptide
IQGAGMT

SEQ ID NO: 9248 - protein, 7 aa, Artificial Sequence
  Description of Artificial Sequence: Synthetic peptide
MEERKPN

SEQ ID NO: 9249 - protein, 7 aa, Artificial Sequence
  Description of Artificial Sequence: Synthetic peptide
ITGGNGG

SEQ ID NO: 9250 - protein, 7 aa, Artificial Sequence
  Description of Artificial Sequence: Synthetic peptide
LSANETK

SEQ ID NO: 9251 - protein, 7 aa, Artificial Sequence
  Description of Artificial Sequence: Synthetic peptide
LQGANAT

SEQ ID NO: 9252 - protein, 7 aa, Artificial Sequence
  Description of Artificial Sequence: Synthetic peptide
LGAGAST

SEQ ID NO: 9253 - protein, 7 aa, Artificial Sequence
  Description of Artificial Sequence: Synthetic peptide
GIGERPA

SEQ ID NO: 9254 - protein, 7 aa, Artificial Sequence
  Description of Artificial Sequence: Synthetic peptide
VSSNSSS

SEQ ID NO: 9255 - protein, 7 aa, Artificial Sequence
  Description of Artificial Sequence: Synthetic peptide
SATNAKI

SEQ ID NO: 9256 - protein, 7 aa, Artificial Sequence
  Description of Artificial Sequence: Synthetic peptide
SGRGTST

SEQ ID NO: 9257 - protein, 7 aa, Artificial Sequence
  Description of Artificial Sequence: Synthetic peptide
WGGNNST

SEQ ID NO: 9258 - protein, 7 aa, Artificial Sequence
  Description of Artificial Sequence: Synthetic peptide
QDTSNTR

SEQ ID NO: 9259 - protein, 7 aa, Artificial Sequence
  Description of Artificial Sequence: Synthetic peptide
GNDAPRV

SEQ ID NO: 9260 - protein, 7 aa, Artificial Sequence
  Description of Artificial Sequence: Synthetic peptide
AQSGNRV

SEQ ID NO: 9261 - protein, 7 aa, Artificial Sequence
  Description of Artificial Sequence: Synthetic peptide
TQTSGVP

SEQ ID NO: 9262 - protein, 7 aa, Artificial Sequence
  Description of Artificial Sequence: Synthetic peptide
SDGAGMK

SEQ ID NO: 9263 - protein, 7 aa, Artificial Sequence
  Description of Artificial Sequence: Synthetic peptide
SAAQAKV

SEQ ID NO: 9264 - protein, 7 aa, Artificial Sequence
  Description of Artificial Sequence: Synthetic peptide
DGTGKQG

SEQ ID NO: 9265 - protein, 7 aa, Artificial Sequence
  Description of Artificial Sequence: Synthetic peptide
VRGASSE

SEQ ID NO: 9266 - protein, 7 aa, Artificial Sequence
  Description of Artificial Sequence: Synthetic peptide
SGNKSSI

SEQ ID NO: 9267 - protein, 7 aa, Artificial Sequence
  Description of Artificial Sequence: Synthetic peptide
TSSPTSA

SEQ ID NO: 9268 - protein, 7 aa, Artificial Sequence
  Description of Artificial Sequence: Synthetic peptide
NQGDRSV

SEQ ID NO: 9269 - protein, 7 aa, Artificial Sequence
  Description of Artificial Sequence: Synthetic peptide
QGTPTQS

SEQ ID NO: 9270 - protein, 7 aa, Artificial Sequence
  Description of Artificial Sequence: Synthetic peptide
TRLSEQK

SEQ ID NO: 9271 - protein, 7 aa, Artificial Sequence
  Description of Artificial Sequence: Synthetic peptide
LSQNPGK

SEQ ID NO: 9272 - protein, 7 aa, Artificial Sequence
  Description of Artificial Sequence: Synthetic peptide
LSSAGSQ

SEQ ID NO: 9273 - protein, 7 aa, Artificial Sequence
  Description of Artificial Sequence: Synthetic peptide
EGSSNTQ

SEQ ID NO: 9274 - protein, 7 aa, Artificial Sequence
  Description of Artificial Sequence: Synthetic peptide
SPETRGS

SEQ ID NO: 9275 - protein, 7 aa, Artificial Sequence
  Description of Artificial Sequence: Synthetic peptide
HQSNKPL

SEQ ID NO: 9276 - protein, 7 aa, Artificial Sequence
  Description of Artificial Sequence: Synthetic peptide
LPADRSS

SEQ ID NO: 9277 - protein, 7 aa, Artificial Sequence
  Description of Artificial Sequence: Synthetic peptide
DNGQAPQ

SEQ ID NO: 9278 - protein, 7 aa, Artificial Sequence
  Description of Artificial Sequence: Synthetic peptide
ARNGAGA

SEQ ID NO: 9279 - protein, 7 aa, Artificial Sequence
  Description of Artificial Sequence: Synthetic peptide
SSSPSNH

SEQ ID NO: 9280 - protein, 7 aa, Artificial Sequence
  Description of Artificial Sequence: Synthetic peptide
TPSQGSL

SEQ ID NO: 9281 - protein, 7 aa, Artificial Sequence
  Description of Artificial Sequence: Synthetic peptide
AGGAGTS

SEQ ID NO: 9282 - protein, 7 aa, Artificial Sequence
  Description of Artificial Sequence: Synthetic peptide
GNGQDHA

SEQ ID NO: 9283 - protein, 7 aa, Artificial Sequence
  Description of Artificial Sequence: Synthetic peptide
SLGSTPI

SEQ ID NO: 9284 - protein, 7 aa, Artificial Sequence
  Description of Artificial Sequence: Synthetic peptide
TTGASTT

SEQ ID NO: 9285 - protein, 7 aa, Artificial Sequence
  Description of Artificial Sequence: Synthetic peptide
ATVGGAK

SEQ ID NO: 9286 - protein, 7 aa, Artificial Sequence
  Description of Artificial Sequence: Synthetic peptide
AGSPKDS

SEQ ID NO: 9287 - protein, 7 aa, Artificial Sequence
  Description of Artificial Sequence: Synthetic peptide
GSVSHST

SEQ ID NO: 9288 - protein, 7 aa, Artificial Sequence
  Description of Artificial Sequence: Synthetic peptide
MPKDSNQ

SEQ ID NO: 9289 - protein, 7 aa, Artificial Sequence
  Description of Artificial Sequence: Synthetic peptide
VKTNGTS

SEQ ID NO: 9290 - protein, 7 aa, Artificial Sequence
  Description of Artificial Sequence: Synthetic peptide
TSQPTSV

SEQ ID NO: 9291 - protein, 7 aa, Artificial Sequence
  Description of Artificial Sequence: Synthetic peptide
DSAKSSH

SEQ ID NO: 9292 - protein, 7 aa, Artificial Sequence
  Description of Artificial Sequence: Synthetic peptide
SQNTTGK

SEQ ID NO: 9293 - protein, 7 aa, Artificial Sequence
  Description of Artificial Sequence: Synthetic peptide
HPLENKG

SEQ ID NO: 9294 - protein, 7 aa, Artificial Sequence
  Description of Artificial Sequence: Synthetic peptide
KTAQSVV

SEQ ID NO: 9295 - protein, 7 aa, Artificial Sequence
  Description of Artificial Sequence: Synthetic peptide
TLDAKSN

SEQ ID NO: 9296 - protein, 7 aa, Artificial Sequence
  Description of Artificial Sequence: Synthetic peptide
TSSGNSH

SEQ ID NO: 9297 - protein, 7 aa, Artificial Sequence
  Description of Artificial Sequence: Synthetic peptide
REQTPTS

SEQ ID NO: 9298 - protein, 7 aa, Artificial Sequence
  Description of Artificial Sequence: Synthetic peptide
SETDRKR

SEQ ID NO: 9299 - protein, 7 aa, Artificial Sequence
  Description of Artificial Sequence: Synthetic peptide
HGPEKQI

SEQ ID NO: 9300 - protein, 7 aa, Artificial Sequence
  Description of Artificial Sequence: Synthetic peptide
LSETSSK

SEQ ID NO: 9301 - protein, 7 aa, Artificial Sequence
  Description of Artificial Sequence: Synthetic peptide
DNAKPNI

SEQ ID NO: 9302 - protein, 7 aa, Artificial Sequence
  Description of Artificial Sequence: Synthetic peptide
DSMRANV

SEQ ID NO: 9303 - protein, 7 aa, Artificial Sequence
  Description of Artificial Sequence: Synthetic peptide
GTSVSAH

SEQ ID NO: 9304 - protein, 7 aa, Artificial Sequence
  Description of Artificial Sequence: Synthetic peptide
GHNGKSS

SEQ ID NO: 9305 - protein, 7 aa, Artificial Sequence
  Description of Artificial Sequence: Synthetic peptide
GHQSSSG

SEQ ID NO: 9306 - protein, 7 aa, Artificial Sequence
  Description of Artificial Sequence: Synthetic peptide
VSSTSSK

SEQ ID NO: 9307 - protein, 7 aa, Artificial Sequence
  Description of Artificial Sequence: Synthetic peptide
VASEKPV

SEQ ID NO: 9308 - protein, 7 aa, Artificial Sequence
  Description of Artificial Sequence: Synthetic peptide
FTGSAPS

SEQ ID NO: 9309 - protein, 7 aa, Artificial Sequence
  Description of Artificial Sequence: Synthetic peptide
NVAKSPL

SEQ ID NO: 9310 - protein, 7 aa, Artificial Sequence
  Description of Artificial Sequence: Synthetic peptide
ETITKPV

SEQ ID NO: 9311 - protein, 7 aa, Artificial Sequence
  Description of Artificial Sequence: Synthetic peptide
GSTSPNL

SEQ ID NO: 9312 - protein, 7 aa, Artificial Sequence
  Description of Artificial Sequence: Synthetic peptide
SLNTKAL

SEQ ID NO: 9313 - protein, 7 aa, Artificial Sequence
  Description of Artificial Sequence: Synthetic peptide
TMAASPH

SEQ ID NO: 9314 - protein, 7 aa, Artificial Sequence
  Description of Artificial Sequence: Synthetic peptide
TGVGTMS

SEQ ID NO: 9315 - protein, 7 aa, Artificial Sequence
  Description of Artificial Sequence: Synthetic peptide
SLASQHS

SEQ ID NO: 9316 - protein, 7 aa, Artificial Sequence
  Description of Artificial Sequence: Synthetic peptide
HQDTSNR

SEQ ID NO: 9317 - protein, 7 aa, Artificial Sequence
  Description of Artificial Sequence: Synthetic peptide
LPPAESK

SEQ ID NO: 9318 - protein, 7 aa, Artificial Sequence
  Description of Artificial Sequence: Synthetic peptide
EVPSKSR

SEQ ID NO: 9319 - protein, 7 aa, Artificial Sequence
  Description of Artificial Sequence: Synthetic peptide
DGNSSKQ

SEQ ID NO: 9320 - protein, 7 aa, Artificial Sequence
  Description of Artificial Sequence: Synthetic peptide
TGKPPSS

SEQ ID NO: 9321 - protein, 7 aa, Artificial Sequence
  Description of Artificial Sequence: Synthetic peptide
SGSTSSS

SEQ ID NO: 9322 - protein, 7 aa, Artificial Sequence
  Description of Artificial Sequence: Synthetic peptide
ARTATSV

SEQ ID NO: 9323 - protein, 7 aa, Artificial Sequence
  Description of Artificial Sequence: Synthetic peptide
ATDREKG

SEQ ID NO: 9324 - protein, 7 aa, Artificial Sequence
  Description of Artificial Sequence: Synthetic peptide
GNSPTAS

SEQ ID NO: 9325 - protein, 7 aa, Artificial Sequence
  Description of Artificial Sequence: Synthetic peptide
GTRSGTA

SEQ ID NO: 9326 - protein, 7 aa, Artificial Sequence
  Description of Artificial Sequence: Synthetic peptide
VGSGSQT

SEQ ID NO: 9327 - protein, 7 aa, Artificial Sequence
  Description of Artificial Sequence: Synthetic peptide
VRDSGSS

SEQ ID NO: 9328 - protein, 7 aa, Artificial Sequence
  Description of Artificial Sequence: Synthetic peptide
TRGQPAG

SEQ ID NO: 9329 - protein, 7 aa, Artificial Sequence
  Description of Artificial Sequence: Synthetic peptide
QTVPAPS

SEQ ID NO: 9330 - protein, 7 aa, Artificial Sequence
  Description of Artificial Sequence: Synthetic peptide
NNNQQSS

SEQ ID NO: 9331 - protein, 7 aa, Artificial Sequence
  Description of Artificial Sequence: Synthetic peptide
SSADRST

SEQ ID NO: 9332 - protein, 7 aa, Artificial Sequence
  Description of Artificial Sequence: Synthetic peptide
GQSSKKE

SEQ ID NO: 9333 - protein, 7 aa, Artificial Sequence
  Description of Artificial Sequence: Synthetic peptide
GVSGPTS

SEQ ID NO: 9334 - protein, 7 aa, Artificial Sequence
  Description of Artificial Sequence: Synthetic peptide
NPASTAQ

SEQ ID NO: 9335 - protein, 7 aa, Artificial Sequence
  Description of Artificial Sequence: Synthetic peptide
QPRPSPT

SEQ ID NO: 9336 - protein, 7 aa, Artificial Sequence
  Description of Artificial Sequence: Synthetic peptide
QSSDKLR

SEQ ID NO: 9337 - protein, 7 aa, Artificial Sequence
  Description of Artificial Sequence: Synthetic peptide
LGQSSQG

SEQ ID NO: 9338 - protein, 7 aa, Artificial Sequence
  Description of Artificial Sequence: Synthetic peptide
LVDNPKG

SEQ ID NO: 9339 - protein, 7 aa, Artificial Sequence
  Description of Artificial Sequence: Synthetic peptide
NSNGNNS

SEQ ID NO: 9340 - protein, 7 aa, Artificial Sequence
  Description of Artificial Sequence: Synthetic peptide
SSRQPVV

SEQ ID NO: 9341 - protein, 7 aa, Artificial Sequence
  Description of Artificial Sequence: Synthetic peptide
STSANPA

SEQ ID NO: 9342 - protein, 7 aa, Artificial Sequence
  Description of Artificial Sequence: Synthetic peptide
LSQGGGA

SEQ ID NO: 9343 - protein, 7 aa, Artificial Sequence
  Description of Artificial Sequence: Synthetic peptide
DKTSSPL

SEQ ID NO: 9344 - protein, 7 aa, Artificial Sequence
  Description of Artificial Sequence: Synthetic peptide
SVQKVNL

SEQ ID NO: 9345 - protein, 7 aa, Artificial Sequence
  Description of Artificial Sequence: Synthetic peptide
HPAQASG

SEQ ID NO: 9346 - protein, 7 aa, Artificial Sequence
  Description of Artificial Sequence: Synthetic peptide
ASVSTTK

SEQ ID NO: 9347 - protein, 7 aa, Artificial Sequence
  Description of Artificial Sequence: Synthetic peptide
NSLKGSS

SEQ ID NO: 9348 - protein, 7 aa, Artificial Sequence
  Description of Artificial Sequence: Synthetic peptide
STSRENL

SEQ ID NO: 9349 - protein, 7 aa, Artificial Sequence
  Description of Artificial Sequence: Synthetic peptide
LSVGNNS

SEQ ID NO: 9350 - protein, 7 aa, Artificial Sequence
  Description of Artificial Sequence: Synthetic peptide
GINSSRT

SEQ ID NO: 9351 - protein, 7 aa, Artificial Sequence
  Description of Artificial Sequence: Synthetic peptide
EAKANAA

SEQ ID NO: 9352 - protein, 7 aa, Artificial Sequence
  Description of Artificial Sequence: Synthetic peptide
GTLPSQQ

SEQ ID NO: 9353 - protein, 7 aa, Artificial Sequence
  Description of Artificial Sequence: Synthetic peptide
NPLASKD

SEQ ID NO: 9354 - protein, 7 aa, Artificial Sequence
  Description of Artificial Sequence: Synthetic peptide
NASSQPA

SEQ ID NO: 9355 - protein, 7 aa, Artificial Sequence
  Description of Artificial Sequence: Synthetic peptide
GNEMSVK

SEQ ID NO: 9356 - protein, 7 aa, Artificial Sequence
  Description of Artificial Sequence: Synthetic peptide
TSATAHH

SEQ ID NO: 9357 - protein, 7 aa, Artificial Sequence
  Description of Artificial Sequence: Synthetic peptide
VQKSVST

SEQ ID NO: 9358 - protein, 7 aa, Artificial Sequence
  Description of Artificial Sequence: Synthetic peptide
SVSTTNA

SEQ ID NO: 9359 - protein, 7 aa, Artificial Sequence
  Description of Artificial Sequence: Synthetic peptide
LSGQSAN

SEQ ID NO: 9360 - protein, 7 aa, Artificial Sequence
  Description of Artificial Sequence: Synthetic peptide
NQSQTTI

SEQ ID NO: 9361 - protein, 7 aa, Artificial Sequence
  Description of Artificial Sequence: Synthetic peptide
NATKGSV

SEQ ID NO: 9362 - protein, 7 aa, Artificial Sequence
  Description of Artificial Sequence: Synthetic peptide
TSSDARV

SEQ ID NO: 9363 - protein, 7 aa, Artificial Sequence
  Description of Artificial Sequence: Synthetic peptide
TQKDSKV

SEQ ID NO: 9364 - protein, 7 aa, Artificial Sequence
  Description of Artificial Sequence: Synthetic peptide
REAESSR

SEQ ID NO: 9365 - protein, 7 aa, Artificial Sequence
  Description of Artificial Sequence: Synthetic peptide
STTKGEM

SEQ ID NO: 9366 - protein, 7 aa, Artificial Sequence
  Description of Artificial Sequence: Synthetic peptide
SDGNANR

SEQ ID NO: 9367 - protein, 7 aa, Artificial Sequence
  Description of Artificial Sequence: Synthetic peptide
SGTESGS

SEQ ID NO: 9368 - protein, 7 aa, Artificial Sequence
  Description of Artificial Sequence: Synthetic peptide
MPTTDMK

SEQ ID NO: 9369 - protein, 7 aa, Artificial Sequence
  Description of Artificial Sequence: Synthetic peptide
HGEKLGQ

SEQ ID NO: 9370 - protein, 7 aa, Artificial Sequence
  Description of Artificial Sequence: Synthetic peptide
HGRGSEG

SEQ ID NO: 9371 - protein, 7 aa, Artificial Sequence
  Description of Artificial Sequence: Synthetic peptide
HGVSTGS

SEQ ID NO: 9372 - protein, 7 aa, Artificial Sequence
  Description of Artificial Sequence: Synthetic peptide
ESDSRNR

SEQ ID NO: 9373 - protein, 7 aa, Artificial Sequence
  Description of Artificial Sequence: Synthetic peptide
EQTQPVR

SEQ ID NO: 9374 - protein, 7 aa, Artificial Sequence
  Description of Artificial Sequence: Synthetic peptide
ASSGTMS

SEQ ID NO: 9375 - protein, 7 aa, Artificial Sequence
  Description of Artificial Sequence: Synthetic peptide
APNSKVV

SEQ ID NO: 9376 - protein, 7 aa, Artificial Sequence
  Description of Artificial Sequence: Synthetic peptide
GSNGKVF

SEQ ID NO: 9377 - protein, 7 aa, Artificial Sequence
  Description of Artificial Sequence: Synthetic peptide
GSTNTKV

SEQ ID NO: 9378 - protein, 7 aa, Artificial Sequence
  Description of Artificial Sequence: Synthetic peptide
GPNKPSF

SEQ ID NO: 9379 - protein, 7 aa, Artificial Sequence
  Description of Artificial Sequence: Synthetic peptide
GNGEHST

SEQ ID NO: 9380 - protein, 7 aa, Artificial Sequence
  Description of Artificial Sequence: Synthetic peptide
GTRPADT

SEQ ID NO: 9381 - protein, 7 aa, Artificial Sequence
  Description of Artificial Sequence: Synthetic peptide
STDSNFR

SEQ ID NO: 9382 - protein, 7 aa, Artificial Sequence
  Description of Artificial Sequence: Synthetic peptide
SISGKNQ

SEQ ID NO: 9383 - protein, 7 aa, Artificial Sequence
  Description of Artificial Sequence: Synthetic peptide
VQTTKSN

SEQ ID NO: 9384 - protein, 7 aa, Artificial Sequence
  Description of Artificial Sequence: Synthetic peptide
GASKHTA

SEQ ID NO: 9385 - protein, 7 aa, Artificial Sequence
  Description of Artificial Sequence: Synthetic peptide
HTKTTPE

SEQ ID NO: 9386 - protein, 7 aa, Artificial Sequence
  Description of Artificial Sequence: Synthetic peptide
QQASKAT

SEQ ID NO: 9387 - protein, 7 aa, Artificial Sequence
  Description of Artificial Sequence: Synthetic peptide
TSNGIAK

SEQ ID NO: 9388 - protein, 7 aa, Artificial Sequence
  Description of Artificial Sequence: Synthetic peptide
TNSSKMT

SEQ ID NO: 9389 - protein, 7 aa, Artificial Sequence
  Description of Artificial Sequence: Synthetic peptide
SNGSSAS

SEQ ID NO: 9390 - protein, 7 aa, Artificial Sequence
  Description of Artificial Sequence: Synthetic peptide
GGQSVPQ

SEQ ID NO: 9391 - protein, 7 aa, Artificial Sequence
  Description of Artificial Sequence: Synthetic peptide
TDSTKHG

SEQ ID NO: 9392 - protein, 7 aa, Artificial Sequence
  Description of Artificial Sequence: Synthetic peptide
QGMGNVI

SEQ ID NO: 9393 - protein, 7 aa, Artificial Sequence
  Description of Artificial Sequence: Synthetic peptide
DKIKTQQ

SEQ ID NO: 9394 - protein, 7 aa, Artificial Sequence
  Description of Artificial Sequence: Synthetic peptide
ESESSKG

SEQ ID NO: 9395 - protein, 7 aa, Artificial Sequence
  Description of Artificial Sequence: Synthetic peptide
VVSGGNS

SEQ ID NO: 9396 - protein, 7 aa, Artificial Sequence
  Description of Artificial Sequence: Synthetic peptide
AEGSRGG

SEQ ID NO: 9397 - protein, 7 aa, Artificial Sequence
  Description of Artificial Sequence: Synthetic peptide
GMERSLG

SEQ ID NO: 9398 - protein, 7 aa, Artificial Sequence
  Description of Artificial Sequence: Synthetic peptide
GQQREPM

SEQ ID NO: 9399 - protein, 7 aa, Artificial Sequence
  Description of Artificial Sequence: Synthetic peptide
MQSNDTK

SEQ ID NO: 9400 - protein, 7 aa, Artificial Sequence
  Description of Artificial Sequence: Synthetic peptide
QGTAQIA

SEQ ID NO: 9401 - protein, 7 aa, Artificial Sequence
  Description of Artificial Sequence: Synthetic peptide
SPTGDSK

SEQ ID NO: 9402 - protein, 7 aa, Artificial Sequence
  Description of Artificial Sequence: Synthetic peptide
STSGSTK

SEQ ID NO: 9403 - protein, 7 aa, Artificial Sequence
  Description of Artificial Sequence: Synthetic peptide
HNVEKAG

SEQ ID NO: 9404 - protein, 7 aa, Artificial Sequence
  Description of Artificial Sequence: Synthetic peptide
ENSNPRS

SEQ ID NO: 9405 - protein, 7 aa, Artificial Sequence
  Description of Artificial Sequence: Synthetic peptide
DSKAGTV

SEQ ID NO: 9406 - protein, 7 aa, Artificial Sequence
  Description of Artificial Sequence: Synthetic peptide
RHGSEQG

SEQ ID NO: 9407 - protein, 7 aa, Artificial Sequence
  Description of Artificial Sequence: Synthetic peptide
HASSSKG

SEQ ID NO: 9408 - protein, 7 aa, Artificial Sequence
  Description of Artificial Sequence: Synthetic peptide
ATGSTAI

SEQ ID NO: 9409 - protein, 7 aa, Artificial Sequence
  Description of Artificial Sequence: Synthetic peptide
TMASKPN

SEQ ID NO: 9410 - protein, 7 aa, Artificial Sequence
  Description of Artificial Sequence: Synthetic peptide
VKNGNVL

SEQ ID NO: 9411 - protein, 7 aa, Artificial Sequence
  Description of Artificial Sequence: Synthetic peptide
TTLQKPV

SEQ ID NO: 9412 - protein, 7 aa, Artificial Sequence
  Description of Artificial Sequence: Synthetic peptide
TVQNSKE

SEQ ID NO: 9413 - protein, 7 aa, Artificial Sequence
  Description of Artificial Sequence: Synthetic peptide
SQKPSGA

SEQ ID NO: 9414 - protein, 7 aa, Artificial Sequence
  Description of Artificial Sequence: Synthetic peptide
SAVQSSG

SEQ ID NO: 9415 - protein, 7 aa, Artificial Sequence
  Description of Artificial Sequence: Synthetic peptide
DRSERSI

SEQ ID NO: 9416 - protein, 7 aa, Artificial Sequence
  Description of Artificial Sequence: Synthetic peptide
AGVTPPS

SEQ ID NO: 9417 - protein, 7 aa, Artificial Sequence
  Description of Artificial Sequence: Synthetic peptide
ATRDKVV

SEQ ID NO: 9418 - protein, 7 aa, Artificial Sequence
  Description of Artificial Sequence: Synthetic peptide
SVHSGSA

SEQ ID NO: 9419 - protein, 7 aa, Artificial Sequence
  Description of Artificial Sequence: Synthetic peptide
TTASSPQ

SEQ ID NO: 9420 - protein, 7 aa, Artificial Sequence
  Description of Artificial Sequence: Synthetic peptide
NANGSSA

SEQ ID NO: 9421 - protein, 7 aa, Artificial Sequence
  Description of Artificial Sequence: Synthetic peptide
SGSTPRE

SEQ ID NO: 9422 - protein, 7 aa, Artificial Sequence
  Description of Artificial Sequence: Synthetic peptide
QNKSGSM

SEQ ID NO: 9423 - protein, 7 aa, Artificial Sequence
  Description of Artificial Sequence: Synthetic peptide
SALGKES

SEQ ID NO: 9424 - protein, 7 aa, Artificial Sequence
  Description of Artificial Sequence: Synthetic peptide
QSGSKVT

SEQ ID NO: 9425 - protein, 7 aa, Artificial Sequence
  Description of Artificial Sequence: Synthetic peptide
MTSDKST

SEQ ID NO: 9426 - protein, 7 aa, Artificial Sequence
  Description of Artificial Sequence: Synthetic peptide
LSNGKST

SEQ ID NO: 9427 - protein, 7 aa, Artificial Sequence
  Description of Artificial Sequence: Synthetic peptide
DNSTGIR

SEQ ID NO: 9428 - protein, 7 aa, Artificial Sequence
  Description of Artificial Sequence: Synthetic peptide
DTLDRSR

SEQ ID NO: 9429 - protein, 7 aa, Artificial Sequence
  Description of Artificial Sequence: Synthetic peptide
ASNNSQS

SEQ ID NO: 9430 - protein, 7 aa, Artificial Sequence
  Description of Artificial Sequence: Synthetic peptide
ASPTKSI

SEQ ID NO: 9431 - protein, 7 aa, Artificial Sequence
  Description of Artificial Sequence: Synthetic peptide
GPTNVQA

SEQ ID NO: 9432 - protein, 7 aa, Artificial Sequence
  Description of Artificial Sequence: Synthetic peptide
VGVDKVA

SEQ ID NO: 9433 - protein, 7 aa, Artificial Sequence
  Description of Artificial Sequence: Synthetic peptide
SSGQSMG

SEQ ID NO: 9434 - protein, 7 aa, Artificial Sequence
  Description of Artificial Sequence: Synthetic peptide
SGTKVAL

SEQ ID NO: 9435 - protein, 7 aa, Artificial Sequence
  Description of Artificial Sequence: Synthetic peptide
AAVSSPS

SEQ ID NO: 9436 - protein, 7 aa, Artificial Sequence
  Description of Artificial Sequence: Synthetic peptide
HGANNVQ

SEQ ID NO: 9437 - protein, 7 aa, Artificial Sequence
  Description of Artificial Sequence: Synthetic peptide
NTSDTKN

SEQ ID NO: 9438 - protein, 7 aa, Artificial Sequence
  Description of Artificial Sequence: Synthetic peptide
NPTNDQK

SEQ ID NO: 9439 - protein, 7 aa, Artificial Sequence
  Description of Artificial Sequence: Synthetic peptide
STQNHGN

SEQ ID NO: 9440 - protein, 7 aa, Artificial Sequence
  Description of Artificial Sequence: Synthetic peptide
QGNNTLM

SEQ ID NO: 9441 - protein, 7 aa, Artificial Sequence
  Description of Artificial Sequence: Synthetic peptide
LAIPDKG

SEQ ID NO: 9442 - protein, 7 aa, Artificial Sequence
  Description of Artificial Sequence: Synthetic peptide
ALSGGNS

SEQ ID NO: 9443 - protein, 7 aa, Artificial Sequence
  Description of Artificial Sequence: Synthetic peptide
VAATPPQ

SEQ ID NO: 9444 - protein, 7 aa, Artificial Sequence
  Description of Artificial Sequence: Synthetic peptide
KAGSSVG

SEQ ID NO: 9445 - protein, 7 aa, Artificial Sequence
  Description of Artificial Sequence: Synthetic peptide
IGAGNPS

SEQ ID NO: 9446 - protein, 7 aa, Artificial Sequence
  Description of Artificial Sequence: Synthetic peptide
HKDRENK

SEQ ID NO: 9447 - protein, 7 aa, Artificial Sequence
  Description of Artificial Sequence: Synthetic peptide
QNSNQLK

SEQ ID NO: 9448 - protein, 7 aa, Artificial Sequence
  Description of Artificial Sequence: Synthetic peptide
GTTNTSS

SEQ ID NO: 9449 - protein, 7 aa, Artificial Sequence
  Description of Artificial Sequence: Synthetic peptide
SPDHAKS

SEQ ID NO: 9450 - protein, 7 aa, Artificial Sequence
  Description of Artificial Sequence: Synthetic peptide
LPVNSTK

SEQ ID NO: 9451 - protein, 7 aa, Artificial Sequence
  Description of Artificial Sequence: Synthetic peptide
SGTKVSE

SEQ ID NO: 9452 - protein, 7 aa, Artificial Sequence
  Description of Artificial Sequence: Synthetic peptide
PLSGKGP

SEQ ID NO: 9453 - protein, 7 aa, Artificial Sequence
  Description of Artificial Sequence: Synthetic peptide
ANSHQNT

SEQ ID NO: 9454 - protein, 7 aa, Artificial Sequence
  Description of Artificial Sequence: Synthetic peptide
GVDSSRG

SEQ ID NO: 9455 - protein, 7 aa, Artificial Sequence
  Description of Artificial Sequence: Synthetic peptide
GSNHSSS

SEQ ID NO: 9456 - protein, 7 aa, Artificial Sequence
  Description of Artificial Sequence: Synthetic peptide
TDGSKGS

SEQ ID NO: 9457 - protein, 7 aa, Artificial Sequence
  Description of Artificial Sequence: Synthetic peptide
NGGTPMR

SEQ ID NO: 9458 - protein, 7 aa, Artificial Sequence
  Description of Artificial Sequence: Synthetic peptide
SATTVNS

SEQ ID NO: 9459 - protein, 7 aa, Artificial Sequence
  Description of Artificial Sequence: Synthetic peptide
NTSSPVV

SEQ ID NO: 9460 - protein, 7 aa, Artificial Sequence
  Description of Artificial Sequence: Synthetic peptide
DSSHHGR

SEQ ID NO: 9461 - protein, 7 aa, Artificial Sequence
  Description of Artificial Sequence: Synthetic peptide
DLLPPGK

SEQ ID NO: 9462 - protein, 7 aa, Artificial Sequence
  Description of Artificial Sequence: Synthetic peptide
SSGIGGA

SEQ ID NO: 9463 - protein, 7 aa, Artificial Sequence
  Description of Artificial Sequence: Synthetic peptide
TGKTSPT

SEQ ID NO: 9464 - protein, 7 aa, Artificial Sequence
  Description of Artificial Sequence: Synthetic peptide
TTVNSPS

SEQ ID NO: 9465 - protein, 7 aa, Artificial Sequence
  Description of Artificial Sequence: Synthetic peptide
KTGTGSS

SEQ ID NO: 9466 - protein, 7 aa, Artificial Sequence
  Description of Artificial Sequence: Synthetic peptide
TKGQTPG

SEQ ID NO: 9467 - protein, 7 aa, Artificial Sequence
  Description of Artificial Sequence: Synthetic peptide
TGGHKGS

SEQ ID NO: 9468 - protein, 7 aa, Artificial Sequence
  Description of Artificial Sequence: Synthetic peptide
THNGTAA

SEQ ID NO: 9469 - protein, 7 aa, Artificial Sequence
  Description of Artificial Sequence: Synthetic peptide
SNSSPTV

SEQ ID NO: 9470 - protein, 7 aa, Artificial Sequence
  Description of Artificial Sequence: Synthetic peptide
SSAQKDQ

SEQ ID NO: 9471 - protein, 7 aa, Artificial Sequence
  Description of Artificial Sequence: Synthetic peptide
SSGQPVS

SEQ ID NO: 9472 - protein, 7 aa, Artificial Sequence
  Description of Artificial Sequence: Synthetic peptide
MNDVKSN

SEQ ID NO: 9473 - protein, 7 aa, Artificial Sequence
  Description of Artificial Sequence: Synthetic peptide
LRAGQGM

SEQ ID NO: 9474 - protein, 7 aa, Artificial Sequence
  Description of Artificial Sequence: Synthetic peptide
LSGATSV

SEQ ID NO: 9475 - protein, 7 aa, Artificial Sequence
  Description of Artificial Sequence: Synthetic peptide
DTKQPQL

SEQ ID NO: 9476 - protein, 7 aa, Artificial Sequence
  Description of Artificial Sequence: Synthetic peptide
AKTVSSG

SEQ ID NO: 9477 - protein, 7 aa, Artificial Sequence
  Description of Artificial Sequence: Synthetic peptide
GPTPANS

SEQ ID NO: 9478 - protein, 7 aa, Artificial Sequence
  Description of Artificial Sequence: Synthetic peptide
GPESRNS

SEQ ID NO: 9479 - protein, 7 aa, Artificial Sequence
  Description of Artificial Sequence: Synthetic peptide
GDGHNAG

SEQ ID NO: 9480 - protein, 7 aa, Artificial Sequence
  Description of Artificial Sequence: Synthetic peptide
VTNGTTR

SEQ ID NO: 9481 - protein, 7 aa, Artificial Sequence
  Description of Artificial Sequence: Synthetic peptide
VAESKVN

SEQ ID NO: 9482 - protein, 7 aa, Artificial Sequence
  Description of Artificial Sequence: Synthetic peptide
VGESNHS

SEQ ID NO: 9483 - protein, 7 aa, Artificial Sequence
  Description of Artificial Sequence: Synthetic peptide
SEPSQKT

SEQ ID NO: 9484 - protein, 7 aa, Artificial Sequence
  Description of Artificial Sequence: Synthetic peptide
SGGQATM

SEQ ID NO: 9485 - protein, 7 aa, Artificial Sequence
  Description of Artificial Sequence: Synthetic peptide
TTSTRAE

SEQ ID NO: 9486 - protein, 7 aa, Artificial Sequence
  Description of Artificial Sequence: Synthetic peptide
SQSTSTL

SEQ ID NO: 9487 - protein, 7 aa, Artificial Sequence
  Description of Artificial Sequence: Synthetic peptide
SVLPNKA

SEQ ID NO: 9488 - protein, 7 aa, Artificial Sequence
  Description of Artificial Sequence: Synthetic peptide
SGSTSLA

SEQ ID NO: 9489 - protein, 7 aa, Artificial Sequence
  Description of Artificial Sequence: Synthetic peptide
DPLSTNR

SEQ ID NO: 9490 - protein, 7 aa, Artificial Sequence
  Description of Artificial Sequence: Synthetic peptide
DASERTH

SEQ ID NO: 9491 - protein, 7 aa, Artificial Sequence
  Description of Artificial Sequence: Synthetic peptide
TTQGNGH

SEQ ID NO: 9492 - protein, 7 aa, Artificial Sequence
  Description of Artificial Sequence: Synthetic peptide
ALAKSGS

SEQ ID NO: 9493 - protein, 7 aa, Artificial Sequence
  Description of Artificial Sequence: Synthetic peptide
DVGSSSN

SEQ ID NO: 9494 - protein, 7 aa, Artificial Sequence
  Description of Artificial Sequence: Synthetic peptide
GTTTQVK

SEQ ID NO: 9495 - protein, 7 aa, Artificial Sequence
  Description of Artificial Sequence: Synthetic peptide
KNTGAPS

SEQ ID NO: 9496 - protein, 7 aa, Artificial Sequence
  Description of Artificial Sequence: Synthetic peptide
EHADKLK

SEQ ID NO: 9497 - protein, 7 aa, Artificial Sequence
  Description of Artificial Sequence: Synthetic peptide
GSKGNST

SEQ ID NO: 9498 - protein, 7 aa, Artificial Sequence
  Description of Artificial Sequence: Synthetic peptide
LASKSST

SEQ ID NO: 9499 - protein, 7 aa, Artificial Sequence
  Description of Artificial Sequence: Synthetic peptide
EQSSLKN

SEQ ID NO: 9500 - protein, 7 aa, Artificial Sequence
  Description of Artificial Sequence: Synthetic peptide
VSTSRPS

SEQ ID NO: 9501 - protein, 7 aa, Artificial Sequence
  Description of Artificial Sequence: Synthetic peptide
LKDTSSI

SEQ ID NO: 9502 - protein, 7 aa, Artificial Sequence
  Description of Artificial Sequence: Synthetic peptide
TGAGSVA

SEQ ID NO: 9503 - protein, 7 aa, Artificial Sequence
  Description of Artificial Sequence: Synthetic peptide
QQIGSKE

SEQ ID NO: 9504 - protein, 7 aa, Artificial Sequence
  Description of Artificial Sequence: Synthetic peptide
ALSSKNV

SEQ ID NO: 9505 - protein, 7 aa, Artificial Sequence
  Description of Artificial Sequence: Synthetic peptide
AGDNSQK

SEQ ID NO: 9506 - protein, 7 aa, Artificial Sequence
  Description of Artificial Sequence: Synthetic peptide
GGETPLK

SEQ ID NO: 9507 - protein, 7 aa, Artificial Sequence
  Description of Artificial Sequence: Synthetic peptide
KASGNAV

SEQ ID NO: 9508 - protein, 7 aa, Artificial Sequence
  Description of Artificial Sequence: Synthetic peptide
TTASDHR

SEQ ID NO: 9509 - protein, 7 aa, Artificial Sequence
  Description of Artificial Sequence: Synthetic peptide
VGTSATT

SEQ ID NO: 9510 - protein, 7 aa, Artificial Sequence
  Description of Artificial Sequence: Synthetic peptide
NPGGSNK

SEQ ID NO: 9511 - protein, 7 aa, Artificial Sequence
  Description of Artificial Sequence: Synthetic peptide
TSAPTNK

SEQ ID NO: 9512 - protein, 7 aa, Artificial Sequence
  Description of Artificial Sequence: Synthetic peptide
SKSTGAI

SEQ ID NO: 9513 - protein, 7 aa, Artificial Sequence
  Description of Artificial Sequence: Synthetic peptide
SQQPSQG

SEQ ID NO: 9514 - protein, 7 aa, Artificial Sequence
  Description of Artificial Sequence: Synthetic peptide
MHESKSL

SEQ ID NO: 9515 - protein, 7 aa, Artificial Sequence
  Description of Artificial Sequence: Synthetic peptide
QNSTGTQ

SEQ ID NO: 9516 - protein, 7 aa, Artificial Sequence
  Description of Artificial Sequence: Synthetic peptide
QAHDSKS

SEQ ID NO: 9517 - protein, 7 aa, Artificial Sequence
  Description of Artificial Sequence: Synthetic peptide
EGRDSNG

SEQ ID NO: 9518 - protein, 7 aa, Artificial Sequence
  Description of Artificial Sequence: Synthetic peptide
DRANSTS

SEQ ID NO: 9519 - protein, 7 aa, Artificial Sequence
  Description of Artificial Sequence: Synthetic peptide
DGSTGPR

SEQ ID NO: 9520 - protein, 7 aa, Artificial Sequence
  Description of Artificial Sequence: Synthetic peptide
GSTQSTS

SEQ ID NO: 9521 - protein, 7 aa, Artificial Sequence
  Description of Artificial Sequence: Synthetic peptide
GSTTSVH

SEQ ID NO: 9522 - protein, 7 aa, Artificial Sequence
  Description of Artificial Sequence: Synthetic peptide
VNGSQML

SEQ ID NO: 9523 - protein, 7 aa, Artificial Sequence
  Description of Artificial Sequence: Synthetic peptide
NPAQTLS

SEQ ID NO: 9524 - protein, 7 aa, Artificial Sequence
  Description of Artificial Sequence: Synthetic peptide
SGATPIM

SEQ ID NO: 9525 - protein, 7 aa, Artificial Sequence
  Description of Artificial Sequence: Synthetic peptide
DNTGSRS

SEQ ID NO: 9526 - protein, 7 aa, Artificial Sequence
  Description of Artificial Sequence: Synthetic peptide
GGAASTL

SEQ ID NO: 9527 - protein, 7 aa, Artificial Sequence
  Description of Artificial Sequence: Synthetic peptide
TTTRSNS

SEQ ID NO: 9528 - protein, 7 aa, Artificial Sequence
  Description of Artificial Sequence: Synthetic peptide
NAHDTKG

SEQ ID NO: 9529 - protein, 7 aa, Artificial Sequence
  Description of Artificial Sequence: Synthetic peptide
TSQSKII

SEQ ID NO: 9530 - protein, 7 aa, Artificial Sequence
  Description of Artificial Sequence: Synthetic peptide
RGNGASG

SEQ ID NO: 9531 - protein, 7 aa, Artificial Sequence
  Description of Artificial Sequence: Synthetic peptide
HHSQDSK

SEQ ID NO: 9532 - protein, 7 aa, Artificial Sequence
  Description of Artificial Sequence: Synthetic peptide
ASATGNA

SEQ ID NO: 9533 - protein, 7 aa, Artificial Sequence
  Description of Artificial Sequence: Synthetic peptide
SEAKTVH

SEQ ID NO: 9534 - protein, 7 aa, Artificial Sequence
  Description of Artificial Sequence: Synthetic peptide
SNKSSAV

SEQ ID NO: 9535 - protein, 7 aa, Artificial Sequence
  Description of Artificial Sequence: Synthetic peptide
DSTPGRS

SEQ ID NO: 9536 - protein, 7 aa, Artificial Sequence
  Description of Artificial Sequence: Synthetic peptide
IAKPDST

SEQ ID NO: 9537 - protein, 7 aa, Artificial Sequence
  Description of Artificial Sequence: Synthetic peptide
NAEVRSS

SEQ ID NO: 9538 - protein, 7 aa, Artificial Sequence
  Description of Artificial Sequence: Synthetic peptide
ERPNNAG

SEQ ID NO: 9539 - protein, 7 aa, Artificial Sequence
  Description of Artificial Sequence: Synthetic peptide
SSGTSSS

SEQ ID NO: 9540 - protein, 7 aa, Artificial Sequence
  Description of Artificial Sequence: Synthetic peptide
SEGQIRS

SEQ ID NO: 9541 - protein, 7 aa, Artificial Sequence
  Description of Artificial Sequence: Synthetic peptide
TSHTPHT

SEQ ID NO: 9542 - protein, 7 aa, Artificial Sequence
  Description of Artificial Sequence: Synthetic peptide
SNGGSGS

SEQ ID NO: 9543 - protein, 7 aa, Artificial Sequence
  Description of Artificial Sequence: Synthetic peptide
IKTTSNA

SEQ ID NO: 9544 - protein, 7 aa, Artificial Sequence
  Description of Artificial Sequence: Synthetic peptide
GNMVKPS

SEQ ID NO: 9545 - protein, 7 aa, Artificial Sequence
  Description of Artificial Sequence: Synthetic peptide
GREPVQG

SEQ ID NO: 9546 - protein, 7 aa, Artificial Sequence
  Description of Artificial Sequence: Synthetic peptide
QVSSEAS

SEQ ID NO: 9547 - protein, 7 aa, Artificial Sequence
  Description of Artificial Sequence: Synthetic peptide
DSGNTPR

SEQ ID NO: 9548 - protein, 7 aa, Artificial Sequence
  Description of Artificial Sequence: Synthetic peptide
GTNTSMA

SEQ ID NO: 9549 - protein, 7 aa, Artificial Sequence
  Description of Artificial Sequence: Synthetic peptide
GDSKPNL

SEQ ID NO: 9550 - protein, 7 aa, Artificial Sequence
  Description of Artificial Sequence: Synthetic peptide
VTSTTSS

SEQ ID NO: 9551 - protein, 7 aa, Artificial Sequence
  Description of Artificial Sequence: Synthetic peptide
YADARAS

SEQ ID NO: 9552 - protein, 7 aa, Artificial Sequence
  Description of Artificial Sequence: Synthetic peptide
LPMGGQN

SEQ ID NO: 9553 - protein, 7 aa, Artificial Sequence
  Description of Artificial Sequence: Synthetic peptide
TMSGKGE

SEQ ID NO: 9554 - protein, 7 aa, Artificial Sequence
  Description of Artificial Sequence: Synthetic peptide
ATTPSTG

SEQ ID NO: 9555 - protein, 7 aa, Artificial Sequence
  Description of Artificial Sequence: Synthetic peptide
VQESQSR

SEQ ID NO: 9556 - protein, 7 aa, Artificial Sequence
  Description of Artificial Sequence: Synthetic peptide
LSGASAP

SEQ ID NO: 9557 - protein, 7 aa, Artificial Sequence
  Description of Artificial Sequence: Synthetic peptide
LETNKPP

SEQ ID NO: 9558 - protein, 7 aa, Artificial Sequence
  Description of Artificial Sequence: Synthetic peptide
MKSDSQL

SEQ ID NO: 9559 - protein, 7 aa, Artificial Sequence
  Description of Artificial Sequence: Synthetic peptide
GVNGTQK

SEQ ID NO: 9560 - protein, 7 aa, Artificial Sequence
  Description of Artificial Sequence: Synthetic peptide
GSAKQNV

SEQ ID NO: 9561 - protein, 7 aa, Artificial Sequence
  Description of Artificial Sequence: Synthetic peptide
KTVSTSS

SEQ ID NO: 9562 - protein, 7 aa, Artificial Sequence
  Description of Artificial Sequence: Synthetic peptide
QTGASNI

SEQ ID NO: 9563 - protein, 7 aa, Artificial Sequence
  Description of Artificial Sequence: Synthetic peptide
DNSHKIS

SEQ ID NO: 9564 - protein, 7 aa, Artificial Sequence
  Description of Artificial Sequence: Synthetic peptide
GSNDGVK

SEQ ID NO: 9565 - protein, 7 aa, Artificial Sequence
  Description of Artificial Sequence: Synthetic peptide
SAGAQST

SEQ ID NO: 9566 - protein, 7 aa, Artificial Sequence
  Description of Artificial Sequence: Synthetic peptide
ANTSTSS

SEQ ID NO: 9567 - protein, 7 aa, Artificial Sequence
  Description of Artificial Sequence: Synthetic peptide
HNGKNMG

SEQ ID NO: 9568 - protein, 7 aa, Artificial Sequence
  Description of Artificial Sequence: Synthetic peptide
SHSSPAN

SEQ ID NO: 9569 - protein, 7 aa, Artificial Sequence
  Description of Artificial Sequence: Synthetic peptide
SGERVGQ

SEQ ID NO: 9570 - protein, 7 aa, Artificial Sequence
  Description of Artificial Sequence: Synthetic peptide
LNTGQSH

SEQ ID NO: 9571 - protein, 7 aa, Artificial Sequence
  Description of Artificial Sequence: Synthetic peptide
ANKSNAT

SEQ ID NO: 9572 - protein, 7 aa, Artificial Sequence
  Description of Artificial Sequence: Synthetic peptide
AVSASPV

SEQ ID NO: 9573 - protein, 7 aa, Artificial Sequence
  Description of Artificial Sequence: Synthetic peptide
AKNSATS

SEQ ID NO: 9574 - protein, 7 aa, Artificial Sequence
  Description of Artificial Sequence: Synthetic peptide
SHKSENV

SEQ ID NO: 9575 - protein, 7 aa, Artificial Sequence
  Description of Artificial Sequence: Synthetic peptide
NGTQSMS

SEQ ID NO: 9576 - protein, 7 aa, Artificial Sequence
  Description of Artificial Sequence: Synthetic peptide
KRESQSA

SEQ ID NO: 9577 - protein, 7 aa, Artificial Sequence
  Description of Artificial Sequence: Synthetic peptide
TGSKTDS

SEQ ID NO: 9578 - protein, 7 aa, Artificial Sequence
  Description of Artificial Sequence: Synthetic peptide
ISGKESS

SEQ ID NO: 9579 - protein, 7 aa, Artificial Sequence
  Description of Artificial Sequence: Synthetic peptide
DKGSGKS

SEQ ID NO: 9580 - protein, 7 aa, Artificial Sequence
  Description of Artificial Sequence: Synthetic peptide
EKSSTPG

SEQ ID NO: 9581 - protein, 7 aa, Artificial Sequence
  Description of Artificial Sequence: Synthetic peptide
DMGSTQK

SEQ ID NO: 9582 - protein, 7 aa, Artificial Sequence
  Description of Artificial Sequence: Synthetic peptide
AHNTPSS

SEQ ID NO: 9583 - protein, 7 aa, Artificial Sequence
  Description of Artificial Sequence: Synthetic peptide
SNDSRLQ

SEQ ID NO: 9584 - protein, 7 aa, Artificial Sequence
  Description of Artificial Sequence: Synthetic peptide
TAEKSIK

SEQ ID NO: 9585 - protein, 7 aa, Artificial Sequence
  Description of Artificial Sequence: Synthetic peptide
EGTTNSK

SEQ ID NO: 9586 - protein, 7 aa, Artificial Sequence
  Description of Artificial Sequence: Synthetic peptide
DTVGTTK

SEQ ID NO: 9587 - protein, 7 aa, Artificial Sequence
  Description of Artificial Sequence: Synthetic peptide
QDVKMAP

SEQ ID NO: 9588 - protein, 7 aa, Artificial Sequence
  Description of Artificial Sequence: Synthetic peptide
KTDSGGQ

SEQ ID NO: 9589 - protein, 7 aa, Artificial Sequence
  Description of Artificial Sequence: Synthetic peptide
TEGKSMG

SEQ ID NO: 9590 - protein, 7 aa, Artificial Sequence
  Description of Artificial Sequence: Synthetic peptide
SSASGQP

SEQ ID NO: 9591 - protein, 7 aa, Artificial Sequence
  Description of Artificial Sequence: Synthetic peptide
SQKPSSG

SEQ ID NO: 9592 - protein, 7 aa, Artificial Sequence
  Description of Artificial Sequence: Synthetic peptide
GVTTNPG

SEQ ID NO: 9593 - protein, 7 aa, Artificial Sequence
  Description of Artificial Sequence: Synthetic peptide
SAARKDG

SEQ ID NO: 9594 - protein, 7 aa, Artificial Sequence
  Description of Artificial Sequence: Synthetic peptide
SESKQTV

SEQ ID NO: 9595 - protein, 7 aa, Artificial Sequence
  Description of Artificial Sequence: Synthetic peptide
SGGSQSS

SEQ ID NO: 9596 - protein, 7 aa, Artificial Sequence
  Description of Artificial Sequence: Synthetic peptide
MGNERVM

SEQ ID NO: 9597 - protein, 7 aa, Artificial Sequence
  Description of Artificial Sequence: Synthetic peptide
QSPAKSG

SEQ ID NO: 9598 - protein, 7 aa, Artificial Sequence
  Description of Artificial Sequence: Synthetic peptide
LVSDHSK

SEQ ID NO: 9599 - protein, 7 aa, Artificial Sequence
  Description of Artificial Sequence: Synthetic peptide
DITPGKS

SEQ ID NO: 9600 - protein, 7 aa, Artificial Sequence
  Description of Artificial Sequence: Synthetic peptide
EMSGKND

SEQ ID NO: 9601 - protein, 7 aa, Artificial Sequence
  Description of Artificial Sequence: Synthetic peptide
ANSDKMR

SEQ ID NO: 9602 - protein, 7 aa, Artificial Sequence
  Description of Artificial Sequence: Synthetic peptide
TNAPSPM

SEQ ID NO: 9603 - protein, 7 aa, Artificial Sequence
  Description of Artificial Sequence: Synthetic peptide
AAAHGNA

SEQ ID NO: 9604 - protein, 7 aa, Artificial Sequence
  Description of Artificial Sequence: Synthetic peptide
SSRTPST

SEQ ID NO: 9605 - protein, 7 aa, Artificial Sequence
  Description of Artificial Sequence: Synthetic peptide
KDAPPTQ

SEQ ID NO: 9606 - protein, 7 aa, Artificial Sequence
  Description of Artificial Sequence: Synthetic peptide
NVSPNGA

SEQ ID NO: 9607 - protein, 7 aa, Artificial Sequence
  Description of Artificial Sequence: Synthetic peptide
TTSGSYS

SEQ ID NO: 9608 - protein, 7 aa, Artificial Sequence
  Description of Artificial Sequence: Synthetic peptide
RREGESK

SEQ ID NO: 9609 - protein, 7 aa, Artificial Sequence
  Description of Artificial Sequence: Synthetic peptide
SNTREIT

SEQ ID NO: 9610 - protein, 7 aa, Artificial Sequence
  Description of Artificial Sequence: Synthetic peptide
SNSDRPM

SEQ ID NO: 9611 - protein, 7 aa, Artificial Sequence
  Description of Artificial Sequence: Synthetic peptide
STTHPSQ

SEQ ID NO: 9612 - protein, 7 aa, Artificial Sequence
  Description of Artificial Sequence: Synthetic peptide
SLGSGPH

SEQ ID NO: 9613 - protein, 7 aa, Artificial Sequence
  Description of Artificial Sequence: Synthetic peptide
ISSGTPS

SEQ ID NO: 9614 - protein, 7 aa, Artificial Sequence
  Description of Artificial Sequence: Synthetic peptide
DSSERVR

SEQ ID NO: 9615 - protein, 7 aa, Artificial Sequence
  Description of Artificial Sequence: Synthetic peptide
ESGSSRG

SEQ ID NO: 9616 - protein, 7 aa, Artificial Sequence
  Description of Artificial Sequence: Synthetic peptide
GSTNPGA

SEQ ID NO: 9617 - protein, 7 aa, Artificial Sequence
  Description of Artificial Sequence: Synthetic peptide
QGRPSSS

SEQ ID NO: 9618 - protein, 7 aa, Artificial Sequence
  Description of Artificial Sequence: Synthetic peptide
NGQTAHS

SEQ ID NO: 9619 - protein, 7 aa, Artificial Sequence
  Description of Artificial Sequence: Synthetic peptide
MPAKDRG

SEQ ID NO: 9620 - protein, 7 aa, Artificial Sequence
  Description of Artificial Sequence: Synthetic peptide
TEDRSLR

SEQ ID NO: 9621 - protein, 7 aa, Artificial Sequence
  Description of Artificial Sequence: Synthetic peptide
SGTSKSV

SEQ ID NO: 9622 - protein, 7 aa, Artificial Sequence
  Description of Artificial Sequence: Synthetic peptide
KGDRVQG

SEQ ID NO: 9623 - protein, 7 aa, Artificial Sequence
  Description of Artificial Sequence: Synthetic peptide
NTATSER

SEQ ID NO: 9624 - protein, 7 aa, Artificial Sequence
  Description of Artificial Sequence: Synthetic peptide
GSDIKKT

SEQ ID NO: 9625 - protein, 7 aa, Artificial Sequence
  Description of Artificial Sequence: Synthetic peptide
SNDKSSH

SEQ ID NO: 9626 - protein, 7 aa, Artificial Sequence
  Description of Artificial Sequence: Synthetic peptide
GQESTAR

SEQ ID NO: 9627 - protein, 7 aa, Artificial Sequence
  Description of Artificial Sequence: Synthetic peptide
GGRPENA

SEQ ID NO: 9628 - protein, 7 aa, Artificial Sequence
  Description of Artificial Sequence: Synthetic peptide
TPNSASN

SEQ ID NO: 9629 - protein, 7 aa, Artificial Sequence
  Description of Artificial Sequence: Synthetic peptide
SALSSPS

SEQ ID NO: 9630 - protein, 7 aa, Artificial Sequence
  Description of Artificial Sequence: Synthetic peptide
LASNGNV

SEQ ID NO: 9631 - protein, 7 aa, Artificial Sequence
  Description of Artificial Sequence: Synthetic peptide
ASQKPPV

SEQ ID NO: 9632 - protein, 7 aa, Artificial Sequence
  Description of Artificial Sequence: Synthetic peptide
TAGSKGN

SEQ ID NO: 9633 - protein, 7 aa, Artificial Sequence
  Description of Artificial Sequence: Synthetic peptide
SAQKSVG

SEQ ID NO: 9634 - protein, 7 aa, Artificial Sequence
  Description of Artificial Sequence: Synthetic peptide
RGAPNTT

SEQ ID NO: 9635 - protein, 7 aa, Artificial Sequence
  Description of Artificial Sequence: Synthetic peptide
EGAAPNT

SEQ ID NO: 9636 - protein, 7 aa, Artificial Sequence
  Description of Artificial Sequence: Synthetic peptide
EKSVKYD

SEQ ID NO: 9637 - protein, 7 aa, Artificial Sequence
  Description of Artificial Sequence: Synthetic peptide
ELNDKNK

SEQ ID NO: 9638 - protein, 7 aa, Artificial Sequence
  Description of Artificial Sequence: Synthetic peptide
GSKGELN

SEQ ID NO: 9639 - protein, 7 aa, Artificial Sequence
  Description of Artificial Sequence: Synthetic peptide
YTDKGSQ

SEQ ID NO: 9640 - protein, 7 aa, Artificial Sequence
  Description of Artificial Sequence: Synthetic peptide
EGRSSNQ

SEQ ID NO: 9641 - protein, 7 aa, Artificial Sequence
  Description of Artificial Sequence: Synthetic peptide
SSSPTMT

SEQ ID NO: 9642 - protein, 7 aa, Artificial Sequence
  Description of Artificial Sequence: Synthetic peptide
NMDTKPL

SEQ ID NO: 9643 - protein, 7 aa, Artificial Sequence
  Description of Artificial Sequence: Synthetic peptide
RATSERS

SEQ ID NO: 9644 - protein, 7 aa, Artificial Sequence
  Description of Artificial Sequence: Synthetic peptide
LTQQTST

SEQ ID NO: 9645 - protein, 7 aa, Artificial Sequence
  Description of Artificial Sequence: Synthetic peptide
DAQKTTF

SEQ ID NO: 9646 - protein, 7 aa, Artificial Sequence
  Description of Artificial Sequence: Synthetic peptide
AGSPSHN

SEQ ID NO: 9647 - protein, 7 aa, Artificial Sequence
  Description of Artificial Sequence: Synthetic peptide
LNSNKSQ

SEQ ID NO: 9648 - protein, 7 aa, Artificial Sequence
  Description of Artificial Sequence: Synthetic peptide
NVTGTTA

SEQ ID NO: 9649 - protein, 7 aa, Artificial Sequence
  Description of Artificial Sequence: Synthetic peptide
TQNGGPR

SEQ ID NO: 9650 - protein, 7 aa, Artificial Sequence
  Description of Artificial Sequence: Synthetic peptide
GLDASRH

SEQ ID NO: 9651 - protein, 7 aa, Artificial Sequence
  Description of Artificial Sequence: Synthetic peptide
MGGTSSK

SEQ ID NO: 9652 - protein, 7 aa, Artificial Sequence
  Description of Artificial Sequence: Synthetic peptide
ASNQSPS

SEQ ID NO: 9653 - protein, 7 aa, Artificial Sequence
  Description of Artificial Sequence: Synthetic peptide
SGVDSPR

SEQ ID NO: 9654 - protein, 7 aa, Artificial Sequence
  Description of Artificial Sequence: Synthetic peptide
AISGSPS

SEQ ID NO: 9655 - protein, 7 aa, Artificial Sequence
  Description of Artificial Sequence: Synthetic peptide
QHSNPPA

SEQ ID NO: 9656 - protein, 7 aa, Artificial Sequence
  Description of Artificial Sequence: Synthetic peptide
ASSPVNS

SEQ ID NO: 9657 - protein, 7 aa, Artificial Sequence
  Description of Artificial Sequence: Synthetic peptide
NNNPPSG

SEQ ID NO: 9658 - protein, 7 aa, Artificial Sequence
  Description of Artificial Sequence: Synthetic peptide
SQSSSKE

SEQ ID NO: 9659 - protein, 7 aa, Artificial Sequence
  Description of Artificial Sequence: Synthetic peptide
SDNKTER

SEQ ID NO: 9660 - protein, 7 aa, Artificial Sequence
  Description of Artificial Sequence: Synthetic peptide
HNNSSAV

SEQ ID NO: 9661 - protein, 7 aa, Artificial Sequence
  Description of Artificial Sequence: Synthetic peptide
LQKSSVE

SEQ ID NO: 9662 - protein, 7 aa, Artificial Sequence
  Description of Artificial Sequence: Synthetic peptide
NTAPPPS

SEQ ID NO: 9663 - protein, 7 aa, Artificial Sequence
  Description of Artificial Sequence: Synthetic peptide
LGTGSNN

SEQ ID NO: 9664 - protein, 7 aa, Artificial Sequence
  Description of Artificial Sequence: Synthetic peptide
NGKQTSN

SEQ ID NO: 9665 - protein, 7 aa, Artificial Sequence
  Description of Artificial Sequence: Synthetic peptide
NQSGATK

SEQ ID NO: 9666 - protein, 7 aa, Artificial Sequence
  Description of Artificial Sequence: Synthetic peptide
NGASKLH

SEQ ID NO: 9667 - protein, 7 aa, Artificial Sequence
  Description of Artificial Sequence: Synthetic peptide
TNNGVHA

SEQ ID NO: 9668 - protein, 7 aa, Artificial Sequence
  Description of Artificial Sequence: Synthetic peptide
TNNGSGN

SEQ ID NO: 9669 - protein, 7 aa, Artificial Sequence
  Description of Artificial Sequence: Synthetic peptide
TESGKAI

SEQ ID NO: 9670 - protein, 7 aa, Artificial Sequence
  Description of Artificial Sequence: Synthetic peptide
DSSTNAR

SEQ ID NO: 9671 - protein, 7 aa, Artificial Sequence
  Description of Artificial Sequence: Synthetic peptide
RAVGKTE

SEQ ID NO: 9672 - protein, 7 aa, Artificial Sequence
  Description of Artificial Sequence: Synthetic peptide
ATSSEKS

SEQ ID NO: 9673 - protein, 7 aa, Artificial Sequence
  Description of Artificial Sequence: Synthetic peptide
NTGGESG

SEQ ID NO: 9674 - protein, 7 aa, Artificial Sequence
  Description of Artificial Sequence: Synthetic peptide
SGKSNDV

SEQ ID NO: 9675 - protein, 7 aa, Artificial Sequence
  Description of Artificial Sequence: Synthetic peptide
LGTQHTS

SEQ ID NO: 9676 - protein, 7 aa, Artificial Sequence
  Description of Artificial Sequence: Synthetic peptide
DDSSAKS

SEQ ID NO: 9677 - protein, 7 aa, Artificial Sequence
  Description of Artificial Sequence: Synthetic peptide
GGPNTTH

SEQ ID NO: 9678 - protein, 7 aa, Artificial Sequence
  Description of Artificial Sequence: Synthetic peptide
SISTKES

SEQ ID NO: 9679 - protein, 7 aa, Artificial Sequence
  Description of Artificial Sequence: Synthetic peptide
TTSDARN

SEQ ID NO: 9680 - protein, 7 aa, Artificial Sequence
  Description of Artificial Sequence: Synthetic peptide
TDASARN

SEQ ID NO: 9681 - protein, 7 aa, Artificial Sequence
  Description of Artificial Sequence: Synthetic peptide
SSVPAKG

SEQ ID NO: 9682 - protein, 7 aa, Artificial Sequence
  Description of Artificial Sequence: Synthetic peptide
GHNGPNS

SEQ ID NO: 9683 - protein, 7 aa, Artificial Sequence
  Description of Artificial Sequence: Synthetic peptide
GSSGSSG

SEQ ID NO: 9684 - protein, 7 aa, Artificial Sequence
  Description of Artificial Sequence: Synthetic peptide
VVSDNSR

SEQ ID NO: 9685 - protein, 7 aa, Artificial Sequence
  Description of Artificial Sequence: Synthetic peptide
DRSPGSQ

SEQ ID NO: 9686 - protein, 7 aa, Artificial Sequence
  Description of Artificial Sequence: Synthetic peptide
GTTPPNA

SEQ ID NO: 9687 - protein, 7 aa, Artificial Sequence
  Description of Artificial Sequence: Synthetic peptide
LADKSSY

SEQ ID NO: 9688 - protein, 7 aa, Artificial Sequence
  Description of Artificial Sequence: Synthetic peptide
MSTTTNA

SEQ ID NO: 9689 - protein, 7 aa, Artificial Sequence
  Description of Artificial Sequence: Synthetic peptide
TTGVSPA

SEQ ID NO: 9690 - protein, 7 aa, Artificial Sequence
  Description of Artificial Sequence: Synthetic peptide
STDSSTK

SEQ ID NO: 9691 - protein, 7 aa, Artificial Sequence
  Description of Artificial Sequence: Synthetic peptide
DVQTPTT

SEQ ID NO: 9692 - protein, 7 aa, Artificial Sequence
  Description of Artificial Sequence: Synthetic peptide
ATSDRPV

SEQ ID NO: 9693 - protein, 7 aa, Artificial Sequence
  Description of Artificial Sequence: Synthetic peptide
SASHSAS

SEQ ID NO: 9694 - protein, 7 aa, Artificial Sequence
  Description of Artificial Sequence: Synthetic peptide
MSSNPKT

SEQ ID NO: 9695 - protein, 7 aa, Artificial Sequence
  Description of Artificial Sequence: Synthetic peptide
DQRNGPT

SEQ ID NO: 9696 - protein, 7 aa, Artificial Sequence
  Description of Artificial Sequence: Synthetic peptide
ESRNNGH

SEQ ID NO: 9697 - protein, 7 aa, Artificial Sequence
  Description of Artificial Sequence: Synthetic peptide
SSSKGHV

SEQ ID NO: 9698 - protein, 7 aa, Artificial Sequence
  Description of Artificial Sequence: Synthetic peptide
GGTQQNL

SEQ ID NO: 9699 - protein, 7 aa, Artificial Sequence
  Description of Artificial Sequence: Synthetic peptide
QQGTKST

SEQ ID NO: 9700 - protein, 7 aa, Artificial Sequence
  Description of Artificial Sequence: Synthetic peptide
NGGGKGG

SEQ ID NO: 9701 - protein, 7 aa, Artificial Sequence
  Description of Artificial Sequence: Synthetic peptide
NTSNKDT

SEQ ID NO: 9702 - protein, 7 aa, Artificial Sequence
  Description of Artificial Sequence: Synthetic peptide
NRSKQGD

SEQ ID NO: 9703 - protein, 7 aa, Artificial Sequence
  Description of Artificial Sequence: Synthetic peptide
NSLTANK

SEQ ID NO: 9704 - protein, 7 aa, Artificial Sequence
  Description of Artificial Sequence: Synthetic peptide
NLGTGGT

SEQ ID NO: 9705 - protein, 7 aa, Artificial Sequence
  Description of Artificial Sequence: Synthetic peptide
TQHGERS

SEQ ID NO: 9706 - protein, 7 aa, Artificial Sequence
  Description of Artificial Sequence: Synthetic peptide
SKSNGAS

SEQ ID NO: 9707 - protein, 7 aa, Artificial Sequence
  Description of Artificial Sequence: Synthetic peptide
SPTSSPG

SEQ ID NO: 9708 - protein, 7 aa, Artificial Sequence
  Description of Artificial Sequence: Synthetic peptide
SESSRSA

SEQ ID NO: 9709 - protein, 7 aa, Artificial Sequence
  Description of Artificial Sequence: Synthetic peptide
SAPSGKA

SEQ ID NO: 9710 - protein, 7 aa, Artificial Sequence
  Description of Artificial Sequence: Synthetic peptide
SGGSGPQ

SEQ ID NO: 9711 - protein, 7 aa, Artificial Sequence
  Description of Artificial Sequence: Synthetic peptide
SSNTSAT

SEQ ID NO: 9712 - protein, 7 aa, Artificial Sequence
  Description of Artificial Sequence: Synthetic peptide
MREDQVR

SEQ ID NO: 9713 - protein, 7 aa, Artificial Sequence
  Description of Artificial Sequence: Synthetic peptide
QSTPALS

SEQ ID NO: 9714 - protein, 7 aa, Artificial Sequence
  Description of Artificial Sequence: Synthetic peptide
LRETKIN

SEQ ID NO: 9715 - protein, 7 aa, Artificial Sequence
  Description of Artificial Sequence: Synthetic peptide
LSRDKIE

SEQ ID NO: 9716 - protein, 7 aa, Artificial Sequence
  Description of Artificial Sequence: Synthetic peptide
LRGGEGA

SEQ ID NO: 9717 - protein, 7 aa, Artificial Sequence
  Description of Artificial Sequence: Synthetic peptide
DNGNARS

SEQ ID NO: 9718 - protein, 7 aa, Artificial Sequence
  Description of Artificial Sequence: Synthetic peptide
ANTGHMA

SEQ ID NO: 9719 - protein, 7 aa, Artificial Sequence
  Description of Artificial Sequence: Synthetic peptide
AHTKENS

SEQ ID NO: 9720 - protein, 7 aa, Artificial Sequence
  Description of Artificial Sequence: Synthetic peptide
ADKGVGG

SEQ ID NO: 9721 - protein, 7 aa, Artificial Sequence
  Description of Artificial Sequence: Synthetic peptide
AGHGTSA

SEQ ID NO: 9722 - protein, 7 aa, Artificial Sequence
  Description of Artificial Sequence: Synthetic peptide
AVAQSNN

SEQ ID NO: 9723 - protein, 7 aa, Artificial Sequence
  Description of Artificial Sequence: Synthetic peptide
GSSGSST

SEQ ID NO: 9724 - protein, 7 aa, Artificial Sequence
  Description of Artificial Sequence: Synthetic peptide
GGIDGKN

SEQ ID NO: 9725 - protein, 7 aa, Artificial Sequence
  Description of Artificial Sequence: Synthetic peptide
GVPNRAG

SEQ ID NO: 9726 - protein, 7 aa, Artificial Sequence
  Description of Artificial Sequence: Synthetic peptide
GRSDSVH

SEQ ID NO: 9727 - protein, 7 aa, Artificial Sequence
  Description of Artificial Sequence: Synthetic peptide
VTQGTAS

SEQ ID NO: 9728 - protein, 7 aa, Artificial Sequence
  Description of Artificial Sequence: Synthetic peptide
YGQQPGG

SEQ ID NO: 9729 - protein, 7 aa, Artificial Sequence
  Description of Artificial Sequence: Synthetic peptide
SAKANSV

SEQ ID NO: 9730 - protein, 7 aa, Artificial Sequence
  Description of Artificial Sequence: Synthetic peptide
SATGTHS

SEQ ID NO: 9731 - protein, 7 aa, Artificial Sequence
  Description of Artificial Sequence: Synthetic peptide
LNSTKPA

SEQ ID NO: 9732 - protein, 7 aa, Artificial Sequence
  Description of Artificial Sequence: Synthetic peptide
ATTTSGG

SEQ ID NO: 9733 - protein, 7 aa, Artificial Sequence
  Description of Artificial Sequence: Synthetic peptide
DGLPNGR

SEQ ID NO: 9734 - protein, 7 aa, Artificial Sequence
  Description of Artificial Sequence: Synthetic peptide
RTNATTS

SEQ ID NO: 9735 - protein, 7 aa, Artificial Sequence
  Description of Artificial Sequence: Synthetic peptide
VPTGNHG

SEQ ID NO: 9736 - protein, 7 aa, Artificial Sequence
  Description of Artificial Sequence: Synthetic peptide
NGSAHKV

SEQ ID NO: 9737 - protein, 7 aa, Artificial Sequence
  Description of Artificial Sequence: Synthetic peptide
STSTTSR

SEQ ID NO: 9738 - protein, 7 aa, Artificial Sequence
  Description of Artificial Sequence: Synthetic peptide
HGMGTTT

SEQ ID NO: 9739 - protein, 7 aa, Artificial Sequence
  Description of Artificial Sequence: Synthetic peptide
HGGTASH

SEQ ID NO: 9740 - protein, 7 aa, Artificial Sequence
  Description of Artificial Sequence: Synthetic peptide
GSHGSTQ

SEQ ID NO: 9741 - protein, 7 aa, Artificial Sequence
  Description of Artificial Sequence: Synthetic peptide
HTSDKSA

SEQ ID NO: 9742 - protein, 7 aa, Artificial Sequence
  Description of Artificial Sequence: Synthetic peptide
AVHSNST

SEQ ID NO: 9743 - protein, 7 aa, Artificial Sequence
  Description of Artificial Sequence: Synthetic peptide
LATSSTV

SEQ ID NO: 9744 - protein, 7 aa, Artificial Sequence
  Description of Artificial Sequence: Synthetic peptide
NVDARNN

SEQ ID NO: 9745 - protein, 7 aa, Artificial Sequence
  Description of Artificial Sequence: Synthetic peptide
MKSQSAI

SEQ ID NO: 9746 - protein, 7 aa, Artificial Sequence
  Description of Artificial Sequence: Synthetic peptide
SPNQQSS

SEQ ID NO: 9747 - protein, 7 aa, Artificial Sequence
  Description of Artificial Sequence: Synthetic peptide
NNGTTSA

SEQ ID NO: 9748 - protein, 7 aa, Artificial Sequence
  Description of Artificial Sequence: Synthetic peptide
TSAQPNN

SEQ ID NO: 9749 - protein, 7 aa, Artificial Sequence
  Description of Artificial Sequence: Synthetic peptide
QTTKSSV

SEQ ID NO: 9750 - protein, 7 aa, Artificial Sequence
  Description of Artificial Sequence: Synthetic peptide
DSVNKRD

SEQ ID NO: 9751 - protein, 7 aa, Artificial Sequence
  Description of Artificial Sequence: Synthetic peptide
ATPGTSG

SEQ ID NO: 9752 - protein, 7 aa, Artificial Sequence
  Description of Artificial Sequence: Synthetic peptide
GVSSTAV

SEQ ID NO: 9753 - protein, 7 aa, Artificial Sequence
  Description of Artificial Sequence: Synthetic peptide
QRGGDSA

SEQ ID NO: 9754 - protein, 7 aa, Artificial Sequence
  Description of Artificial Sequence: Synthetic peptide
ATSNNSR

SEQ ID NO: 9755 - protein, 7 aa, Artificial Sequence
  Description of Artificial Sequence: Synthetic peptide
TKANSSE

SEQ ID NO: 9756 - protein, 7 aa, Artificial Sequence
  Description of Artificial Sequence: Synthetic peptide
SSGEQSR

SEQ ID NO: 9757 - protein, 7 aa, Artificial Sequence
  Description of Artificial Sequence: Synthetic peptide
SLNDSRR

SEQ ID NO: 9758 - protein, 7 aa, Artificial Sequence
  Description of Artificial Sequence: Synthetic peptide
HGSQAPA

SEQ ID NO: 9759 - protein, 7 aa, Artificial Sequence
  Description of Artificial Sequence: Synthetic peptide
YPDKSPI

SEQ ID NO: 9760 - protein, 7 aa, Artificial Sequence
  Description of Artificial Sequence: Synthetic peptide
NADRDNK

SEQ ID NO: 9761 - protein, 7 aa, Artificial Sequence
  Description of Artificial Sequence: Synthetic peptide
TKGGTTG

SEQ ID NO: 9762 - protein, 7 aa, Artificial Sequence
  Description of Artificial Sequence: Synthetic peptide
RQLPDKD

SEQ ID NO: 9763 - protein, 7 aa, Artificial Sequence
  Description of Artificial Sequence: Synthetic peptide
STSTGKS

SEQ ID NO: 9764 - protein, 7 aa, Artificial Sequence
  Description of Artificial Sequence: Synthetic peptide
NSGGNKN

SEQ ID NO: 9765 - protein, 7 aa, Artificial Sequence
  Description of Artificial Sequence: Synthetic peptide
SSRSSTV

SEQ ID NO: 9766 - protein, 7 aa, Artificial Sequence
  Description of Artificial Sequence: Synthetic peptide
SSPQGGN

SEQ ID NO: 9767 - protein, 7 aa, Artificial Sequence
  Description of Artificial Sequence: Synthetic peptide
SITGKGG

SEQ ID NO: 9768 - protein, 7 aa, Artificial Sequence
  Description of Artificial Sequence: Synthetic peptide
ISGAGSK

SEQ ID NO: 9769 - protein, 7 aa, Artificial Sequence
  Description of Artificial Sequence: Synthetic peptide
ASTDSRG

SEQ ID NO: 9770 - protein, 7 aa, Artificial Sequence
  Description of Artificial Sequence: Synthetic peptide
ALGTGKE

SEQ ID NO: 9771 - protein, 7 aa, Artificial Sequence
  Description of Artificial Sequence: Synthetic peptide
TGHPSTA

SEQ ID NO: 9772 - protein, 7 aa, Artificial Sequence
  Description of Artificial Sequence: Synthetic peptide
QSHSASS

SEQ ID NO: 9773 - protein, 7 aa, Artificial Sequence
  Description of Artificial Sequence: Synthetic peptide
DSQVKAM

SEQ ID NO: 9774 - protein, 7 aa, Artificial Sequence
  Description of Artificial Sequence: Synthetic peptide
SKDTQLI

SEQ ID NO: 9775 - protein, 7 aa, Artificial Sequence
  Description of Artificial Sequence: Synthetic peptide
TNDPRSS

SEQ ID NO: 9776 - protein, 7 aa, Artificial Sequence
  Description of Artificial Sequence: Synthetic peptide
SATKAGG

SEQ ID NO: 9777 - protein, 7 aa, Artificial Sequence
  Description of Artificial Sequence: Synthetic peptide
SGNKPEV

SEQ ID NO: 9778 - protein, 7 aa, Artificial Sequence
  Description of Artificial Sequence: Synthetic peptide
QANRNSG

SEQ ID NO: 9779 - protein, 7 aa, Artificial Sequence
  Description of Artificial Sequence: Synthetic peptide
DSAGSGK

SEQ ID NO: 9780 - protein, 7 aa, Artificial Sequence
  Description of Artificial Sequence: Synthetic peptide
GSNNNGQ

SEQ ID NO: 9781 - protein, 7 aa, Artificial Sequence
  Description of Artificial Sequence: Synthetic peptide
GRSGDTN

SEQ ID NO: 9782 - protein, 7 aa, Artificial Sequence
  Description of Artificial Sequence: Synthetic peptide
SKANSQM

SEQ ID NO: 9783 - protein, 7 aa, Artificial Sequence
  Description of Artificial Sequence: Synthetic peptide
SSGKSGM

SEQ ID NO: 9784 - protein, 7 aa, Artificial Sequence
  Description of Artificial Sequence: Synthetic peptide
SSATAQG

SEQ ID NO: 9785 - protein, 7 aa, Artificial Sequence
  Description of Artificial Sequence: Synthetic peptide
TRTNANG

SEQ ID NO: 9786 - protein, 7 aa, Artificial Sequence
  Description of Artificial Sequence: Synthetic peptide
LNSEKAP

SEQ ID NO: 9787 - protein, 7 aa, Artificial Sequence
  Description of Artificial Sequence: Synthetic peptide
EKMSSSS

SEQ ID NO: 9788 - protein, 7 aa, Artificial Sequence
  Description of Artificial Sequence: Synthetic peptide
ASISGAG

SEQ ID NO: 9789 - protein, 7 aa, Artificial Sequence
  Description of Artificial Sequence: Synthetic peptide
GTRSQSQ

SEQ ID NO: 9790 - protein, 7 aa, Artificial Sequence
  Description of Artificial Sequence: Synthetic peptide
VSGKTSA

SEQ ID NO: 9791 - protein, 7 aa, Artificial Sequence
  Description of Artificial Sequence: Synthetic peptide
TGVNNHH

SEQ ID NO: 9792 - protein, 7 aa, Artificial Sequence
  Description of Artificial Sequence: Synthetic peptide
SGDHHKT

SEQ ID NO: 9793 - protein, 7 aa, Artificial Sequence
  Description of Artificial Sequence: Synthetic peptide
LPSGVTK

SEQ ID NO: 9794 - protein, 7 aa, Artificial Sequence
  Description of Artificial Sequence: Synthetic peptide
LSGGTML

SEQ ID NO: 9795 - protein, 7 aa, Artificial Sequence
  Description of Artificial Sequence: Synthetic peptide
ASTGSTA

SEQ ID NO: 9796 - protein, 7 aa, Artificial Sequence
  Description of Artificial Sequence: Synthetic peptide
LQSSGNR

SEQ ID NO: 9797 - protein, 7 aa, Artificial Sequence
  Description of Artificial Sequence: Synthetic peptide
MSTSHSV

SEQ ID NO: 9798 - protein, 7 aa, Artificial Sequence
  Description of Artificial Sequence: Synthetic peptide
GAGNHAS

SEQ ID NO: 9799 - protein, 7 aa, Artificial Sequence
  Description of Artificial Sequence: Synthetic peptide
TKTETNA

SEQ ID NO: 9800 - protein, 7 aa, Artificial Sequence
  Description of Artificial Sequence: Synthetic peptide
DRGQGQM

SEQ ID NO: 9801 - protein, 7 aa, Artificial Sequence
  Description of Artificial Sequence: Synthetic peptide
GSSTNNV

SEQ ID NO: 9802 - protein, 7 aa, Artificial Sequence
  Description of Artificial Sequence: Synthetic peptide
FAGNTQA

SEQ ID NO: 9803 - protein, 7 aa, Artificial Sequence
  Description of Artificial Sequence: Synthetic peptide
SVSNSSQ

SEQ ID NO: 9804 - protein, 7 aa, Artificial Sequence
  Description of Artificial Sequence: Synthetic peptide
QSTKPSG

SEQ ID NO: 9805 - protein, 7 aa, Artificial Sequence
  Description of Artificial Sequence: Synthetic peptide
IPAKSTS

SEQ ID NO: 9806 - protein, 7 aa, Artificial Sequence
  Description of Artificial Sequence: Synthetic peptide
AGRDSLT

SEQ ID NO: 9807 - protein, 7 aa, Artificial Sequence
  Description of Artificial Sequence: Synthetic peptide
SNSKDTT

SEQ ID NO: 9808 - protein, 7 aa, Artificial Sequence
  Description of Artificial Sequence: Synthetic peptide
NTRNPAA

SEQ ID NO: 9809 - protein, 7 aa, Artificial Sequence
  Description of Artificial Sequence: Synthetic peptide
NYDAKSA

SEQ ID NO: 9810 - protein, 7 aa, Artificial Sequence
  Description of Artificial Sequence: Synthetic peptide
ESSGSRL

SEQ ID NO: 9811 - protein, 7 aa, Artificial Sequence
  Description of Artificial Sequence: Synthetic peptide
TNNTPSG

SEQ ID NO: 9812 - protein, 7 aa, Artificial Sequence
  Description of Artificial Sequence: Synthetic peptide
SPGSKVS

SEQ ID NO: 9813 - protein, 7 aa, Artificial Sequence
  Description of Artificial Sequence: Synthetic peptide
SGTTPSV

SEQ ID NO: 9814 - protein, 7 aa, Artificial Sequence
  Description of Artificial Sequence: Synthetic peptide
SGTVKLD

SEQ ID NO: 9815 - protein, 7 aa, Artificial Sequence
  Description of Artificial Sequence: Synthetic peptide
KEDRNTS

SEQ ID NO: 9816 - protein, 7 aa, Artificial Sequence
  Description of Artificial Sequence: Synthetic peptide
SGGGSLG

SEQ ID NO: 9817 - protein, 7 aa, Artificial Sequence
  Description of Artificial Sequence: Synthetic peptide
QAAAHTS

SEQ ID NO: 9818 - protein, 7 aa, Artificial Sequence
  Description of Artificial Sequence: Synthetic peptide
DGGAGVV

SEQ ID NO: 9819 - protein, 7 aa, Artificial Sequence
  Description of Artificial Sequence: Synthetic peptide
GSGKMNV

SEQ ID NO: 9820 - protein, 7 aa, Artificial Sequence
  Description of Artificial Sequence: Synthetic peptide
GLVNQQQ

SEQ ID NO: 9821 - protein, 7 aa, Artificial Sequence
  Description of Artificial Sequence: Synthetic peptide
VSGSTTT

SEQ ID NO: 9822 - protein, 7 aa, Artificial Sequence
  Description of Artificial Sequence: Synthetic peptide
SSFKGGG

SEQ ID NO: 9823 - protein, 7 aa, Artificial Sequence
  Description of Artificial Sequence: Synthetic peptide
SSAQSPS

SEQ ID NO: 9824 - protein, 7 aa, Artificial Sequence
  Description of Artificial Sequence: Synthetic peptide
VESKPSR

SEQ ID NO: 9825 - protein, 7 aa, Artificial Sequence
  Description of Artificial Sequence: Synthetic peptide
SASERNL

SEQ ID NO: 9826 - protein, 7 aa, Artificial Sequence
  Description of Artificial Sequence: Synthetic peptide
DSKEHSQ

SEQ ID NO: 9827 - protein, 7 aa, Artificial Sequence
  Description of Artificial Sequence: Synthetic peptide
ASDKVRN

SEQ ID NO: 9828 - protein, 7 aa, Artificial Sequence
  Description of Artificial Sequence: Synthetic peptide
GVDSNRN

SEQ ID NO: 9829 - protein, 7 aa, Artificial Sequence
  Description of Artificial Sequence: Synthetic peptide
LSGQRVE

SEQ ID NO: 9830 - protein, 7 aa, Artificial Sequence
  Description of Artificial Sequence: Synthetic peptide
YITKEAG

SEQ ID NO: 9831 - protein, 7 aa, Artificial Sequence
  Description of Artificial Sequence: Synthetic peptide
TSNTTHQ

SEQ ID NO: 9832 - protein, 7 aa, Artificial Sequence
  Description of Artificial Sequence: Synthetic peptide
RKEDVQR

SEQ ID NO: 9833 - protein, 7 aa, Artificial Sequence
  Description of Artificial Sequence: Synthetic peptide
MGTQGNG

SEQ ID NO: 9834 - protein, 7 aa, Artificial Sequence
  Description of Artificial Sequence: Synthetic peptide
LATDGPK

SEQ ID NO: 9835 - protein, 7 aa, Artificial Sequence
  Description of Artificial Sequence: Synthetic peptide
VGTPRSE

SEQ ID NO: 9836 - protein, 7 aa, Artificial Sequence
  Description of Artificial Sequence: Synthetic peptide
GPNHTTK

SEQ ID NO: 9837 - protein, 7 aa, Artificial Sequence
  Description of Artificial Sequence: Synthetic peptide
HVGTNNS

SEQ ID NO: 9838 - protein, 7 aa, Artificial Sequence
  Description of Artificial Sequence: Synthetic peptide
GTGPGGS

SEQ ID NO: 9839 - protein, 7 aa, Artificial Sequence
  Description of Artificial Sequence: Synthetic peptide
KNGENNR

SEQ ID NO: 9840 - protein, 7 aa, Artificial Sequence
  Description of Artificial Sequence: Synthetic peptide
SSEKTMS

SEQ ID NO: 9841 - protein, 7 aa, Artificial Sequence
  Description of Artificial Sequence: Synthetic peptide
GGSASAR

SEQ ID NO: 9842 - protein, 7 aa, Artificial Sequence
  Description of Artificial Sequence: Synthetic peptide
GSGARKD

SEQ ID NO: 9843 - protein, 7 aa, Artificial Sequence
  Description of Artificial Sequence: Synthetic peptide
GATGASS

SEQ ID NO: 9844 - protein, 7 aa, Artificial Sequence
  Description of Artificial Sequence: Synthetic peptide
GLGAQPT

SEQ ID NO: 9845 - protein, 7 aa, Artificial Sequence
  Description of Artificial Sequence: Synthetic peptide
VPTTTAK

SEQ ID NO: 9846 - protein, 7 aa, Artificial Sequence
  Description of Artificial Sequence: Synthetic peptide
RSDKRNE

SEQ ID NO: 9847 - protein, 7 aa, Artificial Sequence
  Description of Artificial Sequence: Synthetic peptide
QGVSGGS

SEQ ID NO: 9848 - protein, 7 aa, Artificial Sequence
  Description of Artificial Sequence: Synthetic peptide
LSSKDVA

SEQ ID NO: 9849 - protein, 7 aa, Artificial Sequence
  Description of Artificial Sequence: Synthetic peptide
DNLNKTN

SEQ ID NO: 9850 - protein, 7 aa, Artificial Sequence
  Description of Artificial Sequence: Synthetic peptide
GINTKSA

SEQ ID NO: 9851 - protein, 7 aa, Artificial Sequence
  Description of Artificial Sequence: Synthetic peptide
VATGAAK

SEQ ID NO: 9852 - protein, 7 aa, Artificial Sequence
  Description of Artificial Sequence: Synthetic peptide
NPNKPGT

SEQ ID NO: 9853 - protein, 7 aa, Artificial Sequence
  Description of Artificial Sequence: Synthetic peptide
VATQETK

SEQ ID NO: 9854 - protein, 7 aa, Artificial Sequence
  Description of Artificial Sequence: Synthetic peptide
DMSNKTV

SEQ ID NO: 9855 - protein, 7 aa, Artificial Sequence
  Description of Artificial Sequence: Synthetic peptide
AGGASNS

SEQ ID NO: 9856 - protein, 7 aa, Artificial Sequence
  Description of Artificial Sequence: Synthetic peptide
VTSTKPD

SEQ ID NO: 9857 - protein, 7 aa, Artificial Sequence
  Description of Artificial Sequence: Synthetic peptide
LSTKSVS

SEQ ID NO: 9858 - protein, 7 aa, Artificial Sequence
  Description of Artificial Sequence: Synthetic peptide
SAGGGSR

SEQ ID NO: 9859 - protein, 7 aa, Artificial Sequence
  Description of Artificial Sequence: Synthetic peptide
SGVTNSV

SEQ ID NO: 9860 - protein, 7 aa, Artificial Sequence
  Description of Artificial Sequence: Synthetic peptide
QHNDPKS

SEQ ID NO: 9861 - protein, 7 aa, Artificial Sequence
  Description of Artificial Sequence: Synthetic peptide
ENKNKST

SEQ ID NO: 9862 - protein, 7 aa, Artificial Sequence
  Description of Artificial Sequence: Synthetic peptide
EVPSQTR

SEQ ID NO: 9863 - protein, 7 aa, Artificial Sequence
  Description of Artificial Sequence: Synthetic peptide
AKTRETT

SEQ ID NO: 9864 - protein, 7 aa, Artificial Sequence
  Description of Artificial Sequence: Synthetic peptide
VTGTGSP

SEQ ID NO: 9865 - protein, 7 aa, Artificial Sequence
  Description of Artificial Sequence: Synthetic peptide
SAQQTGS

SEQ ID NO: 9866 - protein, 7 aa, Artificial Sequence
  Description of Artificial Sequence: Synthetic peptide
SPQSPSS

SEQ ID NO: 9867 - protein, 7 aa, Artificial Sequence
  Description of Artificial Sequence: Synthetic peptide
NSSKSPI

SEQ ID NO: 9868 - protein, 7 aa, Artificial Sequence
  Description of Artificial Sequence: Synthetic peptide
AVSDKGI

SEQ ID NO: 9869 - protein, 7 aa, Artificial Sequence
  Description of Artificial Sequence: Synthetic peptide
TGNASTA

SEQ ID NO: 9870 - protein, 7 aa, Artificial Sequence
  Description of Artificial Sequence: Synthetic peptide
TGAATVM

SEQ ID NO: 9871 - protein, 7 aa, Artificial Sequence
  Description of Artificial Sequence: Synthetic peptide
SQTDYKG

SEQ ID NO: 9872 - protein, 7 aa, Artificial Sequence
  Description of Artificial Sequence: Synthetic peptide
ASGHGAS

SEQ ID NO: 9873 - protein, 7 aa, Artificial Sequence
  Description of Artificial Sequence: Synthetic peptide
AGTSAPN

SEQ ID NO: 9874 - protein, 7 aa, Artificial Sequence
  Description of Artificial Sequence: Synthetic peptide
GPGTSNT

SEQ ID NO: 9875 - protein, 7 aa, Artificial Sequence
  Description of Artificial Sequence: Synthetic peptide
SQHTPPS

SEQ ID NO: 9876 - protein, 7 aa, Artificial Sequence
  Description of Artificial Sequence: Synthetic peptide
ENRTQNS

SEQ ID NO: 9877 - protein, 7 aa, Artificial Sequence
  Description of Artificial Sequence: Synthetic peptide
TMSNPGV

SEQ ID NO: 9878 - protein, 7 aa, Artificial Sequence
  Description of Artificial Sequence: Synthetic peptide
QTNKISV

SEQ ID NO: 9879 - protein, 7 aa, Artificial Sequence
  Description of Artificial Sequence: Synthetic peptide
SDGQTRS

SEQ ID NO: 9880 - protein, 7 aa, Artificial Sequence
  Description of Artificial Sequence: Synthetic peptide
SAKPQSK

SEQ ID NO: 9881 - protein, 7 aa, Artificial Sequence
  Description of Artificial Sequence: Synthetic peptide
FRTTATE

SEQ ID NO: 9882 - protein, 7 aa, Artificial Sequence
  Description of Artificial Sequence: Synthetic peptide
ERSGTPS

SEQ ID NO: 9883 - protein, 7 aa, Artificial Sequence
  Description of Artificial Sequence: Synthetic peptide
ALSDSRS

SEQ ID NO: 9884 - protein, 7 aa, Artificial Sequence
  Description of Artificial Sequence: Synthetic peptide
ADTKTGS

SEQ ID NO: 9885 - protein, 7 aa, Artificial Sequence
  Description of Artificial Sequence: Synthetic peptide
GTPSNNT

SEQ ID NO: 9886 - protein, 7 aa, Artificial Sequence
  Description of Artificial Sequence: Synthetic peptide
STGSAFS

SEQ ID NO: 9887 - protein, 7 aa, Artificial Sequence
  Description of Artificial Sequence: Synthetic peptide
ATVSKPA

SEQ ID NO: 9888 - protein, 7 aa, Artificial Sequence
  Description of Artificial Sequence: Synthetic peptide
NMGQNGV

SEQ ID NO: 9889 - protein, 7 aa, Artificial Sequence
  Description of Artificial Sequence: Synthetic peptide
SSIPSEK

SEQ ID NO: 9890 - protein, 7 aa, Artificial Sequence
  Description of Artificial Sequence: Synthetic peptide
SPESRAS

SEQ ID NO: 9891 - protein, 7 aa, Artificial Sequence
  Description of Artificial Sequence: Synthetic peptide
SNSKEQL

SEQ ID NO: 9892 - protein, 7 aa, Artificial Sequence
  Description of Artificial Sequence: Synthetic peptide
STRTSTS

SEQ ID NO: 9893 - protein, 7 aa, Artificial Sequence
  Description of Artificial Sequence: Synthetic peptide
SIQSPSS

SEQ ID NO: 9894 - protein, 7 aa, Artificial Sequence
  Description of Artificial Sequence: Synthetic peptide
LDNKTVI

SEQ ID NO: 9895 - protein, 7 aa, Artificial Sequence
  Description of Artificial Sequence: Synthetic peptide
EPSTISR

SEQ ID NO: 9896 - protein, 7 aa, Artificial Sequence
  Description of Artificial Sequence: Synthetic peptide
EGTSESK

SEQ ID NO: 9897 - protein, 7 aa, Artificial Sequence
  Description of Artificial Sequence: Synthetic peptide
GQSTSTA

SEQ ID NO: 9898 - protein, 7 aa, Artificial Sequence
  Description of Artificial Sequence: Synthetic peptide
VNGPNPT

SEQ ID NO: 9899 - protein, 7 aa, Artificial Sequence
  Description of Artificial Sequence: Synthetic peptide
NDTRGGQ

SEQ ID NO: 9900 - protein, 7 aa, Artificial Sequence
  Description of Artificial Sequence: Synthetic peptide
QGDRDVH

SEQ ID NO: 9901 - protein, 7 aa, Artificial Sequence
  Description of Artificial Sequence: Synthetic peptide
LQNASPG

SEQ ID NO: 9902 - protein, 7 aa, Artificial Sequence
  Description of Artificial Sequence: Synthetic peptide
AAPTTPG

SEQ ID NO: 9903 - protein, 7 aa, Artificial Sequence
  Description of Artificial Sequence: Synthetic peptide
GGQASGH

SEQ ID NO: 9904 - protein, 7 aa, Artificial Sequence
  Description of Artificial Sequence: Synthetic peptide
TNLPTVA

SEQ ID NO: 9905 - protein, 7 aa, Artificial Sequence
  Description of Artificial Sequence: Synthetic peptide
SGREDMR

SEQ ID NO: 9906 - protein, 7 aa, Artificial Sequence
  Description of Artificial Sequence: Synthetic peptide
GKSNERG

SEQ ID NO: 9907 - protein, 7 aa, Artificial Sequence
  Description of Artificial Sequence: Synthetic peptide
NGSTNSR

SEQ ID NO: 9908 - protein, 7 aa, Artificial Sequence
  Description of Artificial Sequence: Synthetic peptide
SQSKSFQ

SEQ ID NO: 9909 - protein, 7 aa, Artificial Sequence
  Description of Artificial Sequence: Synthetic peptide
ETPSKQT

SEQ ID NO: 9910 - protein, 7 aa, Artificial Sequence
  Description of Artificial Sequence: Synthetic peptide
ESSHTSR

SEQ ID NO: 9911 - protein, 7 aa, Artificial Sequence
  Description of Artificial Sequence: Synthetic peptide
GDNDSRK

SEQ ID NO: 9912 - protein, 7 aa, Artificial Sequence
  Description of Artificial Sequence: Synthetic peptide
RTENARS

SEQ ID NO: 9913 - protein, 7 aa, Artificial Sequence
  Description of Artificial Sequence: Synthetic peptide
MGGTAQG

SEQ ID NO: 9914 - protein, 7 aa, Artificial Sequence
  Description of Artificial Sequence: Synthetic peptide
AATGQHT

SEQ ID NO: 9915 - protein, 7 aa, Artificial Sequence
  Description of Artificial Sequence: Synthetic peptide
GTSSAPQ

SEQ ID NO: 9916 - protein, 7 aa, Artificial Sequence
  Description of Artificial Sequence: Synthetic peptide
SPNAKRD

SEQ ID NO: 9917 - protein, 7 aa, Artificial Sequence
  Description of Artificial Sequence: Synthetic peptide
AVGNSGK

SEQ ID NO: 9918 - protein, 7 aa, Artificial Sequence
  Description of Artificial Sequence: Synthetic peptide
SGRGSPM

SEQ ID NO: 9919 - protein, 7 aa, Artificial Sequence
  Description of Artificial Sequence: Synthetic peptide
SSQTTSS

SEQ ID NO: 9920 - protein, 7 aa, Artificial Sequence
  Description of Artificial Sequence: Synthetic peptide
NTGSGSA

SEQ ID NO: 9921 - protein, 7 aa, Artificial Sequence
  Description of Artificial Sequence: Synthetic peptide
QKIDTVR

SEQ ID NO: 9922 - protein, 7 aa, Artificial Sequence
  Description of Artificial Sequence: Synthetic peptide
GTHANAK

SEQ ID NO: 9923 - protein, 7 aa, Artificial Sequence
  Description of Artificial Sequence: Synthetic peptide
GVSKSLS

SEQ ID NO: 9924 - protein, 7 aa, Artificial Sequence
  Description of Artificial Sequence: Synthetic peptide
GTQSSRQ

SEQ ID NO: 9925 - protein, 7 aa, Artificial Sequence
  Description of Artificial Sequence: Synthetic peptide
NSTGTST

SEQ ID NO: 9926 - protein, 7 aa, Artificial Sequence
  Description of Artificial Sequence: Synthetic peptide
TRNTEVH

SEQ ID NO: 9927 - protein, 7 aa, Artificial Sequence
  Description of Artificial Sequence: Synthetic peptide
TPRATAE

SEQ ID NO: 9928 - protein, 7 aa, Artificial Sequence
  Description of Artificial Sequence: Synthetic peptide
NQSNTTV

SEQ ID NO: 9929 - protein, 7 aa, Artificial Sequence
  Description of Artificial Sequence: Synthetic peptide
TPIQDAK

SEQ ID NO: 9930 - protein, 7 aa, Artificial Sequence
  Description of Artificial Sequence: Synthetic peptide
SANSDRS

SEQ ID NO: 9931 - protein, 7 aa, Artificial Sequence
  Description of Artificial Sequence: Synthetic peptide
TPNAHPQ

SEQ ID NO: 9932 - protein, 7 aa, Artificial Sequence
  Description of Artificial Sequence: Synthetic peptide
SLTKGSV

SEQ ID NO: 9933 - protein, 7 aa, Artificial Sequence
  Description of Artificial Sequence: Synthetic peptide
SAAKSST

SEQ ID NO: 9934 - protein, 7 aa, Artificial Sequence
  Description of Artificial Sequence: Synthetic peptide
SNSTKTA

SEQ ID NO: 9935 - protein, 7 aa, Artificial Sequence
  Description of Artificial Sequence: Synthetic peptide
TNSQTSL

SEQ ID NO: 9936 - protein, 7 aa, Artificial Sequence
  Description of Artificial Sequence: Synthetic peptide
KNETSNG

SEQ ID NO: 9937 - protein, 7 aa, Artificial Sequence
  Description of Artificial Sequence: Synthetic peptide
NISHKGE

SEQ ID NO: 9938 - protein, 7 aa, Artificial Sequence
  Description of Artificial Sequence: Synthetic peptide
NASSKLQ

SEQ ID NO: 9939 - protein, 7 aa, Artificial Sequence
  Description of Artificial Sequence: Synthetic peptide
NSGAGLM

SEQ ID NO: 9940 - protein, 7 aa, Artificial Sequence
  Description of Artificial Sequence: Synthetic peptide
TMAQNPS

SEQ ID NO: 9941 - protein, 7 aa, Artificial Sequence
  Description of Artificial Sequence: Synthetic peptide
THQSGSV

SEQ ID NO: 9942 - protein, 7 aa, Artificial Sequence
  Description of Artificial Sequence: Synthetic peptide
TGQQSSI

SEQ ID NO: 9943 - protein, 7 aa, Artificial Sequence
  Description of Artificial Sequence: Synthetic peptide
TGGAPGG

SEQ ID NO: 9944 - protein, 7 aa, Artificial Sequence
  Description of Artificial Sequence: Synthetic peptide
RDGGASM

SEQ ID NO: 9945 - protein, 7 aa, Artificial Sequence
  Description of Artificial Sequence: Synthetic peptide
RGNSNSG

SEQ ID NO: 9946 - protein, 7 aa, Artificial Sequence
  Description of Artificial Sequence: Synthetic peptide
SKGDNGG

SEQ ID NO: 9947 - protein, 7 aa, Artificial Sequence
  Description of Artificial Sequence: Synthetic peptide
SRPEKVP

SEQ ID NO: 9948 - protein, 7 aa, Artificial Sequence
  Description of Artificial Sequence: Synthetic peptide
SSSSPVS

SEQ ID NO: 9949 - protein, 7 aa, Artificial Sequence
  Description of Artificial Sequence: Synthetic peptide
IGTGVSS

SEQ ID NO: 9950 - protein, 7 aa, Artificial Sequence
  Description of Artificial Sequence: Synthetic peptide
MSGSNPQ

SEQ ID NO: 9951 - protein, 7 aa, Artificial Sequence
  Description of Artificial Sequence: Synthetic peptide
IASQKVP

SEQ ID NO: 9952 - protein, 7 aa, Artificial Sequence
  Description of Artificial Sequence: Synthetic peptide
LSVSSAG

SEQ ID NO: 9953 - protein, 7 aa, Artificial Sequence
  Description of Artificial Sequence: Synthetic peptide
LAASSNA

SEQ ID NO: 9954 - protein, 7 aa, Artificial Sequence
  Description of Artificial Sequence: Synthetic peptide
DNTKELR

SEQ ID NO: 9955 - protein, 7 aa, Artificial Sequence
  Description of Artificial Sequence: Synthetic peptide
ASGKPGE

SEQ ID NO: 9956 - protein, 7 aa, Artificial Sequence
  Description of Artificial Sequence: Synthetic peptide
ASNSRDK

SEQ ID NO: 9957 - protein, 7 aa, Artificial Sequence
  Description of Artificial Sequence: Synthetic peptide
GILEKTR

SEQ ID NO: 9958 - protein, 7 aa, Artificial Sequence
  Description of Artificial Sequence: Synthetic peptide
GGGSHQS

SEQ ID NO: 9959 - protein, 7 aa, Artificial Sequence
  Description of Artificial Sequence: Synthetic peptide
GMDKTSR

SEQ ID NO: 9960 - protein, 7 aa, Artificial Sequence
  Description of Artificial Sequence: Synthetic peptide
GSVPDRK

SEQ ID NO: 9961 - protein, 7 aa, Artificial Sequence
  Description of Artificial Sequence: Synthetic peptide
GSHERNT

SEQ ID NO: 9962 - protein, 7 aa, Artificial Sequence
  Description of Artificial Sequence: Synthetic peptide
GIENLKE

SEQ ID NO: 9963 - protein, 7 aa, Artificial Sequence
  Description of Artificial Sequence: Synthetic peptide
GPVSGTG

SEQ ID NO: 9964 - protein, 7 aa, Artificial Sequence
  Description of Artificial Sequence: Synthetic peptide
VGAANSQ

SEQ ID NO: 9965 - protein, 7 aa, Artificial Sequence
  Description of Artificial Sequence: Synthetic peptide
SSTNTSA

SEQ ID NO: 9966 - protein, 7 aa, Artificial Sequence
  Description of Artificial Sequence: Synthetic peptide
FSDSPAK

SEQ ID NO: 9967 - protein, 7 aa, Artificial Sequence
  Description of Artificial Sequence: Synthetic peptide
TNDHSTS

SEQ ID NO: 9968 - protein, 7 aa, Artificial Sequence
  Description of Artificial Sequence: Synthetic peptide
GSPDPRS

SEQ ID NO: 9969 - protein, 7 aa, Artificial Sequence
  Description of Artificial Sequence: Synthetic peptide
TNDSRHE

SEQ ID NO: 9970 - protein, 7 aa, Artificial Sequence
  Description of Artificial Sequence: Synthetic peptide
STASSTL

SEQ ID NO: 9971 - protein, 7 aa, Artificial Sequence
  Description of Artificial Sequence: Synthetic peptide
MVNKQSS

SEQ ID NO: 9972 - protein, 7 aa, Artificial Sequence
  Description of Artificial Sequence: Synthetic peptide
EARSAST

SEQ ID NO: 9973 - protein, 7 aa, Artificial Sequence
  Description of Artificial Sequence: Synthetic peptide
GQGSASA

SEQ ID NO: 9974 - protein, 7 aa, Artificial Sequence
  Description of Artificial Sequence: Synthetic peptide
DGKSKLA

SEQ ID NO: 9975 - protein, 7 aa, Artificial Sequence
  Description of Artificial Sequence: Synthetic peptide
AGTNGLN

SEQ ID NO: 9976 - protein, 7 aa, Artificial Sequence
  Description of Artificial Sequence: Synthetic peptide
SVAAAPT

SEQ ID NO: 9977 - protein, 7 aa, Artificial Sequence
  Description of Artificial Sequence: Synthetic peptide
SSTNPGT

SEQ ID NO: 9978 - protein, 7 aa, Artificial Sequence
  Description of Artificial Sequence: Synthetic peptide
CCTGKSS

SEQ ID NO: 9979 - protein, 7 aa, Artificial Sequence
  Description of Artificial Sequence: Synthetic peptide
NSGSTAS

SEQ ID NO: 9980 - protein, 7 aa, Artificial Sequence
  Description of Artificial Sequence: Synthetic peptide
TALGSNS

SEQ ID NO: 9981 - protein, 7 aa, Artificial Sequence
  Description of Artificial Sequence: Synthetic peptide
SGGGTEN

SEQ ID NO: 9982 - protein, 7 aa, Artificial Sequence
  Description of Artificial Sequence: Synthetic peptide
DGGSNKA

SEQ ID NO: 9983 - protein, 7 aa, Artificial Sequence
  Description of Artificial Sequence: Synthetic peptide
AATTGGA

SEQ ID NO: 9984 - protein, 7 aa, Artificial Sequence
  Description of Artificial Sequence: Synthetic peptide
GPAKTDR

SEQ ID NO: 9985 - protein, 7 aa, Artificial Sequence
  Description of Artificial Sequence: Synthetic peptide
GTSNNKI

SEQ ID NO: 9986 - protein, 7 aa, Artificial Sequence
  Description of Artificial Sequence: Synthetic peptide
IKNSKEG

SEQ ID NO: 9987 - protein, 7 aa, Artificial Sequence
  Description of Artificial Sequence: Synthetic peptide
QPASTSV

SEQ ID NO: 9988 - protein, 7 aa, Artificial Sequence
  Description of Artificial Sequence: Synthetic peptide
DSSKTAV

SEQ ID NO: 9989 - protein, 7 aa, Artificial Sequence
  Description of Artificial Sequence: Synthetic peptide
GALNGHG

SEQ ID NO: 9990 - protein, 7 aa, Artificial Sequence
  Description of Artificial Sequence: Synthetic peptide
WGNSTNA

SEQ ID NO: 9991 - protein, 7 aa, Artificial Sequence
  Description of Artificial Sequence: Synthetic peptide
LNGKPSN

SEQ ID NO: 9992 - protein, 7 aa, Artificial Sequence
  Description of Artificial Sequence: Synthetic peptide
TGASSTL

SEQ ID NO: 9993 - protein, 7 aa, Artificial Sequence
  Description of Artificial Sequence: Synthetic peptide
QTADRRD

SEQ ID NO: 9994 - protein, 7 aa, Artificial Sequence
  Description of Artificial Sequence: Synthetic peptide
NSAHPAT

SEQ ID NO: 9995 - protein, 7 aa, Artificial Sequence
  Description of Artificial Sequence: Synthetic peptide
TTNTGLA

SEQ ID NO: 9996 - protein, 7 aa, Artificial Sequence
  Description of Artificial Sequence: Synthetic peptide
VSSGKVS

SEQ ID NO: 9997 - protein, 7 aa, Artificial Sequence
  Description of Artificial Sequence: Synthetic peptide
SPTSDRL

SEQ ID NO: 9998 - protein, 7 aa, Artificial Sequence
  Description of Artificial Sequence: Synthetic peptide
LSGHNSG

SEQ ID NO: 9999 - protein, 7 aa, Artificial Sequence
  Description of Artificial Sequence: Synthetic peptide
AKSPNSY

SEQ ID NO: 10000 - protein, 7 aa, Artificial Sequence
  Description of Artificial Sequence: Synthetic peptide
FTSEHGR

SEQ ID NO: 10001 - protein, 7 aa, Artificial Sequence
  Description of Artificial Sequence: Synthetic peptide
QSGGQTA

SEQ ID NO: 10002 - protein, 7 aa, Artificial Sequence
  Description of Artificial Sequence: Synthetic peptide
SQASTSL

SEQ ID NO: 10003 - protein, 7 aa, Artificial Sequence
  Description of Artificial Sequence: Synthetic peptide
DGSRQSI

SEQ ID NO: 10004 - protein, 7 aa, Artificial Sequence
  Description of Artificial Sequence: Synthetic peptide
SPNKPTH

SEQ ID NO: 10005 - protein, 7 aa, Artificial Sequence
  Description of Artificial Sequence: Synthetic peptide
STTSDRA

SEQ ID NO: 10006 - protein, 7 aa, Artificial Sequence
  Description of Artificial Sequence: Synthetic peptide
NSDESNR

SEQ ID NO: 10007 - protein, 7 aa, Artificial Sequence
  Description of Artificial Sequence: Synthetic peptide
NTSGQNP

SEQ ID NO: 10008 - protein, 7 aa, Artificial Sequence
  Description of Artificial Sequence: Synthetic peptide
NNNSSTN

SEQ ID NO: 10009 - protein, 7 aa, Artificial Sequence
  Description of Artificial Sequence: Synthetic peptide
TSGDARS

SEQ ID NO: 10010 - protein, 7 aa, Artificial Sequence
  Description of Artificial Sequence: Synthetic peptide
RDNTPAL

SEQ ID NO: 10011 - protein, 7 aa, Artificial Sequence
  Description of Artificial Sequence: Synthetic peptide
IVQENSK

SEQ ID NO: 10012 - protein, 7 aa, Artificial Sequence
  Description of Artificial Sequence: Synthetic peptide
MNSPGTS

SEQ ID NO: 10013 - protein, 7 aa, Artificial Sequence
  Description of Artificial Sequence: Synthetic peptide
ETSSRAS

SEQ ID NO: 10014 - protein, 7 aa, Artificial Sequence
  Description of Artificial Sequence: Synthetic peptide
DLQDSRK

SEQ ID NO: 10015 - protein, 7 aa, Artificial Sequence
  Description of Artificial Sequence: Synthetic peptide
DGKVSTK

SEQ ID NO: 10016 - protein, 7 aa, Artificial Sequence
  Description of Artificial Sequence: Synthetic peptide
GHVQSSK

SEQ ID NO: 10017 - protein, 7 aa, Artificial Sequence
  Description of Artificial Sequence: Synthetic peptide
GPDSNRV

SEQ ID NO: 10018 - protein, 7 aa, Artificial Sequence
  Description of Artificial Sequence: Synthetic peptide
LQSGEQR

SEQ ID NO: 10019 - protein, 7 aa, Artificial Sequence
  Description of Artificial Sequence: Synthetic peptide
NSSTKAV

SEQ ID NO: 10020 - protein, 7 aa, Artificial Sequence
  Description of Artificial Sequence: Synthetic peptide
GGQERNN

SEQ ID NO: 10021 - protein, 7 aa, Artificial Sequence
  Description of Artificial Sequence: Synthetic peptide
SMSATHV

SEQ ID NO: 10022 - protein, 7 aa, Artificial Sequence
  Description of Artificial Sequence: Synthetic peptide
DAREVSR

SEQ ID NO: 10023 - protein, 7 aa, Artificial Sequence
  Description of Artificial Sequence: Synthetic peptide
TLDKTNS

SEQ ID NO: 10024 - protein, 7 aa, Artificial Sequence
  Description of Artificial Sequence: Synthetic peptide
SNNKPNS

SEQ ID NO: 10025 - protein, 7 aa, Artificial Sequence
  Description of Artificial Sequence: Synthetic peptide
LTSEKHL

SEQ ID NO: 10026 - protein, 7 aa, Artificial Sequence
  Description of Artificial Sequence: Synthetic peptide
ESSSGSM

SEQ ID NO: 10027 - protein, 7 aa, Artificial Sequence
  Description of Artificial Sequence: Synthetic peptide
DLKDPRA

SEQ ID NO: 10028 - protein, 7 aa, Artificial Sequence
  Description of Artificial Sequence: Synthetic peptide
DVSQRNL

SEQ ID NO: 10029 - protein, 7 aa, Artificial Sequence
  Description of Artificial Sequence: Synthetic peptide
DQLGTSR

SEQ ID NO: 10030 - protein, 7 aa, Artificial Sequence
  Description of Artificial Sequence: Synthetic peptide
SVKNPTN

SEQ ID NO: 10031 - protein, 7 aa, Artificial Sequence
  Description of Artificial Sequence: Synthetic peptide
SSSESKS

SEQ ID NO: 10032 - protein, 7 aa, Artificial Sequence
  Description of Artificial Sequence: Synthetic peptide
AGSRETS

SEQ ID NO: 10033 - protein, 7 aa, Artificial Sequence
  Description of Artificial Sequence: Synthetic peptide
TNTGSSV

SEQ ID NO: 10034 - protein, 7 aa, Artificial Sequence
  Description of Artificial Sequence: Synthetic peptide
SEGSGGK

SEQ ID NO: 10035 - protein, 7 aa, Artificial Sequence
  Description of Artificial Sequence: Synthetic peptide
MVPGDKV

SEQ ID NO: 10036 - protein, 7 aa, Artificial Sequence
  Description of Artificial Sequence: Synthetic peptide
HNGSKGM

SEQ ID NO: 10037 - protein, 7 aa, Artificial Sequence
  Description of Artificial Sequence: Synthetic peptide
DPSHVNR

SEQ ID NO: 10038 - protein, 7 aa, Artificial Sequence
  Description of Artificial Sequence: Synthetic peptide
AAGDRSG

SEQ ID NO: 10039 - protein, 7 aa, Artificial Sequence
  Description of Artificial Sequence: Synthetic peptide
ASSGQSG

SEQ ID NO: 10040 - protein, 7 aa, Artificial Sequence
  Description of Artificial Sequence: Synthetic peptide
VEASGNK

SEQ ID NO: 10041 - protein, 7 aa, Artificial Sequence
  Description of Artificial Sequence: Synthetic peptide
GNAPNLK

SEQ ID NO: 10042 - protein, 7 aa, Artificial Sequence
  Description of Artificial Sequence: Synthetic peptide
THSSDNQ

SEQ ID NO: 10043 - protein, 7 aa, Artificial Sequence
  Description of Artificial Sequence: Synthetic peptide
SVSSPTK

SEQ ID NO: 10044 - protein, 7 aa, Artificial Sequence
  Description of Artificial Sequence: Synthetic peptide
TINSQPI

SEQ ID NO: 10045 - protein, 7 aa, Artificial Sequence
  Description of Artificial Sequence: Synthetic peptide
SLSQAPT

SEQ ID NO: 10046 - protein, 7 aa, Artificial Sequence
  Description of Artificial Sequence: Synthetic peptide
ESSGARL

SEQ ID NO: 10047 - protein, 7 aa, Artificial Sequence
  Description of Artificial Sequence: Synthetic peptide
SQSKQVS

SEQ ID NO: 10048 - protein, 7 aa, Artificial Sequence
  Description of Artificial Sequence: Synthetic peptide
WSSEKTR

SEQ ID NO: 10049 - protein, 7 aa, Artificial Sequence
  Description of Artificial Sequence: Synthetic peptide
DRLGKGP

SEQ ID NO: 10050 - protein, 7 aa, Artificial Sequence
  Description of Artificial Sequence: Synthetic peptide
SVVQASK

SEQ ID NO: 10051 - protein, 7 aa, Artificial Sequence
  Description of Artificial Sequence: Synthetic peptide
SSSSSSN

SEQ ID NO: 10052 - protein, 7 aa, Artificial Sequence
  Description of Artificial Sequence: Synthetic peptide
MNSQSSR

SEQ ID NO: 10053 - protein, 7 aa, Artificial Sequence
  Description of Artificial Sequence: Synthetic peptide
QTSGTQV

SEQ ID NO: 10054 - protein, 7 aa, Artificial Sequence
  Description of Artificial Sequence: Synthetic peptide
QSKGTTG

SEQ ID NO: 10055 - protein, 7 aa, Artificial Sequence
  Description of Artificial Sequence: Synthetic peptide
DVPSKQL

SEQ ID NO: 10056 - protein, 7 aa, Artificial Sequence
  Description of Artificial Sequence: Synthetic peptide
GVSKDRM

SEQ ID NO: 10057 - protein, 7 aa, Artificial Sequence
  Description of Artificial Sequence: Synthetic peptide
MGSNSSI

SEQ ID NO: 10058 - protein, 7 aa, Artificial Sequence
  Description of Artificial Sequence: Synthetic peptide
GTGRDTA

SEQ ID NO: 10059 - protein, 7 aa, Artificial Sequence
  Description of Artificial Sequence: Synthetic peptide
GTGTDLK

SEQ ID NO: 10060 - protein, 7 aa, Artificial Sequence
  Description of Artificial Sequence: Synthetic peptide
IDTKGGS

SEQ ID NO: 10061 - protein, 7 aa, Artificial Sequence
  Description of Artificial Sequence: Synthetic peptide
SSSQSKM

SEQ ID NO: 10062 - protein, 7 aa, Artificial Sequence
  Description of Artificial Sequence: Synthetic peptide
AAGANSG

SEQ ID NO: 10063 - protein, 7 aa, Artificial Sequence
  Description of Artificial Sequence: Synthetic peptide
KGSNTHG

SEQ ID NO: 10064 - protein, 7 aa, Artificial Sequence
  Description of Artificial Sequence: Synthetic peptide
NAPGQHG

SEQ ID NO: 10065 - protein, 7 aa, Artificial Sequence
  Description of Artificial Sequence: Synthetic peptide
NVSETPK

SEQ ID NO: 10066 - protein, 7 aa, Artificial Sequence
  Description of Artificial Sequence: Synthetic peptide
NTDTRSS

SEQ ID NO: 10067 - protein, 7 aa, Artificial Sequence
  Description of Artificial Sequence: Synthetic peptide
SRTPGSS

SEQ ID NO: 10068 - protein, 7 aa, Artificial Sequence
  Description of Artificial Sequence: Synthetic peptide
SGKSSNS

SEQ ID NO: 10069 - protein, 7 aa, Artificial Sequence
  Description of Artificial Sequence: Synthetic peptide
SGVSHAA

SEQ ID NO: 10070 - protein, 7 aa, Artificial Sequence
  Description of Artificial Sequence: Synthetic peptide
QATTAAR

SEQ ID NO: 10071 - protein, 7 aa, Artificial Sequence
  Description of Artificial Sequence: Synthetic peptide
DHVNKGG

SEQ ID NO: 10072 - protein, 7 aa, Artificial Sequence
  Description of Artificial Sequence: Synthetic peptide
VSSGSLS

SEQ ID NO: 10073 - protein, 7 aa, Artificial Sequence
  Description of Artificial Sequence: Synthetic peptide
SRGADLS

SEQ ID NO: 10074 - protein, 7 aa, Artificial Sequence
  Description of Artificial Sequence: Synthetic peptide
SGTNTAL

SEQ ID NO: 10075 - protein, 7 aa, Artificial Sequence
  Description of Artificial Sequence: Synthetic peptide
SSTPSIG

SEQ ID NO: 10076 - protein, 7 aa, Artificial Sequence
  Description of Artificial Sequence: Synthetic peptide
FAETKGG

SEQ ID NO: 10077 - protein, 7 aa, Artificial Sequence
  Description of Artificial Sequence: Synthetic peptide
RSTGGSS

SEQ ID NO: 10078 - protein, 7 aa, Artificial Sequence
  Description of Artificial Sequence: Synthetic peptide
GGGSGKT

SEQ ID NO: 10079 - protein, 7 aa, Artificial Sequence
  Description of Artificial Sequence: Synthetic peptide
LNNSGSH

SEQ ID NO: 10080 - protein, 7 aa, Artificial Sequence
  Description of Artificial Sequence: Synthetic peptide
TLSAPHS

SEQ ID NO: 10081 - protein, 7 aa, Artificial Sequence
  Description of Artificial Sequence: Synthetic peptide
NADSSTH

SEQ ID NO: 10082 - protein, 7 aa, Artificial Sequence
  Description of Artificial Sequence: Synthetic peptide
ASNVKSL

SEQ ID NO: 10083 - protein, 7 aa, Artificial Sequence
  Description of Artificial Sequence: Synthetic peptide
STSTPHQ

SEQ ID NO: 10084 - protein, 7 aa, Artificial Sequence
  Description of Artificial Sequence: Synthetic peptide
LNTPPSK

SEQ ID NO: 10085 - protein, 7 aa, Artificial Sequence
  Description of Artificial Sequence: Synthetic peptide
NASRETV

SEQ ID NO: 10086 - protein, 7 aa, Artificial Sequence
  Description of Artificial Sequence: Synthetic peptide
TAPERMA

SEQ ID NO: 10087 - protein, 7 aa, Artificial Sequence
  Description of Artificial Sequence: Synthetic peptide
DTGKTRS

SEQ ID NO: 10088 - protein, 7 aa, Artificial Sequence
  Description of Artificial Sequence: Synthetic peptide
GLLSSTK

SEQ ID NO: 10089 - protein, 7 aa, Artificial Sequence
  Description of Artificial Sequence: Synthetic peptide
SLSATSQ

SEQ ID NO: 10090 - protein, 7 aa, Artificial Sequence
  Description of Artificial Sequence: Synthetic peptide
SNERTPK

SEQ ID NO: 10091 - protein, 7 aa, Artificial Sequence
  Description of Artificial Sequence: Synthetic peptide
FEKSTPT

SEQ ID NO: 10092 - protein, 7 aa, Artificial Sequence
  Description of Artificial Sequence: Synthetic peptide
NASAQSK

SEQ ID NO: 10093 - protein, 7 aa, Artificial Sequence
  Description of Artificial Sequence: Synthetic peptide
TTENSRG

SEQ ID NO: 10094 - protein, 7 aa, Artificial Sequence
  Description of Artificial Sequence: Synthetic peptide
SSSTNPK

SEQ ID NO: 10095 - protein, 7 aa, Artificial Sequence
  Description of Artificial Sequence: Synthetic peptide
SNTQGLT

SEQ ID NO: 10096 - protein, 7 aa, Artificial Sequence
  Description of Artificial Sequence: Synthetic peptide
SAKPEGS

SEQ ID NO: 10097 - protein, 7 aa, Artificial Sequence
  Description of Artificial Sequence: Synthetic peptide
SRSKTDA

SEQ ID NO: 10098 - protein, 7 aa, Artificial Sequence
  Description of Artificial Sequence: Synthetic peptide
QGSTTAS

SEQ ID NO: 10099 - protein, 7 aa, Artificial Sequence
  Description of Artificial Sequence: Synthetic peptide
GNPNSAT

SEQ ID NO: 10100 - protein, 7 aa, Artificial Sequence
  Description of Artificial Sequence: Synthetic peptide
TGSTPVH

SEQ ID NO: 10101 - protein, 7 aa, Artificial Sequence
  Description of Artificial Sequence: Synthetic peptide
SSPGGSQ

SEQ ID NO: 10102 - protein, 7 aa, Artificial Sequence
  Description of Artificial Sequence: Synthetic peptide
ETTAKNG

SEQ ID NO: 10103 - protein, 7 aa, Artificial Sequence
  Description of Artificial Sequence: Synthetic peptide
ASGAPSK

SEQ ID NO: 10104 - protein, 7 aa, Artificial Sequence
  Description of Artificial Sequence: Synthetic peptide
VSSKETA

SEQ ID NO: 10105 - protein, 7 aa, Artificial Sequence
  Description of Artificial Sequence: Synthetic peptide
SETKVGI

SEQ ID NO: 10106 - protein, 7 aa, Artificial Sequence
  Description of Artificial Sequence: Synthetic peptide
GTAAVAS

SEQ ID NO: 10107 - protein, 7 aa, Artificial Sequence
  Description of Artificial Sequence: Synthetic peptide
NNAASVK

SEQ ID NO: 10108 - protein, 7 aa, Artificial Sequence
  Description of Artificial Sequence: Synthetic peptide
HGAAKSS

SEQ ID NO: 10109 - protein, 7 aa, Artificial Sequence
  Description of Artificial Sequence: Synthetic peptide
NTVSSGG

SEQ ID NO: 10110 - protein, 7 aa, Artificial Sequence
  Description of Artificial Sequence: Synthetic peptide
KSNDSSG

SEQ ID NO: 10111 - protein, 7 aa, Artificial Sequence
  Description of Artificial Sequence: Synthetic peptide
NNVQTTH

SEQ ID NO: 10112 - protein, 7 aa, Artificial Sequence
  Description of Artificial Sequence: Synthetic peptide
QGASTGS

SEQ ID NO: 10113 - protein, 7 aa, Artificial Sequence
  Description of Artificial Sequence: Synthetic peptide
ELGSKGH

SEQ ID NO: 10114 - protein, 7 aa, Artificial Sequence
  Description of Artificial Sequence: Synthetic peptide
GDRASPK

SEQ ID NO: 10115 - protein, 7 aa, Artificial Sequence
  Description of Artificial Sequence: Synthetic peptide
GSSGKSF

SEQ ID NO: 10116 - protein, 7 aa, Artificial Sequence
  Description of Artificial Sequence: Synthetic peptide
VKANEAS

SEQ ID NO: 10117 - protein, 7 aa, Artificial Sequence
  Description of Artificial Sequence: Synthetic peptide
SEGARHG

SEQ ID NO: 10118 - protein, 7 aa, Artificial Sequence
  Description of Artificial Sequence: Synthetic peptide
QVATGTS

SEQ ID NO: 10119 - protein, 7 aa, Artificial Sequence
  Description of Artificial Sequence: Synthetic peptide
SNGAGLT

SEQ ID NO: 10120 - protein, 7 aa, Artificial Sequence
  Description of Artificial Sequence: Synthetic peptide
LDPKPTS

SEQ ID NO: 10121 - protein, 7 aa, Artificial Sequence
  Description of Artificial Sequence: Synthetic peptide
SASKSST

SEQ ID NO: 10122 - protein, 7 aa, Artificial Sequence
  Description of Artificial Sequence: Synthetic peptide
TQSQVPI

SEQ ID NO: 10123 - protein, 7 aa, Artificial Sequence
  Description of Artificial Sequence: Synthetic peptide
SVNARTS

SEQ ID NO: 10124 - protein, 7 aa, Artificial Sequence
  Description of Artificial Sequence: Synthetic peptide
HGPSSQT

SEQ ID NO: 10125 - protein, 7 aa, Artificial Sequence
  Description of Artificial Sequence: Synthetic peptide
SNASSPS

SEQ ID NO: 10126 - protein, 7 aa, Artificial Sequence
  Description of Artificial Sequence: Synthetic peptide
KDTKQPN

SEQ ID NO: 10127 - protein, 7 aa, Artificial Sequence
  Description of Artificial Sequence: Synthetic peptide
TNTSGSG

SEQ ID NO: 10128 - protein, 7 aa, Artificial Sequence
  Description of Artificial Sequence: Synthetic peptide
LNTSKSV

SEQ ID NO: 10129 - protein, 7 aa, Artificial Sequence
  Description of Artificial Sequence: Synthetic peptide
GMSTGEG

SEQ ID NO: 10130 - protein, 7 aa, Artificial Sequence
  Description of Artificial Sequence: Synthetic peptide
LRTPNAG

SEQ ID NO: 10131 - protein, 7 aa, Artificial Sequence
  Description of Artificial Sequence: Synthetic peptide
SKAAQSI

SEQ ID NO: 10132 - protein, 7 aa, Artificial Sequence
  Description of Artificial Sequence: Synthetic peptide
MTDGSSK

SEQ ID NO: 10133 - protein, 7 aa, Artificial Sequence
  Description of Artificial Sequence: Synthetic peptide
DSTNKAA

SEQ ID NO: 10134 - protein, 7 aa, Artificial Sequence
  Description of Artificial Sequence: Synthetic peptide
GGSTLSK

SEQ ID NO: 10135 - protein, 7 aa, Artificial Sequence
  Description of Artificial Sequence: Synthetic peptide
STATGSK

SEQ ID NO: 10136 - protein, 7 aa, Artificial Sequence
  Description of Artificial Sequence: Synthetic peptide
LPSKVNT

SEQ ID NO: 10137 - protein, 7 aa, Artificial Sequence
  Description of Artificial Sequence: Synthetic peptide
VPSNKNG

SEQ ID NO: 10138 - protein, 7 aa, Artificial Sequence
  Description of Artificial Sequence: Synthetic peptide
NPASKAN

SEQ ID NO: 10139 - protein, 7 aa, Artificial Sequence
  Description of Artificial Sequence: Synthetic peptide
QGNHPSS

SEQ ID NO: 10140 - protein, 7 aa, Artificial Sequence
  Description of Artificial Sequence: Synthetic peptide
ARTGSPS

SEQ ID NO: 10141 - protein, 7 aa, Artificial Sequence
  Description of Artificial Sequence: Synthetic peptide
TTSSKTS

SEQ ID NO: 10142 - protein, 7 aa, Artificial Sequence
  Description of Artificial Sequence: Synthetic peptide
DIKSPSQ

SEQ ID NO: 10143 - protein, 7 aa, Artificial Sequence
  Description of Artificial Sequence: Synthetic peptide
TQATGKG

SEQ ID NO: 10144 - protein, 7 aa, Artificial Sequence
  Description of Artificial Sequence: Synthetic peptide
TSGVSTG

SEQ ID NO: 10145 - protein, 7 aa, Artificial Sequence
  Description of Artificial Sequence: Synthetic peptide
TNTNLKA

SEQ ID NO: 10146 - protein, 7 aa, Artificial Sequence
  Description of Artificial Sequence: Synthetic peptide
SKASSGL

SEQ ID NO: 10147 - protein, 7 aa, Artificial Sequence
  Description of Artificial Sequence: Synthetic peptide
STGSSIG

SEQ ID NO: 10148 - protein, 7 aa, Artificial Sequence
  Description of Artificial Sequence: Synthetic peptide
SVNPSMA

SEQ ID NO: 10149 - protein, 7 aa, Artificial Sequence
  Description of Artificial Sequence: Synthetic peptide
HRVSKDG

SEQ ID NO: 10150 - protein, 7 aa, Artificial Sequence
  Description of Artificial Sequence: Synthetic peptide
HQSGTSG

SEQ ID NO: 10151 - protein, 7 aa, Artificial Sequence
  Description of Artificial Sequence: Synthetic peptide
HESGQKS

SEQ ID NO: 10152 - protein, 7 aa, Artificial Sequence
  Description of Artificial Sequence: Synthetic peptide
LSSDKNS

SEQ ID NO: 10153 - protein, 7 aa, Artificial Sequence
  Description of Artificial Sequence: Synthetic peptide
DTVKSGT

SEQ ID NO: 10154 - protein, 7 aa, Artificial Sequence
  Description of Artificial Sequence: Synthetic peptide
ATTSEQH

SEQ ID NO: 10155 - protein, 7 aa, Artificial Sequence
  Description of Artificial Sequence: Synthetic peptide
YRGTENS

SEQ ID NO: 10156 - protein, 7 aa, Artificial Sequence
  Description of Artificial Sequence: Synthetic peptide
STNSTAR

SEQ ID NO: 10157 - protein, 7 aa, Artificial Sequence
  Description of Artificial Sequence: Synthetic peptide
SNGASLN

SEQ ID NO: 10158 - protein, 7 aa, Artificial Sequence
  Description of Artificial Sequence: Synthetic peptide
HSTGTPM

SEQ ID NO: 10159 - protein, 7 aa, Artificial Sequence
  Description of Artificial Sequence: Synthetic peptide
DETRARS

SEQ ID NO: 10160 - protein, 7 aa, Artificial Sequence
  Description of Artificial Sequence: Synthetic peptide
ESTSSVH

SEQ ID NO: 10161 - protein, 7 aa, Artificial Sequence
  Description of Artificial Sequence: Synthetic peptide
ATVDRNH

SEQ ID NO: 10162 - protein, 7 aa, Artificial Sequence
  Description of Artificial Sequence: Synthetic peptide
GLDAKPM

SEQ ID NO: 10163 - protein, 7 aa, Artificial Sequence
  Description of Artificial Sequence: Synthetic peptide
NSSDLKT

SEQ ID NO: 10164 - protein, 7 aa, Artificial Sequence
  Description of Artificial Sequence: Synthetic peptide
NGSGQIQ

SEQ ID NO: 10165 - protein, 7 aa, Artificial Sequence
  Description of Artificial Sequence: Synthetic peptide
MAIDKGK

SEQ ID NO: 10166 - protein, 7 aa, Artificial Sequence
  Description of Artificial Sequence: Synthetic peptide
ERREHGT

SEQ ID NO: 10167 - protein, 7 aa, Artificial Sequence
  Description of Artificial Sequence: Synthetic peptide
EPADKSS

SEQ ID NO: 10168 - protein, 7 aa, Artificial Sequence
  Description of Artificial Sequence: Synthetic peptide
ATTVTPK

SEQ ID NO: 10169 - protein, 7 aa, Artificial Sequence
  Description of Artificial Sequence: Synthetic peptide
GSGPAQQ

SEQ ID NO: 10170 - protein, 7 aa, Artificial Sequence
  Description of Artificial Sequence: Synthetic peptide
SSVSSTS

SEQ ID NO: 10171 - protein, 7 aa, Artificial Sequence
  Description of Artificial Sequence: Synthetic peptide
NTSSPTT

SEQ ID NO: 10172 - protein, 7 aa, Artificial Sequence
  Description of Artificial Sequence: Synthetic peptide
QTTTAAS

SEQ ID NO: 10173 - protein, 7 aa, Artificial Sequence
  Description of Artificial Sequence: Synthetic peptide
VSEGTTK

SEQ ID NO: 10174 - protein, 7 aa, Artificial Sequence
  Description of Artificial Sequence: Synthetic peptide
ESRGSSS

SEQ ID NO: 10175 - protein, 7 aa, Artificial Sequence
  Description of Artificial Sequence: Synthetic peptide
TMHGSSA

SEQ ID NO: 10176 - protein, 7 aa, Artificial Sequence
  Description of Artificial Sequence: Synthetic peptide
SNANTVH

SEQ ID NO: 10177 - protein, 7 aa, Artificial Sequence
  Description of Artificial Sequence: Synthetic peptide
SLGEKRQ

SEQ ID NO: 10178 - protein, 7 aa, Artificial Sequence
  Description of Artificial Sequence: Synthetic peptide
LGLKTSN

SEQ ID NO: 10179 - protein, 7 aa, Artificial Sequence
  Description of Artificial Sequence: Synthetic peptide
DNAPANR

SEQ ID NO: 10180 - protein, 7 aa, Artificial Sequence
  Description of Artificial Sequence: Synthetic peptide
DNTAAVK

SEQ ID NO: 10181 - protein, 7 aa, Artificial Sequence
  Description of Artificial Sequence: Synthetic peptide
DRTSGVA

SEQ ID NO: 10182 - protein, 7 aa, Artificial Sequence
  Description of Artificial Sequence: Synthetic peptide
AVSGKSI

SEQ ID NO: 10183 - protein, 7 aa, Artificial Sequence
  Description of Artificial Sequence: Synthetic peptide
AMGSSPG

SEQ ID NO: 10184 - protein, 7 aa, Artificial Sequence
  Description of Artificial Sequence: Synthetic peptide
GSKGSPH

SEQ ID NO: 10185 - protein, 7 aa, Artificial Sequence
  Description of Artificial Sequence: Synthetic peptide
GGDSVTK

SEQ ID NO: 10186 - protein, 7 aa, Artificial Sequence
  Description of Artificial Sequence: Synthetic peptide
GRTDQNS

SEQ ID NO: 10187 - protein, 7 aa, Artificial Sequence
  Description of Artificial Sequence: Synthetic peptide
GQAPGST

SEQ ID NO: 10188 - protein, 7 aa, Artificial Sequence
  Description of Artificial Sequence: Synthetic peptide
VQSSKSS

SEQ ID NO: 10189 - protein, 7 aa, Artificial Sequence
  Description of Artificial Sequence: Synthetic peptide
SQGKSSS

SEQ ID NO: 10190 - protein, 7 aa, Artificial Sequence
  Description of Artificial Sequence: Synthetic peptide
TPTGAGG

SEQ ID NO: 10191 - protein, 7 aa, Artificial Sequence
  Description of Artificial Sequence: Synthetic peptide
SNDAGKN

SEQ ID NO: 10192 - protein, 7 aa, Artificial Sequence
  Description of Artificial Sequence: Synthetic peptide
APGRDSS

SEQ ID NO: 10193 - protein, 7 aa, Artificial Sequence
  Description of Artificial Sequence: Synthetic peptide
GNSTSSS

SEQ ID NO: 10194 - protein, 7 aa, Artificial Sequence
  Description of Artificial Sequence: Synthetic peptide
SSGSSMG

SEQ ID NO: 10195 - protein, 7 aa, Artificial Sequence
  Description of Artificial Sequence: Synthetic peptide
SHGQGPQ

SEQ ID NO: 10196 - protein, 7 aa, Artificial Sequence
  Description of Artificial Sequence: Synthetic peptide
TNESTLR

SEQ ID NO: 10197 - protein, 7 aa, Artificial Sequence
  Description of Artificial Sequence: Synthetic peptide
SSGQPGR

SEQ ID NO: 10198 - protein, 7 aa, Artificial Sequence
  Description of Artificial Sequence: Synthetic peptide
QQMDNKT

SEQ ID NO: 10199 - protein, 7 aa, Artificial Sequence
  Description of Artificial Sequence: Synthetic peptide
ADGQSSS

SEQ ID NO: 10200 - protein, 7 aa, Artificial Sequence
  Description of Artificial Sequence: Synthetic peptide
GGPSSDR

SEQ ID NO: 10201 - protein, 7 aa, Artificial Sequence
  Description of Artificial Sequence: Synthetic peptide
NPVAQGN

SEQ ID NO: 10202 - protein, 7 aa, Artificial Sequence
  Description of Artificial Sequence: Synthetic peptide
NNDKSGL

SEQ ID NO: 10203 - protein, 7 aa, Artificial Sequence
  Description of Artificial Sequence: Synthetic peptide
TSSSEKA

SEQ ID NO: 10204 - protein, 7 aa, Artificial Sequence
  Description of Artificial Sequence: Synthetic peptide
ITNSATR

SEQ ID NO: 10205 - protein, 7 aa, Artificial Sequence
  Description of Artificial Sequence: Synthetic peptide
QAAKDQH

SEQ ID NO: 10206 - protein, 7 aa, Artificial Sequence
  Description of Artificial Sequence: Synthetic peptide
HSSTGGS

SEQ ID NO: 10207 - protein, 7 aa, Artificial Sequence
  Description of Artificial Sequence: Synthetic peptide
ESGSQNR

SEQ ID NO: 10208 - protein, 7 aa, Artificial Sequence
  Description of Artificial Sequence: Synthetic peptide
AEGKTAA

SEQ ID NO: 10209 - protein, 7 aa, Artificial Sequence
  Description of Artificial Sequence: Synthetic peptide
GTGANTT

SEQ ID NO: 10210 - protein, 7 aa, Artificial Sequence
  Description of Artificial Sequence: Synthetic peptide
GMASADK

SEQ ID NO: 10211 - protein, 7 aa, Artificial Sequence
  Description of Artificial Sequence: Synthetic peptide
YKAGQQQ

SEQ ID NO: 10212 - protein, 7 aa, Artificial Sequence
  Description of Artificial Sequence: Synthetic peptide
FQGSKAG

SEQ ID NO: 10213 - protein, 7 aa, Artificial Sequence
  Description of Artificial Sequence: Synthetic peptide
SRGQSSN

SEQ ID NO: 10214 - protein, 7 aa, Artificial Sequence
  Description of Artificial Sequence: Synthetic peptide
KGSSNST

SEQ ID NO: 10215 - protein, 7 aa, Artificial Sequence
  Description of Artificial Sequence: Synthetic peptide
SPSSKPS

SEQ ID NO: 10216 - protein, 7 aa, Artificial Sequence
  Description of Artificial Sequence: Synthetic peptide
SSATASA

SEQ ID NO: 10217 - protein, 7 aa, Artificial Sequence
  Description of Artificial Sequence: Synthetic peptide
KTDTSAH

SEQ ID NO: 10218 - protein, 7 aa, Artificial Sequence
  Description of Artificial Sequence: Synthetic peptide
GNAPPTR

SEQ ID NO: 10219 - protein, 7 aa, Artificial Sequence
  Description of Artificial Sequence: Synthetic peptide
SQNHTSS

SEQ ID NO: 10220 - protein, 7 aa, Artificial Sequence
  Description of Artificial Sequence: Synthetic peptide
SDNKTHT

SEQ ID NO: 10221 - protein, 7 aa, Artificial Sequence
  Description of Artificial Sequence: Synthetic peptide
GVENPRA

SEQ ID NO: 10222 - protein, 7 aa, Artificial Sequence
  Description of Artificial Sequence: Synthetic peptide
SQPSSVG

SEQ ID NO: 10223 - protein, 7 aa, Artificial Sequence
  Description of Artificial Sequence: Synthetic peptide
DSSATKL

SEQ ID NO: 10224 - protein, 7 aa, Artificial Sequence
  Description of Artificial Sequence: Synthetic peptide
VPNSSAG

SEQ ID NO: 10225 - protein, 7 aa, Artificial Sequence
  Description of Artificial Sequence: Synthetic peptide
SSSNKPG

SEQ ID NO: 10226 - protein, 7 aa, Artificial Sequence
  Description of Artificial Sequence: Synthetic peptide
CTGTPSG

SEQ ID NO: 10227 - protein, 7 aa, Artificial Sequence
  Description of Artificial Sequence: Synthetic peptide
LTNTASQ

SEQ ID NO: 10228 - protein, 7 aa, Artificial Sequence
  Description of Artificial Sequence: Synthetic peptide
VSGGAAR

SEQ ID NO: 10229 - protein, 7 aa, Artificial Sequence
  Description of Artificial Sequence: Synthetic peptide
VSKQQSA

SEQ ID NO: 10230 - protein, 7 aa, Artificial Sequence
  Description of Artificial Sequence: Synthetic peptide
GVNPSAS

SEQ ID NO: 10231 - protein, 7 aa, Artificial Sequence
  Description of Artificial Sequence: Synthetic peptide
SGSGAPA

SEQ ID NO: 10232 - protein, 7 aa, Artificial Sequence
  Description of Artificial Sequence: Synthetic peptide
QSSNSNA

SEQ ID NO: 10233 - protein, 7 aa, Artificial Sequence
  Description of Artificial Sequence: Synthetic peptide
TATASNQ

SEQ ID NO: 10234 - protein, 7 aa, Artificial Sequence
  Description of Artificial Sequence: Synthetic peptide
GDGRSPN

SEQ ID NO: 10235 - protein, 7 aa, Artificial Sequence
  Description of Artificial Sequence: Synthetic peptide
KSVPSVS

SEQ ID NO: 10236 - protein, 7 aa, Artificial Sequence
  Description of Artificial Sequence: Synthetic peptide
NQSSGGS

SEQ ID NO: 10237 - protein, 7 aa, Artificial Sequence
  Description of Artificial Sequence: Synthetic peptide
SSEKPAS

SEQ ID NO: 10238 - protein, 7 aa, Artificial Sequence
  Description of Artificial Sequence: Synthetic peptide
STKASNG

SEQ ID NO: 10239 - protein, 7 aa, Artificial Sequence
  Description of Artificial Sequence: Synthetic peptide
ISSSKVV

SEQ ID NO: 10240 - protein, 7 aa, Artificial Sequence
  Description of Artificial Sequence: Synthetic peptide
QSSSSTS

SEQ ID NO: 10241 - protein, 7 aa, Artificial Sequence
  Description of Artificial Sequence: Synthetic peptide
ERVPSSG

SEQ ID NO: 10242 - protein, 7 aa, Artificial Sequence
  Description of Artificial Sequence: Synthetic peptide
DNRSSNA

SEQ ID NO: 10243 - protein, 7 aa, Artificial Sequence
  Description of Artificial Sequence: Synthetic peptide
GAVDSVK

SEQ ID NO: 10244 - protein, 7 aa, Artificial Sequence
  Description of Artificial Sequence: Synthetic peptide
VTQGEMK

SEQ ID NO: 10245 - protein, 7 aa, Artificial Sequence
  Description of Artificial Sequence: Synthetic peptide
VAQNAPT

SEQ ID NO: 10246 - protein, 7 aa, Artificial Sequence
  Description of Artificial Sequence: Synthetic peptide
VNNSPSQ

SEQ ID NO: 10247 - protein, 7 aa, Artificial Sequence
  Description of Artificial Sequence: Synthetic peptide
LSGTASN

SEQ ID NO: 10248 - protein, 7 aa, Artificial Sequence
  Description of Artificial Sequence: Synthetic peptide
EGRASSV

SEQ ID NO: 10249 - protein, 7 aa, Artificial Sequence
  Description of Artificial Sequence: Synthetic peptide
DGAATVK

SEQ ID NO: 10250 - protein, 7 aa, Artificial Sequence
  Description of Artificial Sequence: Synthetic peptide
VQGKVTN

SEQ ID NO: 10251 - protein, 7 aa, Artificial Sequence
  Description of Artificial Sequence: Synthetic peptide
NSTKDGS

SEQ ID NO: 10252 - protein, 7 aa, Artificial Sequence
  Description of Artificial Sequence: Synthetic peptide
SNRESIQ

SEQ ID NO: 10253 - protein, 7 aa, Artificial Sequence
  Description of Artificial Sequence: Synthetic peptide
SSSKPKD

SEQ ID NO: 10254 - protein, 7 aa, Artificial Sequence
  Description of Artificial Sequence: Synthetic peptide
HAKNSNG

SEQ ID NO: 10255 - protein, 7 aa, Artificial Sequence
  Description of Artificial Sequence: Synthetic peptide
LDGSKMG

SEQ ID NO: 10256 - protein, 7 aa, Artificial Sequence
  Description of Artificial Sequence: Synthetic peptide
VSTGATR

SEQ ID NO: 10257 - protein, 7 aa, Artificial Sequence
  Description of Artificial Sequence: Synthetic peptide
SSDKIRS

SEQ ID NO: 10258 - protein, 7 aa, Artificial Sequence
  Description of Artificial Sequence: Synthetic peptide
NEVRQSN

SEQ ID NO: 10259 - protein, 7 aa, Artificial Sequence
  Description of Artificial Sequence: Synthetic peptide
LTGDQVK

SEQ ID NO: 10260 - protein, 7 aa, Artificial Sequence
  Description of Artificial Sequence: Synthetic peptide
EPGTSAQ

SEQ ID NO: 10261 - protein, 7 aa, Artificial Sequence
  Description of Artificial Sequence: Synthetic peptide
AEMKPVL

SEQ ID NO: 10262 - protein, 7 aa, Artificial Sequence
  Description of Artificial Sequence: Synthetic peptide
TSTGTLK

SEQ ID NO: 10263 - protein, 7 aa, Artificial Sequence
  Description of Artificial Sequence: Synthetic peptide
SGTSSPN

SEQ ID NO: 10264 - protein, 7 aa, Artificial Sequence
  Description of Artificial Sequence: Synthetic peptide
HQPEPRG

SEQ ID NO: 10265 - protein, 7 aa, Artificial Sequence
  Description of Artificial Sequence: Synthetic peptide
HSGGTSH

SEQ ID NO: 10266 - protein, 7 aa, Artificial Sequence
  Description of Artificial Sequence: Synthetic peptide
LSKSTSG

SEQ ID NO: 10267 - protein, 7 aa, Artificial Sequence
  Description of Artificial Sequence: Synthetic peptide
DKVGSPP

SEQ ID NO: 10268 - protein, 7 aa, Artificial Sequence
  Description of Artificial Sequence: Synthetic peptide
DTQKSSH

SEQ ID NO: 10269 - protein, 7 aa, Artificial Sequence
  Description of Artificial Sequence: Synthetic peptide
TDKPASR

SEQ ID NO: 10270 - protein, 7 aa, Artificial Sequence
  Description of Artificial Sequence: Synthetic peptide
SNSPGGL

SEQ ID NO: 10271 - protein, 7 aa, Artificial Sequence
  Description of Artificial Sequence: Synthetic peptide
DSANTKA

SEQ ID NO: 10272 - protein, 7 aa, Artificial Sequence
  Description of Artificial Sequence: Synthetic peptide
GLNKTTE

SEQ ID NO: 10273 - protein, 7 aa, Artificial Sequence
  Description of Artificial Sequence: Synthetic peptide
GVQGDSM

SEQ ID NO: 10274 - protein, 7 aa, Artificial Sequence
  Description of Artificial Sequence: Synthetic peptide
ASVKSQP

SEQ ID NO: 10275 - protein, 7 aa, Artificial Sequence
  Description of Artificial Sequence: Synthetic peptide
QGTSPTV

SEQ ID NO: 10276 - protein, 7 aa, Artificial Sequence
  Description of Artificial Sequence: Synthetic peptide
TGLQSSS

SEQ ID NO: 10277 - protein, 7 aa, Artificial Sequence
  Description of Artificial Sequence: Synthetic peptide
MPLKSGV

SEQ ID NO: 10278 - protein, 7 aa, Artificial Sequence
  Description of Artificial Sequence: Synthetic peptide
STTSANV

SEQ ID NO: 10279 - protein, 7 aa, Artificial Sequence
  Description of Artificial Sequence: Synthetic peptide
ATSGDRT

SEQ ID NO: 10280 - protein, 7 aa, Artificial Sequence
  Description of Artificial Sequence: Synthetic peptide
VSGNHSA

SEQ ID NO: 10281 - protein, 7 aa, Artificial Sequence
  Description of Artificial Sequence: Synthetic peptide
EPSRAAQ

SEQ ID NO: 10282 - protein, 7 aa, Artificial Sequence
  Description of Artificial Sequence: Synthetic peptide
QDGSNRS

SEQ ID NO: 10283 - protein, 7 aa, Artificial Sequence
  Description of Artificial Sequence: Synthetic peptide
NSSPGLN

SEQ ID NO: 10284 - protein, 7 aa, Artificial Sequence
  Description of Artificial Sequence: Synthetic peptide
MGSSPNI

SEQ ID NO: 10285 - protein, 7 aa, Artificial Sequence
  Description of Artificial Sequence: Synthetic peptide
HTQDKLS

SEQ ID NO: 10286 - protein, 7 aa, Artificial Sequence
  Description of Artificial Sequence: Synthetic peptide
LNSTSTT

SEQ ID NO: 10287 - protein, 7 aa, Artificial Sequence
  Description of Artificial Sequence: Synthetic peptide
LGGTTGK

SEQ ID NO: 10288 - protein, 7 aa, Artificial Sequence
  Description of Artificial Sequence: Synthetic peptide
DSGNDRS

SEQ ID NO: 10289 - protein, 7 aa, Artificial Sequence
  Description of Artificial Sequence: Synthetic peptide
AAEGNKK

SEQ ID NO: 10290 - protein, 7 aa, Artificial Sequence
  Description of Artificial Sequence: Synthetic peptide
GGTKSAV

SEQ ID NO: 10291 - protein, 7 aa, Artificial Sequence
  Description of Artificial Sequence: Synthetic peptide
SDKERGR

SEQ ID NO: 10292 - protein, 7 aa, Artificial Sequence
  Description of Artificial Sequence: Synthetic peptide
VSSSTVS

SEQ ID NO: 10293 - protein, 7 aa, Artificial Sequence
  Description of Artificial Sequence: Synthetic peptide
ESPQQSA

SEQ ID NO: 10294 - protein, 7 aa, Artificial Sequence
  Description of Artificial Sequence: Synthetic peptide
QSNGAVS

SEQ ID NO: 10295 - protein, 7 aa, Artificial Sequence
  Description of Artificial Sequence: Synthetic peptide
RTGNTSM

SEQ ID NO: 10296 - protein, 7 aa, Artificial Sequence
  Description of Artificial Sequence: Synthetic peptide
GSSKTAP

SEQ ID NO: 10297 - protein, 7 aa, Artificial Sequence
  Description of Artificial Sequence: Synthetic peptide
SQSASHS

SEQ ID NO: 10298 - protein, 7 aa, Artificial Sequence
  Description of Artificial Sequence: Synthetic peptide
SHASNNV

SEQ ID NO: 10299 - protein, 7 aa, Artificial Sequence
  Description of Artificial Sequence: Synthetic peptide
SSAKGSG

SEQ ID NO: 10300 - protein, 7 aa, Artificial Sequence
  Description of Artificial Sequence: Synthetic peptide
SGSTSMV

SEQ ID NO: 10301 - protein, 7 aa, Artificial Sequence
  Description of Artificial Sequence: Synthetic peptide
IPKQSVG

SEQ ID NO: 10302 - protein, 7 aa, Artificial Sequence
  Description of Artificial Sequence: Synthetic peptide
QGNQTPV

SEQ ID NO: 10303 - protein, 7 aa, Artificial Sequence
  Description of Artificial Sequence: Synthetic peptide
TDKGAGS

SEQ ID NO: 10304 - protein, 7 aa, Artificial Sequence
  Description of Artificial Sequence: Synthetic peptide
ISEGTAR

SEQ ID NO: 10305 - protein, 7 aa, Artificial Sequence
  Description of Artificial Sequence: Synthetic peptide
GSLSQSG

SEQ ID NO: 10306 - protein, 7 aa, Artificial Sequence
  Description of Artificial Sequence: Synthetic peptide
GPDSALR

SEQ ID NO: 10307 - protein, 7 aa, Artificial Sequence
  Description of Artificial Sequence: Synthetic peptide
GSLPQDR

SEQ ID NO: 10308 - protein, 7 aa, Artificial Sequence
  Description of Artificial Sequence: Synthetic peptide
KIETGGG

SEQ ID NO: 10309 - protein, 7 aa, Artificial Sequence
  Description of Artificial Sequence: Synthetic peptide
HGENVQG

SEQ ID NO: 10310 - protein, 7 aa, Artificial Sequence
  Description of Artificial Sequence: Synthetic peptide
DSANTHK

SEQ ID NO: 10311 - protein, 7 aa, Artificial Sequence
  Description of Artificial Sequence: Synthetic peptide
GSEKERH

SEQ ID NO: 10312 - protein, 7 aa, Artificial Sequence
  Description of Artificial Sequence: Synthetic peptide
GLVKEGS

SEQ ID NO: 10313 - protein, 7 aa, Artificial Sequence
  Description of Artificial Sequence: Synthetic peptide
VASRSNG

SEQ ID NO: 10314 - protein, 7 aa, Artificial Sequence
  Description of Artificial Sequence: Synthetic peptide
DAAVARS

SEQ ID NO: 10315 - protein, 7 aa, Artificial Sequence
  Description of Artificial Sequence: Synthetic peptide
SPQNNGS

SEQ ID NO: 10316 - protein, 7 aa, Artificial Sequence
  Description of Artificial Sequence: Synthetic peptide
GSTPGLS

SEQ ID NO: 10317 - protein, 7 aa, Artificial Sequence
  Description of Artificial Sequence: Synthetic peptide
SASGSGN

SEQ ID NO: 10318 - protein, 7 aa, Artificial Sequence
  Description of Artificial Sequence: Synthetic peptide
QGAPING

SEQ ID NO: 10319 - protein, 7 aa, Artificial Sequence
  Description of Artificial Sequence: Synthetic peptide
GSKSALQ

SEQ ID NO: 10320 - protein, 7 aa, Artificial Sequence
  Description of Artificial Sequence: Synthetic peptide
SLAGGQG

SEQ ID NO: 10321 - protein, 7 aa, Artificial Sequence
  Description of Artificial Sequence: Synthetic peptide
LGKQQTG

SEQ ID NO: 10322 - protein, 7 aa, Artificial Sequence
  Description of Artificial Sequence: Synthetic peptide
IKNSQST

SEQ ID NO: 10323 - protein, 7 aa, Artificial Sequence
  Description of Artificial Sequence: Synthetic peptide
NSLDRPM

SEQ ID NO: 10324 - protein, 7 aa, Artificial Sequence
  Description of Artificial Sequence: Synthetic peptide
TTGSGAT

SEQ ID NO: 10325 - protein, 7 aa, Artificial Sequence
  Description of Artificial Sequence: Synthetic peptide
TSGSRNG

SEQ ID NO: 10326 - protein, 7 aa, Artificial Sequence
  Description of Artificial Sequence: Synthetic peptide
QPGSERQ

SEQ ID NO: 10327 - protein, 7 aa, Artificial Sequence
  Description of Artificial Sequence: Synthetic peptide
MQSAPST

SEQ ID NO: 10328 - protein, 7 aa, Artificial Sequence
  Description of Artificial Sequence: Synthetic peptide
RESDSPK

SEQ ID NO: 10329 - protein, 7 aa, Artificial Sequence
  Description of Artificial Sequence: Synthetic peptide
QPVSKTA

SEQ ID NO: 10330 - protein, 7 aa, Artificial Sequence
  Description of Artificial Sequence: Synthetic peptide
SGQPVKG

SEQ ID NO: 10331 - protein, 7 aa, Artificial Sequence
  Description of Artificial Sequence: Synthetic peptide
SGLSSKQ

SEQ ID NO: 10332 - protein, 7 aa, Artificial Sequence
  Description of Artificial Sequence: Synthetic peptide
QPTDGSK

SEQ ID NO: 10333 - protein, 7 aa, Artificial Sequence
  Description of Artificial Sequence: Synthetic peptide
EGNSIHK

SEQ ID NO: 10334 - protein, 7 aa, Artificial Sequence
  Description of Artificial Sequence: Synthetic peptide
TTTQAKM

SEQ ID NO: 10335 - protein, 7 aa, Artificial Sequence
  Description of Artificial Sequence: Synthetic peptide
NAASKPL

SEQ ID NO: 10336 - protein, 7 aa, Artificial Sequence
  Description of Artificial Sequence: Synthetic peptide
GAGNQPK

SEQ ID NO: 10337 - protein, 7 aa, Artificial Sequence
  Description of Artificial Sequence: Synthetic peptide
GKVDKDK

SEQ ID NO: 10338 - protein, 7 aa, Artificial Sequence
  Description of Artificial Sequence: Synthetic peptide
AGVQGAT

SEQ ID NO: 10339 - protein, 7 aa, Artificial Sequence
  Description of Artificial Sequence: Synthetic peptide
SPDVKVA

SEQ ID NO: 10340 - protein, 7 aa, Artificial Sequence
  Description of Artificial Sequence: Synthetic peptide
IPSSKAV

SEQ ID NO: 10341 - protein, 7 aa, Artificial Sequence
  Description of Artificial Sequence: Synthetic peptide
DQGSHNR

SEQ ID NO: 10342 - protein, 7 aa, Artificial Sequence
  Description of Artificial Sequence: Synthetic peptide
KAEANTQ

SEQ ID NO: 10343 - protein, 7 aa, Artificial Sequence
  Description of Artificial Sequence: Synthetic peptide
KDSAGGS

SEQ ID NO: 10344 - protein, 7 aa, Artificial Sequence
  Description of Artificial Sequence: Synthetic peptide
TAEKSLV

SEQ ID NO: 10345 - protein, 7 aa, Artificial Sequence
  Description of Artificial Sequence: Synthetic peptide
SVAHTSA

SEQ ID NO: 10346 - protein, 7 aa, Artificial Sequence
  Description of Artificial Sequence: Synthetic peptide
NPEAKSK

SEQ ID NO: 10347 - protein, 7 aa, Artificial Sequence
  Description of Artificial Sequence: Synthetic peptide
QGTSVSG

SEQ ID NO: 10348 - protein, 7 aa, Artificial Sequence
  Description of Artificial Sequence: Synthetic peptide
ATNKAGL

SEQ ID NO: 10349 - protein, 7 aa, Artificial Sequence
  Description of Artificial Sequence: Synthetic peptide
STSQSNL

SEQ ID NO: 10350 - protein, 7 aa, Artificial Sequence
  Description of Artificial Sequence: Synthetic peptide
HAGEHRT

SEQ ID NO: 10351 - protein, 7 aa, Artificial Sequence
  Description of Artificial Sequence: Synthetic peptide
GSSSQSS

SEQ ID NO: 10352 - protein, 7 aa, Artificial Sequence
  Description of Artificial Sequence: Synthetic peptide
TVGSERS

SEQ ID NO: 10353 - protein, 7 aa, Artificial Sequence
  Description of Artificial Sequence: Synthetic peptide
HSSGSNA

SEQ ID NO: 10354 - protein, 7 aa, Artificial Sequence
  Description of Artificial Sequence: Synthetic peptide
RSGNGIS

SEQ ID NO: 10355 - protein, 7 aa, Artificial Sequence
  Description of Artificial Sequence: Synthetic peptide
DSQRSNQ

SEQ ID NO: 10356 - protein, 7 aa, Artificial Sequence
  Description of Artificial Sequence: Synthetic peptide
DSHKGSK

SEQ ID NO: 10357 - protein, 7 aa, Artificial Sequence
  Description of Artificial Sequence: Synthetic peptide
GTSKSER

SEQ ID NO: 10358 - protein, 7 aa, Artificial Sequence
  Description of Artificial Sequence: Synthetic peptide
VATNTPK

SEQ ID NO: 10359 - protein, 7 aa, Artificial Sequence
  Description of Artificial Sequence: Synthetic peptide
SGGQSAH

SEQ ID NO: 10360 - protein, 7 aa, Artificial Sequence
  Description of Artificial Sequence: Synthetic peptide
SGVDLKT

SEQ ID NO: 10361 - protein, 7 aa, Artificial Sequence
  Description of Artificial Sequence: Synthetic peptide
TAGSQHT

SEQ ID NO: 10362 - protein, 7 aa, Artificial Sequence
  Description of Artificial Sequence: Synthetic peptide
HQSGSGS

SEQ ID NO: 10363 - protein, 7 aa, Artificial Sequence
  Description of Artificial Sequence: Synthetic peptide
GDGPPTR

SEQ ID NO: 10364 - protein, 7 aa, Artificial Sequence
  Description of Artificial Sequence: Synthetic peptide
KQLSATT

SEQ ID NO: 10365 - protein, 7 aa, Artificial Sequence
  Description of Artificial Sequence: Synthetic peptide
SSAKASP

SEQ ID NO: 10366 - protein, 7 aa, Artificial Sequence
  Description of Artificial Sequence: Synthetic peptide
HPSQASK

SEQ ID NO: 10367 - protein, 7 aa, Artificial Sequence
  Description of Artificial Sequence: Synthetic peptide
ERNSKLS

SEQ ID NO: 10368 - protein, 7 aa, Artificial Sequence
  Description of Artificial Sequence: Synthetic peptide
VPDTGRK

SEQ ID NO: 10369 - protein, 7 aa, Artificial Sequence
  Description of Artificial Sequence: Synthetic peptide
ESKPSSG

SEQ ID NO: 10370 - protein, 7 aa, Artificial Sequence
  Description of Artificial Sequence: Synthetic peptide
SISTPTS

SEQ ID NO: 10371 - protein, 7 aa, Artificial Sequence
  Description of Artificial Sequence: Synthetic peptide
AQGSPIN

SEQ ID NO: 10372 - protein, 7 aa, Artificial Sequence
  Description of Artificial Sequence: Synthetic peptide
QPNSPSV

SEQ ID NO: 10373 - protein, 7 aa, Artificial Sequence
  Description of Artificial Sequence: Synthetic peptide
GVNSASH

SEQ ID NO: 10374 - protein, 7 aa, Artificial Sequence
  Description of Artificial Sequence: Synthetic peptide
TSNTKQG

SEQ ID NO: 10375 - protein, 7 aa, Artificial Sequence
  Description of Artificial Sequence: Synthetic peptide
ESSSSVS

SEQ ID NO: 10376 - protein, 7 aa, Artificial Sequence
  Description of Artificial Sequence: Synthetic peptide
VNAKPSL

SEQ ID NO: 10377 - protein, 7 aa, Artificial Sequence
  Description of Artificial Sequence: Synthetic peptide
GRDVPTR

SEQ ID NO: 10378 - protein, 7 aa, Artificial Sequence
  Description of Artificial Sequence: Synthetic peptide
EGVTKNK

SEQ ID NO: 10379 - protein, 7 aa, Artificial Sequence
  Description of Artificial Sequence: Synthetic peptide
AASPATA

SEQ ID NO: 10380 - protein, 7 aa, Artificial Sequence
  Description of Artificial Sequence: Synthetic peptide
TREGAPS

SEQ ID NO: 10381 - protein, 7 aa, Artificial Sequence
  Description of Artificial Sequence: Synthetic peptide
NVNKIRD

SEQ ID NO: 10382 - protein, 7 aa, Artificial Sequence
  Description of Artificial Sequence: Synthetic peptide
AGGKGLN

SEQ ID NO: 10383 - protein, 7 aa, Artificial Sequence
  Description of Artificial Sequence: Synthetic peptide
SGHGSNS

SEQ ID NO: 10384 - protein, 7 aa, Artificial Sequence
  Description of Artificial Sequence: Synthetic peptide
LEGKPNQ

SEQ ID NO: 10385 - protein, 7 aa, Artificial Sequence
  Description of Artificial Sequence: Synthetic peptide
KKATTNE

SEQ ID NO: 10386 - protein, 7 aa, Artificial Sequence
  Description of Artificial Sequence: Synthetic peptide
KSDDKTR

SEQ ID NO: 10387 - protein, 7 aa, Artificial Sequence
  Description of Artificial Sequence: Synthetic peptide
NSTSVNA

SEQ ID NO: 10388 - protein, 7 aa, Artificial Sequence
  Description of Artificial Sequence: Synthetic peptide
KEDKINS

SEQ ID NO: 10389 - protein, 7 aa, Artificial Sequence
  Description of Artificial Sequence: Synthetic peptide
KGSGSNV

SEQ ID NO: 10390 - protein, 7 aa, Artificial Sequence
  Description of Artificial Sequence: Synthetic peptide
NIGSQKG

SEQ ID NO: 10391 - protein, 7 aa, Artificial Sequence
  Description of Artificial Sequence: Synthetic peptide
NSGQVVA

SEQ ID NO: 10392 - protein, 7 aa, Artificial Sequence
  Description of Artificial Sequence: Synthetic peptide
TTQNSSA

SEQ ID NO: 10393 - protein, 7 aa, Artificial Sequence
  Description of Artificial Sequence: Synthetic peptide
TGQHTSS

SEQ ID NO: 10394 - protein, 7 aa, Artificial Sequence
  Description of Artificial Sequence: Synthetic peptide
TRNSPGE

SEQ ID NO: 10395 - protein, 7 aa, Artificial Sequence
  Description of Artificial Sequence: Synthetic peptide
TDDRSSQ

SEQ ID NO: 10396 - protein, 7 aa, Artificial Sequence
  Description of Artificial Sequence: Synthetic peptide
TSREKIT

SEQ ID NO: 10397 - protein, 7 aa, Artificial Sequence
  Description of Artificial Sequence: Synthetic peptide
RDNTRSS

SEQ ID NO: 10398 - protein, 7 aa, Artificial Sequence
  Description of Artificial Sequence: Synthetic peptide
SKDQSTG

SEQ ID NO: 10399 - protein, 7 aa, Artificial Sequence
  Description of Artificial Sequence: Synthetic peptide
SNHGEKG

SEQ ID NO: 10400 - protein, 7 aa, Artificial Sequence
  Description of Artificial Sequence: Synthetic peptide
STNSSHA

SEQ ID NO: 10401 - protein, 7 aa, Artificial Sequence
  Description of Artificial Sequence: Synthetic peptide
SSDGTHA

SEQ ID NO: 10402 - protein, 7 aa, Artificial Sequence
  Description of Artificial Sequence: Synthetic peptide
SQKEHPT

SEQ ID NO: 10403 - protein, 7 aa, Artificial Sequence
  Description of Artificial Sequence: Synthetic peptide
SASSSLK

SEQ ID NO: 10404 - protein, 7 aa, Artificial Sequence
  Description of Artificial Sequence: Synthetic peptide
IATGLTK

SEQ ID NO: 10405 - protein, 7 aa, Artificial Sequence
  Description of Artificial Sequence: Synthetic peptide
MKDTHAS

SEQ ID NO: 10406 - protein, 7 aa, Artificial Sequence
  Description of Artificial Sequence: Synthetic peptide
QNTTSVL

SEQ ID NO: 10407 - protein, 7 aa, Artificial Sequence
  Description of Artificial Sequence: Synthetic peptide
QNATRSE

SEQ ID NO: 10408 - protein, 7 aa, Artificial Sequence
  Description of Artificial Sequence: Synthetic peptide
QHGKDLG

SEQ ID NO: 10409 - protein, 7 aa, Artificial Sequence
  Description of Artificial Sequence: Synthetic peptide
QGHDSAR

SEQ ID NO: 10410 - protein, 7 aa, Artificial Sequence
  Description of Artificial Sequence: Synthetic peptide
RNEGGMT

SEQ ID NO: 10411 - protein, 7 aa, Artificial Sequence
  Description of Artificial Sequence: Synthetic peptide
RGDNPAS

SEQ ID NO: 10412 - protein, 7 aa, Artificial Sequence
  Description of Artificial Sequence: Synthetic peptide
LATEKST

SEQ ID NO: 10413 - protein, 7 aa, Artificial Sequence
  Description of Artificial Sequence: Synthetic peptide
LTETPKS

SEQ ID NO: 10414 - protein, 7 aa, Artificial Sequence
  Description of Artificial Sequence: Synthetic peptide
ENTQGGR

SEQ ID NO: 10415 - protein, 7 aa, Artificial Sequence
  Description of Artificial Sequence: Synthetic peptide
EPTASVR

SEQ ID NO: 10416 - protein, 7 aa, Artificial Sequence
  Description of Artificial Sequence: Synthetic peptide
DNRASAT

SEQ ID NO: 10417 - protein, 7 aa, Artificial Sequence
  Description of Artificial Sequence: Synthetic peptide
DNSNKMG

SEQ ID NO: 10418 - protein, 7 aa, Artificial Sequence
  Description of Artificial Sequence: Synthetic peptide
ESSNNLK

SEQ ID NO: 10419 - protein, 7 aa, Artificial Sequence
  Description of Artificial Sequence: Synthetic peptide
DNDRGKS

SEQ ID NO: 10420 - protein, 7 aa, Artificial Sequence
  Description of Artificial Sequence: Synthetic peptide
DSHKGIS

SEQ ID NO: 10421 - protein, 7 aa, Artificial Sequence
  Description of Artificial Sequence: Synthetic peptide
ATGGGGA

SEQ ID NO: 10422 - protein, 7 aa, Artificial Sequence
  Description of Artificial Sequence: Synthetic peptide
AATGQMS

SEQ ID NO: 10423 - protein, 7 aa, Artificial Sequence
  Description of Artificial Sequence: Synthetic peptide
AASKSSE

SEQ ID NO: 10424 - protein, 7 aa, Artificial Sequence
  Description of Artificial Sequence: Synthetic peptide
AGPSSPT

SEQ ID NO: 10425 - protein, 7 aa, Artificial Sequence
  Description of Artificial Sequence: Synthetic peptide
AGAPNKT

SEQ ID NO: 10426 - protein, 7 aa, Artificial Sequence
  Description of Artificial Sequence: Synthetic peptide
ATKEGIA

SEQ ID NO: 10427 - protein, 7 aa, Artificial Sequence
  Description of Artificial Sequence: Synthetic peptide
ANSSTEK

SEQ ID NO: 10428 - protein, 7 aa, Artificial Sequence
  Description of Artificial Sequence: Synthetic peptide
ADRPTTV

SEQ ID NO: 10429 - protein, 7 aa, Artificial Sequence
  Description of Artificial Sequence: Synthetic peptide
GNSQSSG

SEQ ID NO: 10430 - protein, 7 aa, Artificial Sequence
  Description of Artificial Sequence: Synthetic peptide
GTTTAGR

SEQ ID NO: 10431 - protein, 7 aa, Artificial Sequence
  Description of Artificial Sequence: Synthetic peptide
GTLADTK

SEQ ID NO: 10432 - protein, 7 aa, Artificial Sequence
  Description of Artificial Sequence: Synthetic peptide
GSKTDMR

SEQ ID NO: 10433 - protein, 7 aa, Artificial Sequence
  Description of Artificial Sequence: Synthetic peptide
GGISNSA

SEQ ID NO: 10434 - protein, 7 aa, Artificial Sequence
  Description of Artificial Sequence: Synthetic peptide
GVPLSTG

SEQ ID NO: 10435 - protein, 7 aa, Artificial Sequence
  Description of Artificial Sequence: Synthetic peptide
GVNRDAA

SEQ ID NO: 10436 - protein, 7 aa, Artificial Sequence
  Description of Artificial Sequence: Synthetic peptide
GTTGQMV

SEQ ID NO: 10437 - protein, 7 aa, Artificial Sequence
  Description of Artificial Sequence: Synthetic peptide
GTTLSEK

SEQ ID NO: 10438 - protein, 7 aa, Artificial Sequence
  Description of Artificial Sequence: Synthetic peptide
GLDTQKA

SEQ ID NO: 10439 - protein, 7 aa, Artificial Sequence
  Description of Artificial Sequence: Synthetic peptide
GGLQEVK

SEQ ID NO: 10440 - protein, 7 aa, Artificial Sequence
  Description of Artificial Sequence: Synthetic peptide
VGSSGHV

SEQ ID NO: 10441 - protein, 7 aa, Artificial Sequence
  Description of Artificial Sequence: Synthetic peptide
VGQRDTG

SEQ ID NO: 10442 - protein, 7 aa, Artificial Sequence
  Description of Artificial Sequence: Synthetic peptide
VNNSSTT

SEQ ID NO: 10443 - protein, 7 aa, Artificial Sequence
  Description of Artificial Sequence: Synthetic peptide
VTQSANG

SEQ ID NO: 10444 - protein, 7 aa, Artificial Sequence
  Description of Artificial Sequence: Synthetic peptide
VTSNSSV

SEQ ID NO: 10445 - protein, 7 aa, Artificial Sequence
  Description of Artificial Sequence: Synthetic peptide
YGDSPKN

SEQ ID NO: 10446 - protein, 7 aa, Artificial Sequence
  Description of Artificial Sequence: Synthetic peptide
SGSQAVL

SEQ ID NO: 10447 - protein, 7 aa, Artificial Sequence
  Description of Artificial Sequence: Synthetic peptide
SPPEHKV

SEQ ID NO: 10448 - protein, 7 aa, Artificial Sequence
  Description of Artificial Sequence: Synthetic peptide
LATSSTG

SEQ ID NO: 10449 - protein, 7 aa, Artificial Sequence
  Description of Artificial Sequence: Synthetic peptide
SQRPSSV

SEQ ID NO: 10450 - protein, 7 aa, Artificial Sequence
  Description of Artificial Sequence: Synthetic peptide
SSRDSKS

SEQ ID NO: 10451 - protein, 7 aa, Artificial Sequence
  Description of Artificial Sequence: Synthetic peptide
GMGGQNV

SEQ ID NO: 10452 - protein, 7 aa, Artificial Sequence
  Description of Artificial Sequence: Synthetic peptide
AGRSDKG

SEQ ID NO: 10453 - protein, 7 aa, Artificial Sequence
  Description of Artificial Sequence: Synthetic peptide
SATTSER

SEQ ID NO: 10454 - protein, 7 aa, Artificial Sequence
  Description of Artificial Sequence: Synthetic peptide
SANAARN

SEQ ID NO: 10455 - protein, 7 aa, Artificial Sequence
  Description of Artificial Sequence: Synthetic peptide
SGATPPR

SEQ ID NO: 10456 - protein, 7 aa, Artificial Sequence
  Description of Artificial Sequence: Synthetic peptide
NHEGKVQ

SEQ ID NO: 10457 - protein, 7 aa, Artificial Sequence
  Description of Artificial Sequence: Synthetic peptide
VRDGSNV

SEQ ID NO: 10458 - protein, 7 aa, Artificial Sequence
  Description of Artificial Sequence: Synthetic peptide
SLTRSSV

SEQ ID NO: 10459 - protein, 7 aa, Artificial Sequence
  Description of Artificial Sequence: Synthetic peptide
QTLGGSG

SEQ ID NO: 10460 - protein, 7 aa, Artificial Sequence
  Description of Artificial Sequence: Synthetic peptide
MSDGHST

SEQ ID NO: 10461 - protein, 7 aa, Artificial Sequence
  Description of Artificial Sequence: Synthetic peptide
LTAGSGT

SEQ ID NO: 10462 - protein, 7 aa, Artificial Sequence
  Description of Artificial Sequence: Synthetic peptide
DTTSKRA

SEQ ID NO: 10463 - protein, 7 aa, Artificial Sequence
  Description of Artificial Sequence: Synthetic peptide
HTAGNNV

SEQ ID NO: 10464 - protein, 7 aa, Artificial Sequence
  Description of Artificial Sequence: Synthetic peptide
AHSAKDA

SEQ ID NO: 10465 - protein, 7 aa, Artificial Sequence
  Description of Artificial Sequence: Synthetic peptide
TTESTTR

SEQ ID NO: 10466 - protein, 7 aa, Artificial Sequence
  Description of Artificial Sequence: Synthetic peptide
TTEASNR

SEQ ID NO: 10467 - protein, 7 aa, Artificial Sequence
  Description of Artificial Sequence: Synthetic peptide
DSKSAHA

SEQ ID NO: 10468 - protein, 7 aa, Artificial Sequence
  Description of Artificial Sequence: Synthetic peptide
GGLDKGV

SEQ ID NO: 10469 - protein, 7 aa, Artificial Sequence
  Description of Artificial Sequence: Synthetic peptide
VKVGEQH

SEQ ID NO: 10470 - protein, 7 aa, Artificial Sequence
  Description of Artificial Sequence: Synthetic peptide
TKSNGNT

SEQ ID NO: 10471 - protein, 7 aa, Artificial Sequence
  Description of Artificial Sequence: Synthetic peptide
VGATPVQ

SEQ ID NO: 10472 - protein, 7 aa, Artificial Sequence
  Description of Artificial Sequence: Synthetic peptide
TNDSKSK

SEQ ID NO: 10473 - protein, 7 aa, Artificial Sequence
  Description of Artificial Sequence: Synthetic peptide
MASNSPV

SEQ ID NO: 10474 - protein, 7 aa, Artificial Sequence
  Description of Artificial Sequence: Synthetic peptide
EPADKGT

SEQ ID NO: 10475 - protein, 7 aa, Artificial Sequence
  Description of Artificial Sequence: Synthetic peptide
VTTAGGS

SEQ ID NO: 10476 - protein, 7 aa, Artificial Sequence
  Description of Artificial Sequence: Synthetic peptide
VSTSSTR

SEQ ID NO: 10477 - protein, 7 aa, Artificial Sequence
  Description of Artificial Sequence: Synthetic peptide
ANSTKTM

SEQ ID NO: 10478 - protein, 7 aa, Artificial Sequence
  Description of Artificial Sequence: Synthetic peptide
DKVRDTQ

SEQ ID NO: 10479 - protein, 7 aa, Artificial Sequence
  Description of Artificial Sequence: Synthetic peptide
GPVGSSQ

SEQ ID NO: 10480 - protein, 7 aa, Artificial Sequence
  Description of Artificial Sequence: Synthetic peptide
MKTESQM

SEQ ID NO: 10481 - protein, 7 aa, Artificial Sequence
  Description of Artificial Sequence: Synthetic peptide
TTDKGRD

SEQ ID NO: 10482 - protein, 7 aa, Artificial Sequence
  Description of Artificial Sequence: Synthetic peptide
RQGDGGV

SEQ ID NO: 10483 - protein, 7 aa, Artificial Sequence
  Description of Artificial Sequence: Synthetic peptide
GSSNSAS

SEQ ID NO: 10484 - protein, 7 aa, Artificial Sequence
  Description of Artificial Sequence: Synthetic peptide
GQVGTHP

SEQ ID NO: 10485 - protein, 7 aa, Artificial Sequence
  Description of Artificial Sequence: Synthetic peptide
SEVAQKS

SEQ ID NO: 10486 - protein, 7 aa, Artificial Sequence
  Description of Artificial Sequence: Synthetic peptide
HGTSSTS

SEQ ID NO: 10487 - protein, 7 aa, Artificial Sequence
  Description of Artificial Sequence: Synthetic peptide
GAEGSIR

SEQ ID NO: 10488 - protein, 7 aa, Artificial Sequence
  Description of Artificial Sequence: Synthetic peptide
FEQGSRS

SEQ ID NO: 10489 - protein, 7 aa, Artificial Sequence
  Description of Artificial Sequence: Synthetic peptide
ANKSSAM

SEQ ID NO: 10490 - protein, 7 aa, Artificial Sequence
  Description of Artificial Sequence: Synthetic peptide
LDKNGSA

SEQ ID NO: 10491 - protein, 7 aa, Artificial Sequence
  Description of Artificial Sequence: Synthetic peptide
EKSNSNG

SEQ ID NO: 10492 - protein, 7 aa, Artificial Sequence
  Description of Artificial Sequence: Synthetic peptide
GSNQRTT

SEQ ID NO: 10493 - protein, 7 aa, Artificial Sequence
  Description of Artificial Sequence: Synthetic peptide
SGSSPFK

SEQ ID NO: 10494 - protein, 7 aa, Artificial Sequence
  Description of Artificial Sequence: Synthetic peptide
RNAEKAV

SEQ ID NO: 10495 - protein, 7 aa, Artificial Sequence
  Description of Artificial Sequence: Synthetic peptide
SQEKNSA

SEQ ID NO: 10496 - protein, 7 aa, Artificial Sequence
  Description of Artificial Sequence: Synthetic peptide
QNGKQAP

SEQ ID NO: 10497 - protein, 7 aa, Artificial Sequence
  Description of Artificial Sequence: Synthetic peptide
RQNSKDT

SEQ ID NO: 10498 - protein, 7 aa, Artificial Sequence
  Description of Artificial Sequence: Synthetic peptide
ASEKASL

SEQ ID NO: 10499 - protein, 7 aa, Artificial Sequence
  Description of Artificial Sequence: Synthetic peptide
LGSNSPT

SEQ ID NO: 10500 - protein, 7 aa, Artificial Sequence
  Description of Artificial Sequence: Synthetic peptide
TSESKSA

SEQ ID NO: 10501 - protein, 7 aa, Artificial Sequence
  Description of Artificial Sequence: Synthetic peptide
NAGAQNR

SEQ ID NO: 10502 - protein, 7 aa, Artificial Sequence
  Description of Artificial Sequence: Synthetic peptide
MSTSGHH

SEQ ID NO: 10503 - protein, 7 aa, Artificial Sequence
  Description of Artificial Sequence: Synthetic peptide
QGPERGG

SEQ ID NO: 10504 - protein, 7 aa, Artificial Sequence
  Description of Artificial Sequence: Synthetic peptide
LGHGNHS

SEQ ID NO: 10505 - protein, 7 aa, Artificial Sequence
  Description of Artificial Sequence: Synthetic peptide
ESVDRSR

SEQ ID NO: 10506 - protein, 7 aa, Artificial Sequence
  Description of Artificial Sequence: Synthetic peptide
ARSPGSG

SEQ ID NO: 10507 - protein, 7 aa, Artificial Sequence
  Description of Artificial Sequence: Synthetic peptide
VSNPGNQ

SEQ ID NO: 10508 - protein, 7 aa, Artificial Sequence
  Description of Artificial Sequence: Synthetic peptide
GTTDSRA

SEQ ID NO: 10509 - protein, 7 aa, Artificial Sequence
  Description of Artificial Sequence: Synthetic peptide
AGNNDQK

SEQ ID NO: 10510 - protein, 7 aa, Artificial Sequence
  Description of Artificial Sequence: Synthetic peptide
TPAVNNV

SEQ ID NO: 10511 - protein, 7 aa, Artificial Sequence
  Description of Artificial Sequence: Synthetic peptide
HRNTDVS

SEQ ID NO: 10512 - protein, 7 aa, Artificial Sequence
  Description of Artificial Sequence: Synthetic peptide
DMNSVSK

SEQ ID NO: 10513 - protein, 7 aa, Artificial Sequence
  Description of Artificial Sequence: Synthetic peptide
GSESGSH

SEQ ID NO: 10514 - protein, 7 aa, Artificial Sequence
  Description of Artificial Sequence: Synthetic peptide
AVGASSS

SEQ ID NO: 10515 - protein, 7 aa, Artificial Sequence
  Description of Artificial Sequence: Synthetic peptide
QPSQTPK

SEQ ID NO: 10516 - protein, 7 aa, Artificial Sequence
  Description of Artificial Sequence: Synthetic peptide
SPNQPSA

SEQ ID NO: 10517 - protein, 7 aa, Artificial Sequence
  Description of Artificial Sequence: Synthetic peptide
ADGGKTN

SEQ ID NO: 10518 - protein, 7 aa, Artificial Sequence
  Description of Artificial Sequence: Synthetic peptide
KGASASM

SEQ ID NO: 10519 - protein, 7 aa, Artificial Sequence
  Description of Artificial Sequence: Synthetic peptide
NSPSKST

SEQ ID NO: 10520 - protein, 7 aa, Artificial Sequence
  Description of Artificial Sequence: Synthetic peptide
TMDSRRD

SEQ ID NO: 10521 - protein, 7 aa, Artificial Sequence
  Description of Artificial Sequence: Synthetic peptide
TSGLTST

SEQ ID NO: 10522 - protein, 7 aa, Artificial Sequence
  Description of Artificial Sequence: Synthetic peptide
SSSSTGG

SEQ ID NO: 10523 - protein, 7 aa, Artificial Sequence
  Description of Artificial Sequence: Synthetic peptide
SPPGSKS

SEQ ID NO: 10524 - protein, 7 aa, Artificial Sequence
  Description of Artificial Sequence: Synthetic peptide
SGNPTKV

SEQ ID NO: 10525 - protein, 7 aa, Artificial Sequence
  Description of Artificial Sequence: Synthetic peptide
EGLSQSR

SEQ ID NO: 10526 - protein, 7 aa, Artificial Sequence
  Description of Artificial Sequence: Synthetic peptide
DTGVQSR

SEQ ID NO: 10527 - protein, 7 aa, Artificial Sequence
  Description of Artificial Sequence: Synthetic peptide
DGVQTAN

SEQ ID NO: 10528 - protein, 7 aa, Artificial Sequence
  Description of Artificial Sequence: Synthetic peptide
GGSAQER

SEQ ID NO: 10529 - protein, 7 aa, Artificial Sequence
  Description of Artificial Sequence: Synthetic peptide
GAGSTSK

SEQ ID NO: 10530 - protein, 7 aa, Artificial Sequence
  Description of Artificial Sequence: Synthetic peptide
SSSGSTQ

SEQ ID NO: 10531 - protein, 7 aa, Artificial Sequence
  Description of Artificial Sequence: Synthetic peptide
ASVPTSS

SEQ ID NO: 10532 - protein, 7 aa, Artificial Sequence
  Description of Artificial Sequence: Synthetic peptide
AVSKNTL

SEQ ID NO: 10533 - protein, 7 aa, Artificial Sequence
  Description of Artificial Sequence: Synthetic peptide
SHTPPNG

SEQ ID NO: 10534 - protein, 7 aa, Artificial Sequence
  Description of Artificial Sequence: Synthetic peptide
TGVDTNR

SEQ ID NO: 10535 - protein, 7 aa, Artificial Sequence
  Description of Artificial Sequence: Synthetic peptide
NQGGKGD

SEQ ID NO: 10536 - protein, 7 aa, Artificial Sequence
  Description of Artificial Sequence: Synthetic peptide
SNSTVHT

SEQ ID NO: 10537 - protein, 7 aa, Artificial Sequence
  Description of Artificial Sequence: Synthetic peptide
SSNKPGL

SEQ ID NO: 10538 - protein, 7 aa, Artificial Sequence
  Description of Artificial Sequence: Synthetic peptide
SSGKPNG

SEQ ID NO: 10539 - protein, 7 aa, Artificial Sequence
  Description of Artificial Sequence: Synthetic peptide
SSGPSGR

SEQ ID NO: 10540 - protein, 7 aa, Artificial Sequence
  Description of Artificial Sequence: Synthetic peptide
EKLSTAA

SEQ ID NO: 10541 - protein, 7 aa, Artificial Sequence
  Description of Artificial Sequence: Synthetic peptide
DTSSLAK

SEQ ID NO: 10542 - protein, 7 aa, Artificial Sequence
  Description of Artificial Sequence: Synthetic peptide
CASKDSR

SEQ ID NO: 10543 - protein, 7 aa, Artificial Sequence
  Description of Artificial Sequence: Synthetic peptide
TASGHNN

SEQ ID NO: 10544 - protein, 7 aa, Artificial Sequence
  Description of Artificial Sequence: Synthetic peptide
SNSTPSL

SEQ ID NO: 10545 - protein, 7 aa, Artificial Sequence
  Description of Artificial Sequence: Synthetic peptide
QPTNTSK

SEQ ID NO: 10546 - protein, 7 aa, Artificial Sequence
  Description of Artificial Sequence: Synthetic peptide
ADQKGST

SEQ ID NO: 10547 - protein, 7 aa, Artificial Sequence
  Description of Artificial Sequence: Synthetic peptide
RSNGTTQ

SEQ ID NO: 10548 - protein, 7 aa, Artificial Sequence
  Description of Artificial Sequence: Synthetic peptide
RTEGSGG

SEQ ID NO: 10549 - protein, 7 aa, Artificial Sequence
  Description of Artificial Sequence: Synthetic peptide
SGSEPRK

SEQ ID NO: 10550 - protein, 7 aa, Artificial Sequence
  Description of Artificial Sequence: Synthetic peptide
DTSAQRS

SEQ ID NO: 10551 - protein, 7 aa, Artificial Sequence
  Description of Artificial Sequence: Synthetic peptide
DRTKNVG

SEQ ID NO: 10552 - protein, 7 aa, Artificial Sequence
  Description of Artificial Sequence: Synthetic peptide
DAGSSPR

SEQ ID NO: 10553 - protein, 7 aa, Artificial Sequence
  Description of Artificial Sequence: Synthetic peptide
GTVARDG

SEQ ID NO: 10554 - protein, 7 aa, Artificial Sequence
  Description of Artificial Sequence: Synthetic peptide
GVQTPNH

SEQ ID NO: 10555 - protein, 7 aa, Artificial Sequence
  Description of Artificial Sequence: Synthetic peptide
GLSNSNR

SEQ ID NO: 10556 - protein, 7 aa, Artificial Sequence
  Description of Artificial Sequence: Synthetic peptide
VTSSSVL

SEQ ID NO: 10557 - protein, 7 aa, Artificial Sequence
  Description of Artificial Sequence: Synthetic peptide
LHSDPHS

SEQ ID NO: 10558 - protein, 7 aa, Artificial Sequence
  Description of Artificial Sequence: Synthetic peptide
FGQQTVK

SEQ ID NO: 10559 - protein, 7 aa, Artificial Sequence
  Description of Artificial Sequence: Synthetic peptide
SNKAQSI

SEQ ID NO: 10560 - protein, 7 aa, Artificial Sequence
  Description of Artificial Sequence: Synthetic peptide
ASTSSTA

SEQ ID NO: 10561 - protein, 7 aa, Artificial Sequence
  Description of Artificial Sequence: Synthetic peptide
SPSQSHG

SEQ ID NO: 10562 - protein, 7 aa, Artificial Sequence
  Description of Artificial Sequence: Synthetic peptide
QNHGSSS

SEQ ID NO: 10563 - protein, 7 aa, Artificial Sequence
  Description of Artificial Sequence: Synthetic peptide
VGGKPST

SEQ ID NO: 10564 - protein, 7 aa, Artificial Sequence
  Description of Artificial Sequence: Synthetic peptide
SSASNSS

SEQ ID NO: 10565 - protein, 7 aa, Artificial Sequence
  Description of Artificial Sequence: Synthetic peptide
LKDSGSS

SEQ ID NO: 10566 - protein, 7 aa, Artificial Sequence
  Description of Artificial Sequence: Synthetic peptide
TTARDTN

SEQ ID NO: 10567 - protein, 7 aa, Artificial Sequence
  Description of Artificial Sequence: Synthetic peptide
TAVPHSG

SEQ ID NO: 10568 - protein, 7 aa, Artificial Sequence
  Description of Artificial Sequence: Synthetic peptide
STTGSTS

SEQ ID NO: 10569 - protein, 7 aa, Artificial Sequence
  Description of Artificial Sequence: Synthetic peptide
MNSQSPS

SEQ ID NO: 10570 - protein, 7 aa, Artificial Sequence
  Description of Artificial Sequence: Synthetic peptide
PPSGPTK

SEQ ID NO: 10571 - protein, 7 aa, Artificial Sequence
  Description of Artificial Sequence: Synthetic peptide
SSGGQPS

SEQ ID NO: 10572 - protein, 7 aa, Artificial Sequence
  Description of Artificial Sequence: Synthetic peptide
SSTSTPR

SEQ ID NO: 10573 - protein, 7 aa, Artificial Sequence
  Description of Artificial Sequence: Synthetic peptide
VGQKSSM

SEQ ID NO: 10574 - protein, 7 aa, Artificial Sequence
  Description of Artificial Sequence: Synthetic peptide
DEGGPHR

SEQ ID NO: 10575 - protein, 7 aa, Artificial Sequence
  Description of Artificial Sequence: Synthetic peptide
NATRTSS

SEQ ID NO: 10576 - protein, 7 aa, Artificial Sequence
  Description of Artificial Sequence: Synthetic peptide
NRGATNQ

SEQ ID NO: 10577 - protein, 7 aa, Artificial Sequence
  Description of Artificial Sequence: Synthetic peptide
STRSSTS

SEQ ID NO: 10578 - protein, 7 aa, Artificial Sequence
  Description of Artificial Sequence: Synthetic peptide
VGTPSKE

SEQ ID NO: 10579 - protein, 7 aa, Artificial Sequence
  Description of Artificial Sequence: Synthetic peptide
LSTAKSS

SEQ ID NO: 10580 - protein, 7 aa, Artificial Sequence
  Description of Artificial Sequence: Synthetic peptide
KLSGSSS

SEQ ID NO: 10581 - protein, 7 aa, Artificial Sequence
  Description of Artificial Sequence: Synthetic peptide
TLGGNHM

SEQ ID NO: 10582 - protein, 7 aa, Artificial Sequence
  Description of Artificial Sequence: Synthetic peptide
SNGSDRN

SEQ ID NO: 10583 - protein, 7 aa, Artificial Sequence
  Description of Artificial Sequence: Synthetic peptide
QQSGQNI

SEQ ID NO: 10584 - protein, 7 aa, Artificial Sequence
  Description of Artificial Sequence: Synthetic peptide
DKSGQSR

SEQ ID NO: 10585 - protein, 7 aa, Artificial Sequence
  Description of Artificial Sequence: Synthetic peptide
AGNTMGS

SEQ ID NO: 10586 - protein, 7 aa, Artificial Sequence
  Description of Artificial Sequence: Synthetic peptide
AMGEQRA

SEQ ID NO: 10587 - protein, 7 aa, Artificial Sequence
  Description of Artificial Sequence: Synthetic peptide
VHAQDQH

SEQ ID NO: 10588 - protein, 7 aa, Artificial Sequence
  Description of Artificial Sequence: Synthetic peptide
FDNQPTS

SEQ ID NO: 10589 - protein, 7 aa, Artificial Sequence
  Description of Artificial Sequence: Synthetic peptide
HSSAESR

SEQ ID NO: 10590 - protein, 7 aa, Artificial Sequence
  Description of Artificial Sequence: Synthetic peptide
HGSPQNE

SEQ ID NO: 10591 - protein, 7 aa, Artificial Sequence
  Description of Artificial Sequence: Synthetic peptide
LSDGAIK

SEQ ID NO: 10592 - protein, 7 aa, Artificial Sequence
  Description of Artificial Sequence: Synthetic peptide
DSGDARV

SEQ ID NO: 10593 - protein, 7 aa, Artificial Sequence
  Description of Artificial Sequence: Synthetic peptide
GTGSQRS

SEQ ID NO: 10594 - protein, 7 aa, Artificial Sequence
  Description of Artificial Sequence: Synthetic peptide
GTDKAMG

SEQ ID NO: 10595 - protein, 7 aa, Artificial Sequence
  Description of Artificial Sequence: Synthetic peptide
GLTTPNN

SEQ ID NO: 10596 - protein, 7 aa, Artificial Sequence
  Description of Artificial Sequence: Synthetic peptide
VPGVSQP

SEQ ID NO: 10597 - protein, 7 aa, Artificial Sequence
  Description of Artificial Sequence: Synthetic peptide
SGSSGTR

SEQ ID NO: 10598 - protein, 7 aa, Artificial Sequence
  Description of Artificial Sequence: Synthetic peptide
TINSGPH

SEQ ID NO: 10599 - protein, 7 aa, Artificial Sequence
  Description of Artificial Sequence: Synthetic peptide
ERATGTA

SEQ ID NO: 10600 - protein, 7 aa, Artificial Sequence
  Description of Artificial Sequence: Synthetic peptide
GITGTNA

SEQ ID NO: 10601 - protein, 7 aa, Artificial Sequence
  Description of Artificial Sequence: Synthetic peptide
STASGVS

SEQ ID NO: 10602 - protein, 7 aa, Artificial Sequence
  Description of Artificial Sequence: Synthetic peptide
GSPPPVK

SEQ ID NO: 10603 - protein, 7 aa, Artificial Sequence
  Description of Artificial Sequence: Synthetic peptide
GSAGKLS

SEQ ID NO: 10604 - protein, 7 aa, Artificial Sequence
  Description of Artificial Sequence: Synthetic peptide
KTGADNA

SEQ ID NO: 10605 - protein, 7 aa, Artificial Sequence
  Description of Artificial Sequence: Synthetic peptide
RDSTNPK

SEQ ID NO: 10606 - protein, 7 aa, Artificial Sequence
  Description of Artificial Sequence: Synthetic peptide
RVGSSTQ

SEQ ID NO: 10607 - protein, 7 aa, Artificial Sequence
  Description of Artificial Sequence: Synthetic peptide
SASSQPS

SEQ ID NO: 10608 - protein, 7 aa, Artificial Sequence
  Description of Artificial Sequence: Synthetic peptide
SGIEQKK

SEQ ID NO: 10609 - protein, 7 aa, Artificial Sequence
  Description of Artificial Sequence: Synthetic peptide
RTTDQQS

SEQ ID NO: 10610 - protein, 7 aa, Artificial Sequence
  Description of Artificial Sequence: Synthetic peptide
IAGTSSS

SEQ ID NO: 10611 - protein, 7 aa, Artificial Sequence
  Description of Artificial Sequence: Synthetic peptide
HGSASQG

SEQ ID NO: 10612 - protein, 7 aa, Artificial Sequence
  Description of Artificial Sequence: Synthetic peptide
QLGTKEA

SEQ ID NO: 10613 - protein, 7 aa, Artificial Sequence
  Description of Artificial Sequence: Synthetic peptide
HNGDRNV

SEQ ID NO: 10614 - protein, 7 aa, Artificial Sequence
  Description of Artificial Sequence: Synthetic peptide
LRSTETK

SEQ ID NO: 10615 - protein, 7 aa, Artificial Sequence
  Description of Artificial Sequence: Synthetic peptide
GSQTSPM

SEQ ID NO: 10616 - protein, 7 aa, Artificial Sequence
  Description of Artificial Sequence: Synthetic peptide
NVDHAAK

SEQ ID NO: 10617 - protein, 7 aa, Artificial Sequence
  Description of Artificial Sequence: Synthetic peptide
TGVNGAT

SEQ ID NO: 10618 - protein, 7 aa, Artificial Sequence
  Description of Artificial Sequence: Synthetic peptide
DGLKSTG

SEQ ID NO: 10619 - protein, 7 aa, Artificial Sequence
  Description of Artificial Sequence: Synthetic peptide
VTSNSPK

SEQ ID NO: 10620 - protein, 7 aa, Artificial Sequence
  Description of Artificial Sequence: Synthetic peptide
SGTEHSR

SEQ ID NO: 10621 - protein, 7 aa, Artificial Sequence
  Description of Artificial Sequence: Synthetic peptide
NQRPSVE

SEQ ID NO: 10622 - protein, 7 aa, Artificial Sequence
  Description of Artificial Sequence: Synthetic peptide
TTSSPRL

SEQ ID NO: 10623 - protein, 7 aa, Artificial Sequence
  Description of Artificial Sequence: Synthetic peptide
DALKTNT

SEQ ID NO: 10624 - protein, 7 aa, Artificial Sequence
  Description of Artificial Sequence: Synthetic peptide
LRNGTSA

SEQ ID NO: 10625 - protein, 7 aa, Artificial Sequence
  Description of Artificial Sequence: Synthetic peptide
SSTEKST

SEQ ID NO: 10626 - protein, 7 aa, Artificial Sequence
  Description of Artificial Sequence: Synthetic peptide
SGVPPAA

SEQ ID NO: 10627 - protein, 7 aa, Artificial Sequence
  Description of Artificial Sequence: Synthetic peptide
SRNGTLA

SEQ ID NO: 10628 - protein, 7 aa, Artificial Sequence
  Description of Artificial Sequence: Synthetic peptide
IDKGTTL

SEQ ID NO: 10629 - protein, 7 aa, Artificial Sequence
  Description of Artificial Sequence: Synthetic peptide
QRQDTTN

SEQ ID NO: 10630 - protein, 7 aa, Artificial Sequence
  Description of Artificial Sequence: Synthetic peptide
VQEPKMQ

SEQ ID NO: 10631 - protein, 7 aa, Artificial Sequence
  Description of Artificial Sequence: Synthetic peptide
NVETSSK

SEQ ID NO: 10632 - protein, 7 aa, Artificial Sequence
  Description of Artificial Sequence: Synthetic peptide
SPASHPV

SEQ ID NO: 10633 - protein, 7 aa, Artificial Sequence
  Description of Artificial Sequence: Synthetic peptide
QKGSDIA

SEQ ID NO: 10634 - protein, 7 aa, Artificial Sequence
  Description of Artificial Sequence: Synthetic peptide
LRDSNNK

SEQ ID NO: 10635 - protein, 7 aa, Artificial Sequence
  Description of Artificial Sequence: Synthetic peptide
SGGDPQR

SEQ ID NO: 10636 - protein, 7 aa, Artificial Sequence
  Description of Artificial Sequence: Synthetic peptide
LSSEKTS

SEQ ID NO: 10637 - protein, 7 aa, Artificial Sequence
  Description of Artificial Sequence: Synthetic peptide
NKTDRPT

SEQ ID NO: 10638 - protein, 7 aa, Artificial Sequence
  Description of Artificial Sequence: Synthetic peptide
MSTNSPQ

SEQ ID NO: 10639 - protein, 7 aa, Artificial Sequence
  Description of Artificial Sequence: Synthetic peptide
NGQGVQQ

SEQ ID NO: 10640 - protein, 7 aa, Artificial Sequence
  Description of Artificial Sequence: Synthetic peptide
NSGVSPA

SEQ ID NO: 10641 - protein, 7 aa, Artificial Sequence
  Description of Artificial Sequence: Synthetic peptide
SKVQQAT

SEQ ID NO: 10642 - protein, 7 aa, Artificial Sequence
  Description of Artificial Sequence: Synthetic peptide
QSKVPVS

SEQ ID NO: 10643 - protein, 7 aa, Artificial Sequence
  Description of Artificial Sequence: Synthetic peptide
ESTAHAT

SEQ ID NO: 10644 - protein, 7 aa, Artificial Sequence
  Description of Artificial Sequence: Synthetic peptide
DGAVSHG

SEQ ID NO: 10645 - protein, 7 aa, Artificial Sequence
  Description of Artificial Sequence: Synthetic peptide
EGVQARG

SEQ ID NO: 10646 - protein, 7 aa, Artificial Sequence
  Description of Artificial Sequence: Synthetic peptide
ALSSSKA

SEQ ID NO: 10647 - protein, 7 aa, Artificial Sequence
  Description of Artificial Sequence: Synthetic peptide
AFGKSSA

SEQ ID NO: 10648 - protein, 7 aa, Artificial Sequence
  Description of Artificial Sequence: Synthetic peptide
GSKGSQM

SEQ ID NO: 10649 - protein, 7 aa, Artificial Sequence
  Description of Artificial Sequence: Synthetic peptide
GVHEAKR

SEQ ID NO: 10650 - protein, 7 aa, Artificial Sequence
  Description of Artificial Sequence: Synthetic peptide
GSNKVVA

SEQ ID NO: 10651 - protein, 7 aa, Artificial Sequence
  Description of Artificial Sequence: Synthetic peptide
SMNKDRL

SEQ ID NO: 10652 - protein, 7 aa, Artificial Sequence
  Description of Artificial Sequence: Synthetic peptide
TSDVKTL

SEQ ID NO: 10653 - protein, 7 aa, Artificial Sequence
  Description of Artificial Sequence: Synthetic peptide
NASKDLR

SEQ ID NO: 10654 - protein, 7 aa, Artificial Sequence
  Description of Artificial Sequence: Synthetic peptide
VSGPSAT

SEQ ID NO: 10655 - protein, 7 aa, Artificial Sequence
  Description of Artificial Sequence: Synthetic peptide
GSKEHGS

SEQ ID NO: 10656 - protein, 7 aa, Artificial Sequence
  Description of Artificial Sequence: Synthetic peptide
NDGLANS

SEQ ID NO: 10657 - protein, 7 aa, Artificial Sequence
  Description of Artificial Sequence: Synthetic peptide
TSHAPSM

SEQ ID NO: 10658 - protein, 7 aa, Artificial Sequence
  Description of Artificial Sequence: Synthetic peptide
TSGPSIG

SEQ ID NO: 10659 - protein, 7 aa, Artificial Sequence
  Description of Artificial Sequence: Synthetic peptide
SETRSAV

SEQ ID NO: 10660 - protein, 7 aa, Artificial Sequence
  Description of Artificial Sequence: Synthetic peptide
SSTGSPG

SEQ ID NO: 10661 - protein, 7 aa, Artificial Sequence
  Description of Artificial Sequence: Synthetic peptide
EAFKDGG

SEQ ID NO: 10662 - protein, 7 aa, Artificial Sequence
  Description of Artificial Sequence: Synthetic peptide
AGGAPMT

SEQ ID NO: 10663 - protein, 7 aa, Artificial Sequence
  Description of Artificial Sequence: Synthetic peptide
VPSTSTA

SEQ ID NO: 10664 - protein, 7 aa, Artificial Sequence
  Description of Artificial Sequence: Synthetic peptide
QGTGHVA

SEQ ID NO: 10665 - protein, 7 aa, Artificial Sequence
  Description of Artificial Sequence: Synthetic peptide
NQGATLG

SEQ ID NO: 10666 - protein, 7 aa, Artificial Sequence
  Description of Artificial Sequence: Synthetic peptide
NLGSSAN

SEQ ID NO: 10667 - protein, 7 aa, Artificial Sequence
  Description of Artificial Sequence: Synthetic peptide
TITPTSA

SEQ ID NO: 10668 - protein, 7 aa, Artificial Sequence
  Description of Artificial Sequence: Synthetic peptide
SLGQATA

SEQ ID NO: 10669 - protein, 7 aa, Artificial Sequence
  Description of Artificial Sequence: Synthetic peptide
SEGRATG

SEQ ID NO: 10670 - protein, 7 aa, Artificial Sequence
  Description of Artificial Sequence: Synthetic peptide
MGNNTPM

SEQ ID NO: 10671 - protein, 7 aa, Artificial Sequence
  Description of Artificial Sequence: Synthetic peptide
EGHSTAL

SEQ ID NO: 10672 - protein, 7 aa, Artificial Sequence
  Description of Artificial Sequence: Synthetic peptide
ALGQDKN

SEQ ID NO: 10673 - protein, 7 aa, Artificial Sequence
  Description of Artificial Sequence: Synthetic peptide
GTINTSS

SEQ ID NO: 10674 - protein, 7 aa, Artificial Sequence
  Description of Artificial Sequence: Synthetic peptide
SATSQNH

SEQ ID NO: 10675 - protein, 7 aa, Artificial Sequence
  Description of Artificial Sequence: Synthetic peptide
EGKANKG

SEQ ID NO: 10676 - protein, 7 aa, Artificial Sequence
  Description of Artificial Sequence: Synthetic peptide
LPAQNVT

SEQ ID NO: 10677 - protein, 7 aa, Artificial Sequence
  Description of Artificial Sequence: Synthetic peptide
NTQTHSK

SEQ ID NO: 10678 - protein, 7 aa, Artificial Sequence
  Description of Artificial Sequence: Synthetic peptide
SLTNNGK

SEQ ID NO: 10679 - protein, 7 aa, Artificial Sequence
  Description of Artificial Sequence: Synthetic peptide
SAPNGAA

SEQ ID NO: 10680 - protein, 7 aa, Artificial Sequence
  Description of Artificial Sequence: Synthetic peptide
QHSGSSA

SEQ ID NO: 10681 - protein, 7 aa, Artificial Sequence
  Description of Artificial Sequence: Synthetic peptide
GSASTPT

SEQ ID NO: 10682 - protein, 7 aa, Artificial Sequence
  Description of Artificial Sequence: Synthetic peptide
GSSNSNA

SEQ ID NO: 10683 - protein, 7 aa, Artificial Sequence
  Description of Artificial Sequence: Synthetic peptide
VNGGAVQ

SEQ ID NO: 10684 - protein, 7 aa, Artificial Sequence
  Description of Artificial Sequence: Synthetic peptide
SSGNLGA

SEQ ID NO: 10685 - protein, 7 aa, Artificial Sequence
  Description of Artificial Sequence: Synthetic peptide
NSKSAMT

SEQ ID NO: 10686 - protein, 7 aa, Artificial Sequence
  Description of Artificial Sequence: Synthetic peptide
NSPNSSS

SEQ ID NO: 10687 - protein, 7 aa, Artificial Sequence
  Description of Artificial Sequence: Synthetic peptide
NTLQTSH

SEQ ID NO: 10688 - protein, 7 aa, Artificial Sequence
  Description of Artificial Sequence: Synthetic peptide
TPSTSRG

SEQ ID NO: 10689 - protein, 7 aa, Artificial Sequence
  Description of Artificial Sequence: Synthetic peptide
ERLHETR

SEQ ID NO: 10690 - protein, 7 aa, Artificial Sequence
  Description of Artificial Sequence: Synthetic peptide
DQTTGNQ

SEQ ID NO: 10691 - protein, 7 aa, Artificial Sequence
  Description of Artificial Sequence: Synthetic peptide
TNSDSPR

SEQ ID NO: 10692 - protein, 7 aa, Artificial Sequence
  Description of Artificial Sequence: Synthetic peptide
DAVKQSR

SEQ ID NO: 10693 - protein, 7 aa, Artificial Sequence
  Description of Artificial Sequence: Synthetic peptide
FGDHGAK

SEQ ID NO: 10694 - protein, 7 aa, Artificial Sequence
  Description of Artificial Sequence: Synthetic peptide
NASPASG

SEQ ID NO: 10695 - protein, 7 aa, Artificial Sequence
  Description of Artificial Sequence: Synthetic peptide
TTHAKVG

SEQ ID NO: 10696 - protein, 7 aa, Artificial Sequence
  Description of Artificial Sequence: Synthetic peptide
TRGGHAE

SEQ ID NO: 10697 - protein, 7 aa, Artificial Sequence
  Description of Artificial Sequence: Synthetic peptide
STGQKGS

SEQ ID NO: 10698 - protein, 7 aa, Artificial Sequence
  Description of Artificial Sequence: Synthetic peptide
SEAKSVN

SEQ ID NO: 10699 - protein, 7 aa, Artificial Sequence
  Description of Artificial Sequence: Synthetic peptide
SGENRSL

SEQ ID NO: 10700 - protein, 7 aa, Artificial Sequence
  Description of Artificial Sequence: Synthetic peptide
MRGETSL

SEQ ID NO: 10701 - protein, 7 aa, Artificial Sequence
  Description of Artificial Sequence: Synthetic peptide
QSNGKTE

SEQ ID NO: 10702 - protein, 7 aa, Artificial Sequence
  Description of Artificial Sequence: Synthetic peptide
HGESSRT

SEQ ID NO: 10703 - protein, 7 aa, Artificial Sequence
  Description of Artificial Sequence: Synthetic peptide
LSGSASG

SEQ ID NO: 10704 - protein, 7 aa, Artificial Sequence
  Description of Artificial Sequence: Synthetic peptide
ENNNSGR

SEQ ID NO: 10705 - protein, 7 aa, Artificial Sequence
  Description of Artificial Sequence: Synthetic peptide
GHQKNEL

SEQ ID NO: 10706 - protein, 7 aa, Artificial Sequence
  Description of Artificial Sequence: Synthetic peptide
GKEQRVG

SEQ ID NO: 10707 - protein, 7 aa, Artificial Sequence
  Description of Artificial Sequence: Synthetic peptide
FGSSSPT

SEQ ID NO: 10708 - protein, 7 aa, Artificial Sequence
  Description of Artificial Sequence: Synthetic peptide
LTSQAST

SEQ ID NO: 10709 - protein, 7 aa, Artificial Sequence
  Description of Artificial Sequence: Synthetic peptide
RADGGNG

SEQ ID NO: 10710 - protein, 7 aa, Artificial Sequence
  Description of Artificial Sequence: Synthetic peptide
SQPPPSH

SEQ ID NO: 10711 - protein, 7 aa, Artificial Sequence
  Description of Artificial Sequence: Synthetic peptide
NAAASPK

SEQ ID NO: 10712 - protein, 7 aa, Artificial Sequence
  Description of Artificial Sequence: Synthetic peptide
NGNSDHR

SEQ ID NO: 10713 - protein, 7 aa, Artificial Sequence
  Description of Artificial Sequence: Synthetic peptide
LKEVPQS

SEQ ID NO: 10714 - protein, 7 aa, Artificial Sequence
  Description of Artificial Sequence: Synthetic peptide
GALGKGP

SEQ ID NO: 10715 - protein, 7 aa, Artificial Sequence
  Description of Artificial Sequence: Synthetic peptide
TSGSSAT

SEQ ID NO: 10716 - protein, 7 aa, Artificial Sequence
  Description of Artificial Sequence: Synthetic peptide
GTTAPGT

SEQ ID NO: 10717 - protein, 7 aa, Artificial Sequence
  Description of Artificial Sequence: Synthetic peptide
TSASNNS

SEQ ID NO: 10718 - protein, 7 aa, Artificial Sequence
  Description of Artificial Sequence: Synthetic peptide
RDNGKHD

SEQ ID NO: 10719 - protein, 7 aa, Artificial Sequence
  Description of Artificial Sequence: Synthetic peptide
HNNSGLT

SEQ ID NO: 10720 - protein, 7 aa, Artificial Sequence
  Description of Artificial Sequence: Synthetic peptide
DRQKATN

SEQ ID NO: 10721 - protein, 7 aa, Artificial Sequence
  Description of Artificial Sequence: Synthetic peptide
AGRDAAS

SEQ ID NO: 10722 - protein, 7 aa, Artificial Sequence
  Description of Artificial Sequence: Synthetic peptide
GGDGAHK

SEQ ID NO: 10723 - protein, 7 aa, Artificial Sequence
  Description of Artificial Sequence: Synthetic peptide
TITSSPS

SEQ ID NO: 10724 - protein, 7 aa, Artificial Sequence
  Description of Artificial Sequence: Synthetic peptide
NVGASPV

SEQ ID NO: 10725 - protein, 7 aa, Artificial Sequence
  Description of Artificial Sequence: Synthetic peptide
IQSGNSA

SEQ ID NO: 10726 - protein, 7 aa, Artificial Sequence
  Description of Artificial Sequence: Synthetic peptide
GNGSPVL

SEQ ID NO: 10727 - protein, 7 aa, Artificial Sequence
  Description of Artificial Sequence: Synthetic peptide
TQNKGLS

SEQ ID NO: 10728 - protein, 7 aa, Artificial Sequence
  Description of Artificial Sequence: Synthetic peptide
THEDKGY

SEQ ID NO: 10729 - protein, 7 aa, Artificial Sequence
  Description of Artificial Sequence: Synthetic peptide
TGTHNTV

SEQ ID NO: 10730 - protein, 7 aa, Artificial Sequence
  Description of Artificial Sequence: Synthetic peptide
STMPASK

SEQ ID NO: 10731 - protein, 7 aa, Artificial Sequence
  Description of Artificial Sequence: Synthetic peptide
SDGKVMV

SEQ ID NO: 10732 - protein, 7 aa, Artificial Sequence
  Description of Artificial Sequence: Synthetic peptide
MAKPGET

SEQ ID NO: 10733 - protein, 7 aa, Artificial Sequence
  Description of Artificial Sequence: Synthetic peptide
QTNSSKG

SEQ ID NO: 10734 - protein, 7 aa, Artificial Sequence
  Description of Artificial Sequence: Synthetic peptide
ATSSGST

SEQ ID NO: 10735 - protein, 7 aa, Artificial Sequence
  Description of Artificial Sequence: Synthetic peptide
GDQDRTK

SEQ ID NO: 10736 - protein, 7 aa, Artificial Sequence
  Description of Artificial Sequence: Synthetic peptide
SADAKGR

SEQ ID NO: 10737 - protein, 7 aa, Artificial Sequence
  Description of Artificial Sequence: Synthetic peptide
SAGPTGH

SEQ ID NO: 10738 - protein, 7 aa, Artificial Sequence
  Description of Artificial Sequence: Synthetic peptide
HSSTTPA

SEQ ID NO: 10739 - protein, 7 aa, Artificial Sequence
  Description of Artificial Sequence: Synthetic peptide
EARAPIT

SEQ ID NO: 10740 - protein, 7 aa, Artificial Sequence
  Description of Artificial Sequence: Synthetic peptide
SATRSGS

SEQ ID NO: 10741 - protein, 7 aa, Artificial Sequence
  Description of Artificial Sequence: Synthetic peptide
NSASRPS

SEQ ID NO: 10742 - protein, 7 aa, Artificial Sequence
  Description of Artificial Sequence: Synthetic peptide
GRGERIS

SEQ ID NO: 10743 - protein, 7 aa, Artificial Sequence
  Description of Artificial Sequence: Synthetic peptide
MTKGSTL

SEQ ID NO: 10744 - protein, 7 aa, Artificial Sequence
  Description of Artificial Sequence: Synthetic peptide
TGTNTMS

SEQ ID NO: 10745 - protein, 7 aa, Artificial Sequence
  Description of Artificial Sequence: Synthetic peptide
MNSSRSV

SEQ ID NO: 10746 - protein, 7 aa, Artificial Sequence
  Description of Artificial Sequence: Synthetic peptide
QSVGTTR

SEQ ID NO: 10747 - protein, 7 aa, Artificial Sequence
  Description of Artificial Sequence: Synthetic peptide
EASGKST

SEQ ID NO: 10748 - protein, 7 aa, Artificial Sequence
  Description of Artificial Sequence: Synthetic peptide
STSSSPH

SEQ ID NO: 10749 - protein, 7 aa, Artificial Sequence
  Description of Artificial Sequence: Synthetic peptide
ESSSALK

SEQ ID NO: 10750 - protein, 7 aa, Artificial Sequence
  Description of Artificial Sequence: Synthetic peptide
HPQSQPN

SEQ ID NO: 10751 - protein, 7 aa, Artificial Sequence
  Description of Artificial Sequence: Synthetic peptide
SNSQTGS

SEQ ID NO: 10752 - protein, 7 aa, Artificial Sequence
  Description of Artificial Sequence: Synthetic peptide
MTSSTAS

SEQ ID NO: 10753 - protein, 7 aa, Artificial Sequence
  Description of Artificial Sequence: Synthetic peptide
NTNNQPA

SEQ ID NO: 10754 - protein, 7 aa, Artificial Sequence
  Description of Artificial Sequence: Synthetic peptide
GNTSKNL

SEQ ID NO: 10755 - protein, 7 aa, Artificial Sequence
  Description of Artificial Sequence: Synthetic peptide
KVADRPS

SEQ ID NO: 10756 - protein, 7 aa, Artificial Sequence
  Description of Artificial Sequence: Synthetic peptide
NTSKSTD

SEQ ID NO: 10757 - protein, 7 aa, Artificial Sequence
  Description of Artificial Sequence: Synthetic peptide
NSGATIT

SEQ ID NO: 10758 - protein, 7 aa, Artificial Sequence
  Description of Artificial Sequence: Synthetic peptide
RENATPS

SEQ ID NO: 10759 - protein, 7 aa, Artificial Sequence
  Description of Artificial Sequence: Synthetic peptide
SNSGNSK

SEQ ID NO: 10760 - protein, 7 aa, Artificial Sequence
  Description of Artificial Sequence: Synthetic peptide
SSTKQIG

SEQ ID NO: 10761 - protein, 7 aa, Artificial Sequence
  Description of Artificial Sequence: Synthetic peptide
SAERSVS

SEQ ID NO: 10762 - protein, 7 aa, Artificial Sequence
  Description of Artificial Sequence: Synthetic peptide
SDTNRAS

SEQ ID NO: 10763 - protein, 7 aa, Artificial Sequence
  Description of Artificial Sequence: Synthetic peptide
MDKPTAA

SEQ ID NO: 10764 - protein, 7 aa, Artificial Sequence
  Description of Artificial Sequence: Synthetic peptide
EHKDNTK

SEQ ID NO: 10765 - protein, 7 aa, Artificial Sequence
  Description of Artificial Sequence: Synthetic peptide
DATTKTA

SEQ ID NO: 10766 - protein, 7 aa, Artificial Sequence
  Description of Artificial Sequence: Synthetic peptide
AATAPHG

SEQ ID NO: 10767 - protein, 7 aa, Artificial Sequence
  Description of Artificial Sequence: Synthetic peptide
GNQENRG

SEQ ID NO: 10768 - protein, 7 aa, Artificial Sequence
  Description of Artificial Sequence: Synthetic peptide
GDLPTQR

SEQ ID NO: 10769 - protein, 7 aa, Artificial Sequence
  Description of Artificial Sequence: Synthetic peptide
VVGTSTG

SEQ ID NO: 10770 - protein, 7 aa, Artificial Sequence
  Description of Artificial Sequence: Synthetic peptide
SSTAPGT

SEQ ID NO: 10771 - protein, 7 aa, Artificial Sequence
  Description of Artificial Sequence: Synthetic peptide
SSEPRSS

SEQ ID NO: 10772 - protein, 7 aa, Artificial Sequence
  Description of Artificial Sequence: Synthetic peptide
LVANTSK

SEQ ID NO: 10773 - protein, 7 aa, Artificial Sequence
  Description of Artificial Sequence: Synthetic peptide
LEGKGLK

SEQ ID NO: 10774 - protein, 7 aa, Artificial Sequence
  Description of Artificial Sequence: Synthetic peptide
DTTAKLS

SEQ ID NO: 10775 - protein, 7 aa, Artificial Sequence
  Description of Artificial Sequence: Synthetic peptide
NPVAGNN

SEQ ID NO: 10776 - protein, 7 aa, Artificial Sequence
  Description of Artificial Sequence: Synthetic peptide
SGATTAT

SEQ ID NO: 10777 - protein, 7 aa, Artificial Sequence
  Description of Artificial Sequence: Synthetic peptide
RSEAAVH

SEQ ID NO: 10778 - protein, 7 aa, Artificial Sequence
  Description of Artificial Sequence: Synthetic peptide
GENPTRT

SEQ ID NO: 10779 - protein, 7 aa, Artificial Sequence
  Description of Artificial Sequence: Synthetic peptide
GAHDKTI

SEQ ID NO: 10780 - protein, 7 aa, Artificial Sequence
  Description of Artificial Sequence: Synthetic peptide
GSTKSAC

SEQ ID NO: 10781 - protein, 7 aa, Artificial Sequence
  Description of Artificial Sequence: Synthetic peptide
VRNSSST

SEQ ID NO: 10782 - protein, 7 aa, Artificial Sequence
  Description of Artificial Sequence: Synthetic peptide
DQRSASA

SEQ ID NO: 10783 - protein, 7 aa, Artificial Sequence
  Description of Artificial Sequence: Synthetic peptide
GTNTGKG

SEQ ID NO: 10784 - protein, 7 aa, Artificial Sequence
  Description of Artificial Sequence: Synthetic peptide
SVANAPH

SEQ ID NO: 10785 - protein, 7 aa, Artificial Sequence
  Description of Artificial Sequence: Synthetic peptide
QAMEKTS

SEQ ID NO: 10786 - protein, 7 aa, Artificial Sequence
  Description of Artificial Sequence: Synthetic peptide
DTTNNRQ

SEQ ID NO: 10787 - protein, 7 aa, Artificial Sequence
  Description of Artificial Sequence: Synthetic peptide
VSGVSNT

SEQ ID NO: 10788 - protein, 7 aa, Artificial Sequence
  Description of Artificial Sequence: Synthetic peptide
TGNPSVH

SEQ ID NO: 10789 - protein, 7 aa, Artificial Sequence
  Description of Artificial Sequence: Synthetic peptide
QSDSPHT

SEQ ID NO: 10790 - protein, 7 aa, Artificial Sequence
  Description of Artificial Sequence: Synthetic peptide
LNTSPNQ

SEQ ID NO: 10791 - protein, 7 aa, Artificial Sequence
  Description of Artificial Sequence: Synthetic peptide
GPGKSEG

SEQ ID NO: 10792 - protein, 7 aa, Artificial Sequence
  Description of Artificial Sequence: Synthetic peptide
NGVSSVN

SEQ ID NO: 10793 - protein, 7 aa, Artificial Sequence
  Description of Artificial Sequence: Synthetic peptide
NQSNVQG

SEQ ID NO: 10794 - protein, 7 aa, Artificial Sequence
  Description of Artificial Sequence: Synthetic peptide
SSTSNRA

SEQ ID NO: 10795 - protein, 7 aa, Artificial Sequence
  Description of Artificial Sequence: Synthetic peptide
EREKETG

SEQ ID NO: 10796 - protein, 7 aa, Artificial Sequence
  Description of Artificial Sequence: Synthetic peptide
QTGSTSI

SEQ ID NO: 10797 - protein, 7 aa, Artificial Sequence
  Description of Artificial Sequence: Synthetic peptide
LSGHKTS

SEQ ID NO: 10798 - protein, 7 aa, Artificial Sequence
  Description of Artificial Sequence: Synthetic peptide
QASTKAV

SEQ ID NO: 10799 - protein, 7 aa, Artificial Sequence
  Description of Artificial Sequence: Synthetic peptide
EGGQKLA

SEQ ID NO: 10800 - protein, 7 aa, Artificial Sequence
  Description of Artificial Sequence: Synthetic peptide
DPERNGG

SEQ ID NO: 10801 - protein, 7 aa, Artificial Sequence
  Description of Artificial Sequence: Synthetic peptide
AGNAPVS

SEQ ID NO: 10802 - protein, 7 aa, Artificial Sequence
  Description of Artificial Sequence: Synthetic peptide
SAVSSAS

SEQ ID NO: 10803 - protein, 7 aa, Artificial Sequence
  Description of Artificial Sequence: Synthetic peptide
SGKDRVI

SEQ ID NO: 10804 - protein, 7 aa, Artificial Sequence
  Description of Artificial Sequence: Synthetic peptide
SGNSQTQ

SEQ ID NO: 10805 - protein, 7 aa, Artificial Sequence
  Description of Artificial Sequence: Synthetic peptide
GTSGSGS

SEQ ID NO: 10806 - protein, 7 aa, Artificial Sequence
  Description of Artificial Sequence: Synthetic peptide
KPSPSSG

SEQ ID NO: 10807 - protein, 7 aa, Artificial Sequence
  Description of Artificial Sequence: Synthetic peptide
NGINSPQ

SEQ ID NO: 10808 - protein, 7 aa, Artificial Sequence
  Description of Artificial Sequence: Synthetic peptide
QGVQGLQ

SEQ ID NO: 10809 - protein, 7 aa, Artificial Sequence
  Description of Artificial Sequence: Synthetic peptide
DRVSSSK

SEQ ID NO: 10810 - protein, 7 aa, Artificial Sequence
  Description of Artificial Sequence: Synthetic peptide
GTNKVSL

SEQ ID NO: 10811 - protein, 7 aa, Artificial Sequence
  Description of Artificial Sequence: Synthetic peptide
KGTPVSS

SEQ ID NO: 10812 - protein, 7 aa, Artificial Sequence
  Description of Artificial Sequence: Synthetic peptide
TGSSRST

SEQ ID NO: 10813 - protein, 7 aa, Artificial Sequence
  Description of Artificial Sequence: Synthetic peptide
SNKGSDS

SEQ ID NO: 10814 - protein, 7 aa, Artificial Sequence
  Description of Artificial Sequence: Synthetic peptide
MTEHRPP

SEQ ID NO: 10815 - protein, 7 aa, Artificial Sequence
  Description of Artificial Sequence: Synthetic peptide
ISGTTNT

SEQ ID NO: 10816 - protein, 7 aa, Artificial Sequence
  Description of Artificial Sequence: Synthetic peptide
HSAPSSA

SEQ ID NO: 10817 - protein, 7 aa, Artificial Sequence
  Description of Artificial Sequence: Synthetic peptide
DKSSKHS

SEQ ID NO: 10818 - protein, 7 aa, Artificial Sequence
  Description of Artificial Sequence: Synthetic peptide
AGSPQLG

SEQ ID NO: 10819 - protein, 7 aa, Artificial Sequence
  Description of Artificial Sequence: Synthetic peptide
GRNNEPL

SEQ ID NO: 10820 - protein, 7 aa, Artificial Sequence
  Description of Artificial Sequence: Synthetic peptide
LGSSVVQ

SEQ ID NO: 10821 - protein, 7 aa, Artificial Sequence
  Description of Artificial Sequence: Synthetic peptide
MHESPNR

SEQ ID NO: 10822 - protein, 7 aa, Artificial Sequence
  Description of Artificial Sequence: Synthetic peptide
TQRQSTG

SEQ ID NO: 10823 - protein, 7 aa, Artificial Sequence
  Description of Artificial Sequence: Synthetic peptide
GLATPAV

SEQ ID NO: 10824 - protein, 7 aa, Artificial Sequence
  Description of Artificial Sequence: Synthetic peptide
VSKKDQV

SEQ ID NO: 10825 - protein, 7 aa, Artificial Sequence
  Description of Artificial Sequence: Synthetic peptide
STATPHS

SEQ ID NO: 10826 - protein, 7 aa, Artificial Sequence
  Description of Artificial Sequence: Synthetic peptide
QSTPPGT

SEQ ID NO: 10827 - protein, 7 aa, Artificial Sequence
  Description of Artificial Sequence: Synthetic peptide
QGDITKG

SEQ ID NO: 10828 - protein, 7 aa, Artificial Sequence
  Description of Artificial Sequence: Synthetic peptide
GIGNDNM

SEQ ID NO: 10829 - protein, 7 aa, Artificial Sequence
  Description of Artificial Sequence: Synthetic peptide
GADSRKN

SEQ ID NO: 10830 - protein, 7 aa, Artificial Sequence
  Description of Artificial Sequence: Synthetic peptide
YKDELQR

SEQ ID NO: 10831 - protein, 7 aa, Artificial Sequence
  Description of Artificial Sequence: Synthetic peptide
SSDIKMQ

SEQ ID NO: 10832 - protein, 7 aa, Artificial Sequence
  Description of Artificial Sequence: Synthetic peptide
TVGSNAL

SEQ ID NO: 10833 - protein, 7 aa, Artificial Sequence
  Description of Artificial Sequence: Synthetic peptide
VGSNSTH

SEQ ID NO: 10834 - protein, 7 aa, Artificial Sequence
  Description of Artificial Sequence: Synthetic peptide
KSDGSTS

SEQ ID NO: 10835 - protein, 7 aa, Artificial Sequence
  Description of Artificial Sequence: Synthetic peptide
TPSSTNV

SEQ ID NO: 10836 - protein, 7 aa, Artificial Sequence
  Description of Artificial Sequence: Synthetic peptide
APTKSSE

SEQ ID NO: 10837 - protein, 7 aa, Artificial Sequence
  Description of Artificial Sequence: Synthetic peptide
GSMKSSN

SEQ ID NO: 10838 - protein, 7 aa, Artificial Sequence
  Description of Artificial Sequence: Synthetic peptide
GLSGEKP

SEQ ID NO: 10839 - protein, 7 aa, Artificial Sequence
  Description of Artificial Sequence: Synthetic peptide
SAANTSR

SEQ ID NO: 10840 - protein, 7 aa, Artificial Sequence
  Description of Artificial Sequence: Synthetic peptide
GTDSTTR

SEQ ID NO: 10841 - protein, 7 aa, Artificial Sequence
  Description of Artificial Sequence: Synthetic peptide
RTNTTPT

SEQ ID NO: 10842 - protein, 7 aa, Artificial Sequence
  Description of Artificial Sequence: Synthetic peptide
SAGGHGQ

SEQ ID NO: 10843 - protein, 7 aa, Artificial Sequence
  Description of Artificial Sequence: Synthetic peptide
QPLKGNA

SEQ ID NO: 10844 - protein, 7 aa, Artificial Sequence
  Description of Artificial Sequence: Synthetic peptide
HREKASG

SEQ ID NO: 10845 - protein, 7 aa, Artificial Sequence
  Description of Artificial Sequence: Synthetic peptide
LTTRTST

SEQ ID NO: 10846 - protein, 7 aa, Artificial Sequence
  Description of Artificial Sequence: Synthetic peptide
ATDQGKL

SEQ ID NO: 10847 - protein, 7 aa, Artificial Sequence
  Description of Artificial Sequence: Synthetic peptide
ASKEASS

SEQ ID NO: 10848 - protein, 7 aa, Artificial Sequence
  Description of Artificial Sequence: Synthetic peptide
GVVGSPT

SEQ ID NO: 10849 - protein, 7 aa, Artificial Sequence
  Description of Artificial Sequence: Synthetic peptide
AKDGQSR

SEQ ID NO: 10850 - protein, 7 aa, Artificial Sequence
  Description of Artificial Sequence: Synthetic peptide
TSDHSSS

SEQ ID NO: 10851 - protein, 7 aa, Artificial Sequence
  Description of Artificial Sequence: Synthetic peptide
GGSPGVH

SEQ ID NO: 10852 - protein, 7 aa, Artificial Sequence
  Description of Artificial Sequence: Synthetic peptide
KGEGSVH

SEQ ID NO: 10853 - protein, 7 aa, Artificial Sequence
  Description of Artificial Sequence: Synthetic peptide
KGSGNTV

SEQ ID NO: 10854 - protein, 7 aa, Artificial Sequence
  Description of Artificial Sequence: Synthetic peptide
NSGSTPT

SEQ ID NO: 10855 - protein, 7 aa, Artificial Sequence
  Description of Artificial Sequence: Synthetic peptide
TKAGSTV

SEQ ID NO: 10856 - protein, 7 aa, Artificial Sequence
  Description of Artificial Sequence: Synthetic peptide
TDKATSG

SEQ ID NO: 10857 - protein, 7 aa, Artificial Sequence
  Description of Artificial Sequence: Synthetic peptide
SQGSSST

SEQ ID NO: 10858 - protein, 7 aa, Artificial Sequence
  Description of Artificial Sequence: Synthetic peptide
SAGTSGG

SEQ ID NO: 10859 - protein, 7 aa, Artificial Sequence
  Description of Artificial Sequence: Synthetic peptide
SGSTNHG

SEQ ID NO: 10860 - protein, 7 aa, Artificial Sequence
  Description of Artificial Sequence: Synthetic peptide
SGAEKVH

SEQ ID NO: 10861 - protein, 7 aa, Artificial Sequence
  Description of Artificial Sequence: Synthetic peptide
SPAHSGG

SEQ ID NO: 10862 - protein, 7 aa, Artificial Sequence
  Description of Artificial Sequence: Synthetic peptide
SSNSRSS

SEQ ID NO: 10863 - protein, 7 aa, Artificial Sequence
  Description of Artificial Sequence: Synthetic peptide
MSTSPGT

SEQ ID NO: 10864 - protein, 7 aa, Artificial Sequence
  Description of Artificial Sequence: Synthetic peptide
HSEVKSG

SEQ ID NO: 10865 - protein, 7 aa, Artificial Sequence
  Description of Artificial Sequence: Synthetic peptide
ERGGQTT

SEQ ID NO: 10866 - protein, 7 aa, Artificial Sequence
  Description of Artificial Sequence: Synthetic peptide
DSESKNV

SEQ ID NO: 10867 - protein, 7 aa, Artificial Sequence
  Description of Artificial Sequence: Synthetic peptide
EDGASRV

SEQ ID NO: 10868 - protein, 7 aa, Artificial Sequence
  Description of Artificial Sequence: Synthetic peptide
DRQGSVA

SEQ ID NO: 10869 - protein, 7 aa, Artificial Sequence
  Description of Artificial Sequence: Synthetic peptide
ATATKGN

SEQ ID NO: 10870 - protein, 7 aa, Artificial Sequence
  Description of Artificial Sequence: Synthetic peptide
ANKSPPD

SEQ ID NO: 10871 - protein, 7 aa, Artificial Sequence
  Description of Artificial Sequence: Synthetic peptide
ARGASTI

SEQ ID NO: 10872 - protein, 7 aa, Artificial Sequence
  Description of Artificial Sequence: Synthetic peptide
GTANGGP

SEQ ID NO: 10873 - protein, 7 aa, Artificial Sequence
  Description of Artificial Sequence: Synthetic peptide
GGTKALG

SEQ ID NO: 10874 - protein, 7 aa, Artificial Sequence
  Description of Artificial Sequence: Synthetic peptide
GVSSPKQ

SEQ ID NO: 10875 - protein, 7 aa, Artificial Sequence
  Description of Artificial Sequence: Synthetic peptide
VTESSSR

SEQ ID NO: 10876 - protein, 7 aa, Artificial Sequence
  Description of Artificial Sequence: Synthetic peptide
SSKDHPN

SEQ ID NO: 10877 - protein, 7 aa, Artificial Sequence
  Description of Artificial Sequence: Synthetic peptide
FGKSPSN

SEQ ID NO: 10878 - protein, 7 aa, Artificial Sequence
  Description of Artificial Sequence: Synthetic peptide
MMANANQ

SEQ ID NO: 10879 - protein, 7 aa, Artificial Sequence
  Description of Artificial Sequence: Synthetic peptide
NGSKPTI

SEQ ID NO: 10880 - protein, 7 aa, Artificial Sequence
  Description of Artificial Sequence: Synthetic peptide
QRGNTPE

SEQ ID NO: 10881 - protein, 7 aa, Artificial Sequence
  Description of Artificial Sequence: Synthetic peptide
ETHPKAT

SEQ ID NO: 10882 - protein, 7 aa, Artificial Sequence
  Description of Artificial Sequence: Synthetic peptide
GVTSHNS

SEQ ID NO: 10883 - protein, 7 aa, Artificial Sequence
  Description of Artificial Sequence: Synthetic peptide
LSGSQAA

SEQ ID NO: 10884 - protein, 7 aa, Artificial Sequence
  Description of Artificial Sequence: Synthetic peptide
NGASSPN

SEQ ID NO: 10885 - protein, 7 aa, Artificial Sequence
  Description of Artificial Sequence: Synthetic peptide
ISNSTSG

SEQ ID NO: 10886 - protein, 7 aa, Artificial Sequence
  Description of Artificial Sequence: Synthetic peptide
QTVDKPR

SEQ ID NO: 10887 - protein, 7 aa, Artificial Sequence
  Description of Artificial Sequence: Synthetic peptide
RRNGTAE

SEQ ID NO: 10888 - protein, 7 aa, Artificial Sequence
  Description of Artificial Sequence: Synthetic peptide
GLLDSKS

SEQ ID NO: 10889 - protein, 7 aa, Artificial Sequence
  Description of Artificial Sequence: Synthetic peptide
TSKTSQL

SEQ ID NO: 10890 - protein, 7 aa, Artificial Sequence
  Description of Artificial Sequence: Synthetic peptide
SNRSSTA

SEQ ID NO: 10891 - protein, 7 aa, Artificial Sequence
  Description of Artificial Sequence: Synthetic peptide
SNATASA

SEQ ID NO: 10892 - protein, 7 aa, Artificial Sequence
  Description of Artificial Sequence: Synthetic peptide
QNGGKSV

SEQ ID NO: 10893 - protein, 7 aa, Artificial Sequence
  Description of Artificial Sequence: Synthetic peptide
SRESNHS

SEQ ID NO: 10894 - protein, 7 aa, Artificial Sequence
  Description of Artificial Sequence: Synthetic peptide
TQATSSS

SEQ ID NO: 10895 - protein, 7 aa, Artificial Sequence
  Description of Artificial Sequence: Synthetic peptide
STSKNSP

SEQ ID NO: 10896 - protein, 7 aa, Artificial Sequence
  Description of Artificial Sequence: Synthetic peptide
SQKAGSA

SEQ ID NO: 10897 - protein, 7 aa, Artificial Sequence
  Description of Artificial Sequence: Synthetic peptide
SAPGNSG

SEQ ID NO: 10898 - protein, 7 aa, Artificial Sequence
  Description of Artificial Sequence: Synthetic peptide
SLRKDGS

SEQ ID NO: 10899 - protein, 7 aa, Artificial Sequence
  Description of Artificial Sequence: Synthetic peptide
QNETPRS

SEQ ID NO: 10900 - protein, 7 aa, Artificial Sequence
  Description of Artificial Sequence: Synthetic peptide
DIQNPPR

SEQ ID NO: 10901 - protein, 7 aa, Artificial Sequence
  Description of Artificial Sequence: Synthetic peptide
DNNHGKL

SEQ ID NO: 10902 - protein, 7 aa, Artificial Sequence
  Description of Artificial Sequence: Synthetic peptide
AGAGLQS

SEQ ID NO: 10903 - protein, 7 aa, Artificial Sequence
  Description of Artificial Sequence: Synthetic peptide
GSDKVSN

SEQ ID NO: 10904 - protein, 7 aa, Artificial Sequence
  Description of Artificial Sequence: Synthetic peptide
SQTPVGV

SEQ ID NO: 10905 - protein, 7 aa, Artificial Sequence
  Description of Artificial Sequence: Synthetic peptide
DKSQHAM

SEQ ID NO: 10906 - protein, 7 aa, Artificial Sequence
  Description of Artificial Sequence: Synthetic peptide
GASPSNG

SEQ ID NO: 10907 - protein, 7 aa, Artificial Sequence
  Description of Artificial Sequence: Synthetic peptide
HVSSKAD

SEQ ID NO: 10908 - protein, 7 aa, Artificial Sequence
  Description of Artificial Sequence: Synthetic peptide
LAQKSST

SEQ ID NO: 10909 - protein, 7 aa, Artificial Sequence
  Description of Artificial Sequence: Synthetic peptide
IGKSNLS

SEQ ID NO: 10910 - protein, 7 aa, Artificial Sequence
  Description of Artificial Sequence: Synthetic peptide
QASSSQT

SEQ ID NO: 10911 - protein, 7 aa, Artificial Sequence
  Description of Artificial Sequence: Synthetic peptide
RTTTDRA

SEQ ID NO: 10912 - protein, 7 aa, Artificial Sequence
  Description of Artificial Sequence: Synthetic peptide
QDLKTPQ

SEQ ID NO: 10913 - protein, 7 aa, Artificial Sequence
  Description of Artificial Sequence: Synthetic peptide
GAPVSNL

SEQ ID NO: 10914 - protein, 7 aa, Artificial Sequence
  Description of Artificial Sequence: Synthetic peptide
VTRKDSM

SEQ ID NO: 10915 - protein, 7 aa, Artificial Sequence
  Description of Artificial Sequence: Synthetic peptide
ERANHTT

SEQ ID NO: 10916 - protein, 7 aa, Artificial Sequence
  Description of Artificial Sequence: Synthetic peptide
THDNKSI

SEQ ID NO: 10917 - protein, 7 aa, Artificial Sequence
  Description of Artificial Sequence: Synthetic peptide
ETSSTNR

SEQ ID NO: 10918 - protein, 7 aa, Artificial Sequence
  Description of Artificial Sequence: Synthetic peptide
EPDNPSR

SEQ ID NO: 10919 - protein, 7 aa, Artificial Sequence
  Description of Artificial Sequence: Synthetic peptide
GTGQSRA

SEQ ID NO: 10920 - protein, 7 aa, Artificial Sequence
  Description of Artificial Sequence: Synthetic peptide
SGVRDTA

SEQ ID NO: 10921 - protein, 7 aa, Artificial Sequence
  Description of Artificial Sequence: Synthetic peptide
DPGAKPL

SEQ ID NO: 10922 - protein, 7 aa, Artificial Sequence
  Description of Artificial Sequence: Synthetic peptide
GVLNRDK

SEQ ID NO: 10923 - protein, 7 aa, Artificial Sequence
  Description of Artificial Sequence: Synthetic peptide
SQHGTSS

SEQ ID NO: 10924 - protein, 7 aa, Artificial Sequence
  Description of Artificial Sequence: Synthetic peptide
TKDHQAN

SEQ ID NO: 10925 - protein, 7 aa, Artificial Sequence
  Description of Artificial Sequence: Synthetic peptide
TGTNHAL

SEQ ID NO: 10926 - protein, 7 aa, Artificial Sequence
  Description of Artificial Sequence: Synthetic peptide
QNSKPSS

SEQ ID NO: 10927 - protein, 7 aa, Artificial Sequence
  Description of Artificial Sequence: Synthetic peptide
STNGSHG

SEQ ID NO: 10928 - protein, 7 aa, Artificial Sequence
  Description of Artificial Sequence: Synthetic peptide
NSGTHGS

SEQ ID NO: 10929 - protein, 7 aa, Artificial Sequence
  Description of Artificial Sequence: Synthetic peptide
TGSEHQN

SEQ ID NO: 10930 - protein, 7 aa, Artificial Sequence
  Description of Artificial Sequence: Synthetic peptide
SRNDSNK

SEQ ID NO: 10931 - protein, 7 aa, Artificial Sequence
  Description of Artificial Sequence: Synthetic peptide
SLTSANV

SEQ ID NO: 10932 - protein, 7 aa, Artificial Sequence
  Description of Artificial Sequence: Synthetic peptide
HHSTASQ

SEQ ID NO: 10933 - protein, 7 aa, Artificial Sequence
  Description of Artificial Sequence: Synthetic peptide
EESPKKG

SEQ ID NO: 10934 - protein, 7 aa, Artificial Sequence
  Description of Artificial Sequence: Synthetic peptide
AGASSQG

SEQ ID NO: 10935 - protein, 7 aa, Artificial Sequence
  Description of Artificial Sequence: Synthetic peptide
TNQGGNH

SEQ ID NO: 10936 - protein, 7 aa, Artificial Sequence
  Description of Artificial Sequence: Synthetic peptide
ATTAAPV

SEQ ID NO: 10937 - protein, 7 aa, Artificial Sequence
  Description of Artificial Sequence: Synthetic peptide
NGMSSST

SEQ ID NO: 10938 - protein, 7 aa, Artificial Sequence
  Description of Artificial Sequence: Synthetic peptide
SNSETAS

SEQ ID NO: 10939 - protein, 7 aa, Artificial Sequence
  Description of Artificial Sequence: Synthetic peptide
QPVTSNQ

SEQ ID NO: 10940 - protein, 7 aa, Artificial Sequence
  Description of Artificial Sequence: Synthetic peptide
EGRGTSP

SEQ ID NO: 10941 - protein, 7 aa, Artificial Sequence
  Description of Artificial Sequence: Synthetic peptide
DLNAQKS

SEQ ID NO: 10942 - protein, 7 aa, Artificial Sequence
  Description of Artificial Sequence: Synthetic peptide
GAANDTR

SEQ ID NO: 10943 - protein, 7 aa, Artificial Sequence
  Description of Artificial Sequence: Synthetic peptide
LNNTSSG

SEQ ID NO: 10944 - protein, 7 aa, Artificial Sequence
  Description of Artificial Sequence: Synthetic peptide
NQTSNPH

SEQ ID NO: 10945 - protein, 7 aa, Artificial Sequence
  Description of Artificial Sequence: Synthetic peptide
TRQNSSN

SEQ ID NO: 10946 - protein, 7 aa, Artificial Sequence
  Description of Artificial Sequence: Synthetic peptide
SNAGGKS

SEQ ID NO: 10947 - protein, 7 aa, Artificial Sequence
  Description of Artificial Sequence: Synthetic peptide
SSDTSKG

SEQ ID NO: 10948 - protein, 7 aa, Artificial Sequence
  Description of Artificial Sequence: Synthetic peptide
SEVAKSG

SEQ ID NO: 10949 - protein, 7 aa, Artificial Sequence
  Description of Artificial Sequence: Synthetic peptide
SDVKAHN

SEQ ID NO: 10950 - protein, 7 aa, Artificial Sequence
  Description of Artificial Sequence: Synthetic peptide
LGADRVA

SEQ ID NO: 10951 - protein, 7 aa, Artificial Sequence
  Description of Artificial Sequence: Synthetic peptide
DSRTTSG

SEQ ID NO: 10952 - protein, 7 aa, Artificial Sequence
  Description of Artificial Sequence: Synthetic peptide
ASSTSTR

SEQ ID NO: 10953 - protein, 7 aa, Artificial Sequence
  Description of Artificial Sequence: Synthetic peptide
CSQPKAG

SEQ ID NO: 10954 - protein, 7 aa, Artificial Sequence
  Description of Artificial Sequence: Synthetic peptide
GLEGASR

SEQ ID NO: 10955 - protein, 7 aa, Artificial Sequence
  Description of Artificial Sequence: Synthetic peptide
TQSDRPP

SEQ ID NO: 10956 - protein, 7 aa, Artificial Sequence
  Description of Artificial Sequence: Synthetic peptide
TQTQSAS

SEQ ID NO: 10957 - protein, 7 aa, Artificial Sequence
  Description of Artificial Sequence: Synthetic peptide
QGSENGR

SEQ ID NO: 10958 - protein, 7 aa, Artificial Sequence
  Description of Artificial Sequence: Synthetic peptide
EGNSSRS

SEQ ID NO: 10959 - protein, 7 aa, Artificial Sequence
  Description of Artificial Sequence: Synthetic peptide
DTPAAAK

SEQ ID NO: 10960 - protein, 7 aa, Artificial Sequence
  Description of Artificial Sequence: Synthetic peptide
AASNGPS

SEQ ID NO: 10961 - protein, 7 aa, Artificial Sequence
  Description of Artificial Sequence: Synthetic peptide
GATSSAS

SEQ ID NO: 10962 - protein, 7 aa, Artificial Sequence
  Description of Artificial Sequence: Synthetic peptide
SQSTPSV

SEQ ID NO: 10963 - protein, 7 aa, Artificial Sequence
  Description of Artificial Sequence: Synthetic peptide
TSKSTST

SEQ ID NO: 10964 - protein, 7 aa, Artificial Sequence
  Description of Artificial Sequence: Synthetic peptide
DGPRTSV

SEQ ID NO: 10965 - protein, 7 aa, Artificial Sequence
  Description of Artificial Sequence: Synthetic peptide
SNSARLG

SEQ ID NO: 10966 - protein, 7 aa, Artificial Sequence
  Description of Artificial Sequence: Synthetic peptide
TPTDGRS

SEQ ID NO: 10967 - protein, 7 aa, Artificial Sequence
  Description of Artificial Sequence: Synthetic peptide
TPNSRPE

SEQ ID NO: 10968 - protein, 7 aa, Artificial Sequence
  Description of Artificial Sequence: Synthetic peptide
TSNAHNV

SEQ ID NO: 10969 - protein, 7 aa, Artificial Sequence
  Description of Artificial Sequence: Synthetic peptide
STAASTA

SEQ ID NO: 10970 - protein, 7 aa, Artificial Sequence
  Description of Artificial Sequence: Synthetic peptide
SLGNQGA

SEQ ID NO: 10971 - protein, 7 aa, Artificial Sequence
  Description of Artificial Sequence: Synthetic peptide
ENSRVGT

SEQ ID NO: 10972 - protein, 7 aa, Artificial Sequence
  Description of Artificial Sequence: Synthetic peptide
EGKASVL

SEQ ID NO: 10973 - protein, 7 aa, Artificial Sequence
  Description of Artificial Sequence: Synthetic peptide
DSRTAGN

SEQ ID NO: 10974 - protein, 7 aa, Artificial Sequence
  Description of Artificial Sequence: Synthetic peptide
GRQGTDK

SEQ ID NO: 10975 - protein, 7 aa, Artificial Sequence
  Description of Artificial Sequence: Synthetic peptide
GPSSTIS

SEQ ID NO: 10976 - protein, 7 aa, Artificial Sequence
  Description of Artificial Sequence: Synthetic peptide
GALPSQT

SEQ ID NO: 10977 - protein, 7 aa, Artificial Sequence
  Description of Artificial Sequence: Synthetic peptide
GSNGGRS

SEQ ID NO: 10978 - protein, 7 aa, Artificial Sequence
  Description of Artificial Sequence: Synthetic peptide
GLGEDRV

SEQ ID NO: 10979 - protein, 7 aa, Artificial Sequence
  Description of Artificial Sequence: Synthetic peptide
SQNTGHP

SEQ ID NO: 10980 - protein, 7 aa, Artificial Sequence
  Description of Artificial Sequence: Synthetic peptide
TSGSARD

SEQ ID NO: 10981 - protein, 7 aa, Artificial Sequence
  Description of Artificial Sequence: Synthetic peptide
AQGQGHA

SEQ ID NO: 10982 - protein, 7 aa, Artificial Sequence
  Description of Artificial Sequence: Synthetic peptide
LAAGSSG

SEQ ID NO: 10983 - protein, 7 aa, Artificial Sequence
  Description of Artificial Sequence: Synthetic peptide
NLSTAGS

SEQ ID NO: 10984 - protein, 7 aa, Artificial Sequence
  Description of Artificial Sequence: Synthetic peptide
TSNANNK

SEQ ID NO: 10985 - protein, 7 aa, Artificial Sequence
  Description of Artificial Sequence: Synthetic peptide
RGTPPSD

SEQ ID NO: 10986 - protein, 7 aa, Artificial Sequence
  Description of Artificial Sequence: Synthetic peptide
SANQAGS

SEQ ID NO: 10987 - protein, 7 aa, Artificial Sequence
  Description of Artificial Sequence: Synthetic peptide
QKGETVA

SEQ ID NO: 10988 - protein, 7 aa, Artificial Sequence
  Description of Artificial Sequence: Synthetic peptide
SQSSGVS

SEQ ID NO: 10989 - protein, 7 aa, Artificial Sequence
  Description of Artificial Sequence: Synthetic peptide
LSGKAGG

SEQ ID NO: 10990 - protein, 7 aa, Artificial Sequence
  Description of Artificial Sequence: Synthetic peptide
SSGSNHI

SEQ ID NO: 10991 - protein, 7 aa, Artificial Sequence
  Description of Artificial Sequence: Synthetic peptide
RQGSTPA

SEQ ID NO: 10992 - protein, 7 aa, Artificial Sequence
  Description of Artificial Sequence: Synthetic peptide
DALSKTS

SEQ ID NO: 10993 - protein, 7 aa, Artificial Sequence
  Description of Artificial Sequence: Synthetic peptide
GARSPTN

SEQ ID NO: 10994 - protein, 7 aa, Artificial Sequence
  Description of Artificial Sequence: Synthetic peptide
LPTQHSS

SEQ ID NO: 10995 - protein, 7 aa, Artificial Sequence
  Description of Artificial Sequence: Synthetic peptide
VTSSGSQ

SEQ ID NO: 10996 - protein, 7 aa, Artificial Sequence
  Description of Artificial Sequence: Synthetic peptide
KTESPMA

SEQ ID NO: 10997 - protein, 7 aa, Artificial Sequence
  Description of Artificial Sequence: Synthetic peptide
TPDQKMV

SEQ ID NO: 10998 - protein, 7 aa, Artificial Sequence
  Description of Artificial Sequence: Synthetic peptide
SNMERPS

SEQ ID NO: 10999 - protein, 7 aa, Artificial Sequence
  Description of Artificial Sequence: Synthetic peptide
SNDKLNA

SEQ ID NO: 11000 - protein, 7 aa, Artificial Sequence
  Description of Artificial Sequence: Synthetic peptide
LLSNKSG

SEQ ID NO: 11001 - protein, 7 aa, Artificial Sequence
  Description of Artificial Sequence: Synthetic peptide
AGASPGR

SEQ ID NO: 11002 - protein, 7 aa, Artificial Sequence
  Description of Artificial Sequence: Synthetic peptide
SGQGEHS

SEQ ID NO: 11003 - protein, 7 aa, Artificial Sequence
  Description of Artificial Sequence: Synthetic peptide
TGKPSTL

SEQ ID NO: 11004 - protein, 7 aa, Artificial Sequence
  Description of Artificial Sequence: Synthetic peptide
SPTEPVR

SEQ ID NO: 11005 - protein, 7 aa, Artificial Sequence
  Description of Artificial Sequence: Synthetic peptide
GAGTHGA

SEQ ID NO: 11006 - protein, 7 aa, Artificial Sequence
  Description of Artificial Sequence: Synthetic peptide
NQQQTTT

SEQ ID NO: 11007 - protein, 7 aa, Artificial Sequence
  Description of Artificial Sequence: Synthetic peptide
EGSSPVM

SEQ ID NO: 11008 - protein, 7 aa, Artificial Sequence
  Description of Artificial Sequence: Synthetic peptide
SRENVPS

SEQ ID NO: 11009 - protein, 7 aa, Artificial Sequence
  Description of Artificial Sequence: Synthetic peptide
SGQTQRA

SEQ ID NO: 11010 - protein, 7 aa, Artificial Sequence
  Description of Artificial Sequence: Synthetic peptide
TGVSGHL

SEQ ID NO: 11011 - protein, 7 aa, Artificial Sequence
  Description of Artificial Sequence: Synthetic peptide
EAQSGSR

SEQ ID NO: 11012 - protein, 7 aa, Artificial Sequence
  Description of Artificial Sequence: Synthetic peptide
TNASKPS

SEQ ID NO: 11013 - protein, 7 aa, Artificial Sequence
  Description of Artificial Sequence: Synthetic peptide
NTGQKGL

SEQ ID NO: 11014 - protein, 7 aa, Artificial Sequence
  Description of Artificial Sequence: Synthetic peptide
VKDAPKT

SEQ ID NO: 11015 - protein, 7 aa, Artificial Sequence
  Description of Artificial Sequence: Synthetic peptide
QVGKNPL

SEQ ID NO: 11016 - protein, 7 aa, Artificial Sequence
  Description of Artificial Sequence: Synthetic peptide
DKQKSSY

SEQ ID NO: 11017 - protein, 7 aa, Artificial Sequence
  Description of Artificial Sequence: Synthetic peptide
DGSGNLR

SEQ ID NO: 11018 - protein, 7 aa, Artificial Sequence
  Description of Artificial Sequence: Synthetic peptide
AEQSVTK

SEQ ID NO: 11019 - protein, 7 aa, Artificial Sequence
  Description of Artificial Sequence: Synthetic peptide
AGVTGHR

SEQ ID NO: 11020 - protein, 7 aa, Artificial Sequence
  Description of Artificial Sequence: Synthetic peptide
VKGQAGQ

SEQ ID NO: 11021 - protein, 7 aa, Artificial Sequence
  Description of Artificial Sequence: Synthetic peptide
IGTGASR

SEQ ID NO: 11022 - protein, 7 aa, Artificial Sequence
  Description of Artificial Sequence: Synthetic peptide
SSKPSPD

SEQ ID NO: 11023 - protein, 7 aa, Artificial Sequence
  Description of Artificial Sequence: Synthetic peptide
IHNDSVK

SEQ ID NO: 11024 - protein, 7 aa, Artificial Sequence
  Description of Artificial Sequence: Synthetic peptide
QNPAATS

SEQ ID NO: 11025 - protein, 7 aa, Artificial Sequence
  Description of Artificial Sequence: Synthetic peptide
RTESTAR

SEQ ID NO: 11026 - protein, 7 aa, Artificial Sequence
  Description of Artificial Sequence: Synthetic peptide
MNTGSPT

SEQ ID NO: 11027 - protein, 7 aa, Artificial Sequence
  Description of Artificial Sequence: Synthetic peptide
AGEGKLS

SEQ ID NO: 11028 - protein, 7 aa, Artificial Sequence
  Description of Artificial Sequence: Synthetic peptide
SSSNAMK

SEQ ID NO: 11029 - protein, 7 aa, Artificial Sequence
  Description of Artificial Sequence: Synthetic peptide
TDGKHQG

SEQ ID NO: 11030 - protein, 7 aa, Artificial Sequence
  Description of Artificial Sequence: Synthetic peptide
DASPGHT

SEQ ID NO: 11031 - protein, 7 aa, Artificial Sequence
  Description of Artificial Sequence: Synthetic peptide
STGSQSP

SEQ ID NO: 11032 - protein, 7 aa, Artificial Sequence
  Description of Artificial Sequence: Synthetic peptide
LNGATTA

SEQ ID NO: 11033 - protein, 7 aa, Artificial Sequence
  Description of Artificial Sequence: Synthetic peptide
NLTSSGG

SEQ ID NO: 11034 - protein, 7 aa, Artificial Sequence
  Description of Artificial Sequence: Synthetic peptide
NASSERH

SEQ ID NO: 11035 - protein, 7 aa, Artificial Sequence
  Description of Artificial Sequence: Synthetic peptide
SLPSNGG

SEQ ID NO: 11036 - protein, 7 aa, Artificial Sequence
  Description of Artificial Sequence: Synthetic peptide
MDSRNSG

SEQ ID NO: 11037 - protein, 7 aa, Artificial Sequence
  Description of Artificial Sequence: Synthetic peptide
GASKGPY

SEQ ID NO: 11038 - protein, 7 aa, Artificial Sequence
  Description of Artificial Sequence: Synthetic peptide
SLAQTPK

SEQ ID NO: 11039 - protein, 7 aa, Artificial Sequence
  Description of Artificial Sequence: Synthetic peptide
HSESKQS

SEQ ID NO: 11040 - protein, 7 aa, Artificial Sequence
  Description of Artificial Sequence: Synthetic peptide
KVTDKSL

SEQ ID NO: 11041 - protein, 7 aa, Artificial Sequence
  Description of Artificial Sequence: Synthetic peptide
QMPGEHS

SEQ ID NO: 11042 - protein, 7 aa, Artificial Sequence
  Description of Artificial Sequence: Synthetic peptide
QDTQQPR

SEQ ID NO: 11043 - protein, 7 aa, Artificial Sequence
  Description of Artificial Sequence: Synthetic peptide
QGKTGST

SEQ ID NO: 11044 - protein, 7 aa, Artificial Sequence
  Description of Artificial Sequence: Synthetic peptide
GNSTSAV

SEQ ID NO: 11045 - protein, 7 aa, Artificial Sequence
  Description of Artificial Sequence: Synthetic peptide
GGNSKGV

SEQ ID NO: 11046 - protein, 7 aa, Artificial Sequence
  Description of Artificial Sequence: Synthetic peptide
SSAGSSA

SEQ ID NO: 11047 - protein, 7 aa, Artificial Sequence
  Description of Artificial Sequence: Synthetic peptide
QGDAARV

SEQ ID NO: 11048 - protein, 7 aa, Artificial Sequence
  Description of Artificial Sequence: Synthetic peptide
HHGQNGS

SEQ ID NO: 11049 - protein, 7 aa, Artificial Sequence
  Description of Artificial Sequence: Synthetic peptide
ANEPNLR

SEQ ID NO: 11050 - protein, 7 aa, Artificial Sequence
  Description of Artificial Sequence: Synthetic peptide
VNSGHTV

SEQ ID NO: 11051 - protein, 7 aa, Artificial Sequence
  Description of Artificial Sequence: Synthetic peptide
VPSSQSK

SEQ ID NO: 11052 - protein, 7 aa, Artificial Sequence
  Description of Artificial Sequence: Synthetic peptide
GLSTKDS

SEQ ID NO: 11053 - protein, 7 aa, Artificial Sequence
  Description of Artificial Sequence: Synthetic peptide
STQPSVK

SEQ ID NO: 11054 - protein, 7 aa, Artificial Sequence
  Description of Artificial Sequence: Synthetic peptide
QMSEPKQ

SEQ ID NO: 11055 - protein, 7 aa, Artificial Sequence
  Description of Artificial Sequence: Synthetic peptide
NHNPPSG

SEQ ID NO: 11056 - protein, 7 aa, Artificial Sequence
  Description of Artificial Sequence: Synthetic peptide
KGQLANV

SEQ ID NO: 11057 - protein, 7 aa, Artificial Sequence
  Description of Artificial Sequence: Synthetic peptide
TDTANPR

SEQ ID NO: 11058 - protein, 7 aa, Artificial Sequence
  Description of Artificial Sequence: Synthetic peptide
SVQRNGE

SEQ ID NO: 11059 - protein, 7 aa, Artificial Sequence
  Description of Artificial Sequence: Synthetic peptide
GTKSPTQ

SEQ ID NO: 11060 - protein, 7 aa, Artificial Sequence
  Description of Artificial Sequence: Synthetic peptide
SSTSTHG

SEQ ID NO: 11061 - protein, 7 aa, Artificial Sequence
  Description of Artificial Sequence: Synthetic peptide
GVTKGSS

SEQ ID NO: 11062 - protein, 7 aa, Artificial Sequence
  Description of Artificial Sequence: Synthetic peptide
NSGSNGG

SEQ ID NO: 11063 - protein, 7 aa, Artificial Sequence
  Description of Artificial Sequence: Synthetic peptide
SVGSTNG

SEQ ID NO: 11064 - protein, 7 aa, Artificial Sequence
  Description of Artificial Sequence: Synthetic peptide
DVATSNR

SEQ ID NO: 11065 - protein, 7 aa, Artificial Sequence
  Description of Artificial Sequence: Synthetic peptide
GLVKPNM

SEQ ID NO: 11066 - protein, 7 aa, Artificial Sequence
  Description of Artificial Sequence: Synthetic peptide
SKASAPS

SEQ ID NO: 11067 - protein, 7 aa, Artificial Sequence
  Description of Artificial Sequence: Synthetic peptide
SMSSSNT

SEQ ID NO: 11068 - protein, 7 aa, Artificial Sequence
  Description of Artificial Sequence: Synthetic peptide
SGAGGTS

SEQ ID NO: 11069 - protein, 7 aa, Artificial Sequence
  Description of Artificial Sequence: Synthetic peptide
MRDNQTQ

SEQ ID NO: 11070 - protein, 7 aa, Artificial Sequence
  Description of Artificial Sequence: Synthetic peptide
GNKQQPL

SEQ ID NO: 11071 - protein, 7 aa, Artificial Sequence
  Description of Artificial Sequence: Synthetic peptide
SPLSSKD

SEQ ID NO: 11072 - protein, 7 aa, Artificial Sequence
  Description of Artificial Sequence: Synthetic peptide
TGSDPLK

SEQ ID NO: 11073 - protein, 7 aa, Artificial Sequence
  Description of Artificial Sequence: Synthetic peptide
MTTGSTP

SEQ ID NO: 11074 - protein, 7 aa, Artificial Sequence
  Description of Artificial Sequence: Synthetic peptide
QNDGNRH

SEQ ID NO: 11075 - protein, 7 aa, Artificial Sequence
  Description of Artificial Sequence: Synthetic peptide
DSGNGKL

SEQ ID NO: 11076 - protein, 7 aa, Artificial Sequence
  Description of Artificial Sequence: Synthetic peptide
ARDNNNI

SEQ ID NO: 11077 - protein, 7 aa, Artificial Sequence
  Description of Artificial Sequence: Synthetic peptide
STTSPNS

SEQ ID NO: 11078 - protein, 7 aa, Artificial Sequence
  Description of Artificial Sequence: Synthetic peptide
NRTTSSQ

SEQ ID NO: 11079 - protein, 7 aa, Artificial Sequence
  Description of Artificial Sequence: Synthetic peptide
IATSHST

SEQ ID NO: 11080 - protein, 7 aa, Artificial Sequence
  Description of Artificial Sequence: Synthetic peptide
QPQKDSV

SEQ ID NO: 11081 - protein, 7 aa, Artificial Sequence
  Description of Artificial Sequence: Synthetic peptide
HAGKTTL

SEQ ID NO: 11082 - protein, 7 aa, Artificial Sequence
  Description of Artificial Sequence: Synthetic peptide
LQAAGST

SEQ ID NO: 11083 - protein, 7 aa, Artificial Sequence
  Description of Artificial Sequence: Synthetic peptide
QGSAPVQ

SEQ ID NO: 11084 - protein, 7 aa, Artificial Sequence
  Description of Artificial Sequence: Synthetic peptide
TSGNTSG

SEQ ID NO: 11085 - protein, 7 aa, Artificial Sequence
  Description of Artificial Sequence: Synthetic peptide
QVKTPNV

SEQ ID NO: 11086 - protein, 7 aa, Artificial Sequence
  Description of Artificial Sequence: Synthetic peptide
SGNTPSL

SEQ ID NO: 11087 - protein, 7 aa, Artificial Sequence
  Description of Artificial Sequence: Synthetic peptide
GNTQGIS

SEQ ID NO: 11088 - protein, 7 aa, Artificial Sequence
  Description of Artificial Sequence: Synthetic peptide
KGTNGAS

SEQ ID NO: 11089 - protein, 7 aa, Artificial Sequence
  Description of Artificial Sequence: Synthetic peptide
NSGQKID

SEQ ID NO: 11090 - protein, 7 aa, Artificial Sequence
  Description of Artificial Sequence: Synthetic peptide
TKISGAT

SEQ ID NO: 11091 - protein, 7 aa, Artificial Sequence
  Description of Artificial Sequence: Synthetic peptide
TMPKGDN

SEQ ID NO: 11092 - protein, 7 aa, Artificial Sequence
  Description of Artificial Sequence: Synthetic peptide
TRSNSNN

SEQ ID NO: 11093 - protein, 7 aa, Artificial Sequence
  Description of Artificial Sequence: Synthetic peptide
TGDSPTH

SEQ ID NO: 11094 - protein, 7 aa, Artificial Sequence
  Description of Artificial Sequence: Synthetic peptide
TPGTSRV

SEQ ID NO: 11095 - protein, 7 aa, Artificial Sequence
  Description of Artificial Sequence: Synthetic peptide
TSPGSHT

SEQ ID NO: 11096 - protein, 7 aa, Artificial Sequence
  Description of Artificial Sequence: Synthetic peptide
SKSTLAT

SEQ ID NO: 11097 - protein, 7 aa, Artificial Sequence
  Description of Artificial Sequence: Synthetic peptide
STASNPV

SEQ ID NO: 11098 - protein, 7 aa, Artificial Sequence
  Description of Artificial Sequence: Synthetic peptide
SSTNAQS

SEQ ID NO: 11099 - protein, 7 aa, Artificial Sequence
  Description of Artificial Sequence: Synthetic peptide
SADTKTS

SEQ ID NO: 11100 - protein, 7 aa, Artificial Sequence
  Description of Artificial Sequence: Synthetic peptide
SPMASKG

SEQ ID NO: 11101 - protein, 7 aa, Artificial Sequence
  Description of Artificial Sequence: Synthetic peptide
SGDTVHR

SEQ ID NO: 11102 - protein, 7 aa, Artificial Sequence
  Description of Artificial Sequence: Synthetic peptide
QTGRDST

SEQ ID NO: 11103 - protein, 7 aa, Artificial Sequence
  Description of Artificial Sequence: Synthetic peptide
QPNNGTR

SEQ ID NO: 11104 - protein, 7 aa, Artificial Sequence
  Description of Artificial Sequence: Synthetic peptide
QPAKGNM

SEQ ID NO: 11105 - protein, 7 aa, Artificial Sequence
  Description of Artificial Sequence: Synthetic peptide
RNGQTAG

SEQ ID NO: 11106 - protein, 7 aa, Artificial Sequence
  Description of Artificial Sequence: Synthetic peptide
LKSSSGG

SEQ ID NO: 11107 - protein, 7 aa, Artificial Sequence
  Description of Artificial Sequence: Synthetic peptide
EINKSNM

SEQ ID NO: 11108 - protein, 7 aa, Artificial Sequence
  Description of Artificial Sequence: Synthetic peptide
DRGGSTH

SEQ ID NO: 11109 - protein, 7 aa, Artificial Sequence
  Description of Artificial Sequence: Synthetic peptide
DSGHEKP

SEQ ID NO: 11110 - protein, 7 aa, Artificial Sequence
  Description of Artificial Sequence: Synthetic peptide
ETGSERT

SEQ ID NO: 11111 - protein, 7 aa, Artificial Sequence
  Description of Artificial Sequence: Synthetic peptide
EAKEPRS

SEQ ID NO: 11112 - protein, 7 aa, Artificial Sequence
  Description of Artificial Sequence: Synthetic peptide
EGGSTQV

SEQ ID NO: 11113 - protein, 7 aa, Artificial Sequence
  Description of Artificial Sequence: Synthetic peptide
EGSRKMD

SEQ ID NO: 11114 - protein, 7 aa, Artificial Sequence
  Description of Artificial Sequence: Synthetic peptide
DVNDRRT

SEQ ID NO: 11115 - protein, 7 aa, Artificial Sequence
  Description of Artificial Sequence: Synthetic peptide
AKADKNT

SEQ ID NO: 11116 - protein, 7 aa, Artificial Sequence
  Description of Artificial Sequence: Synthetic peptide
AGGQVTR

SEQ ID NO: 11117 - protein, 7 aa, Artificial Sequence
  Description of Artificial Sequence: Synthetic peptide
AGHSAPA

SEQ ID NO: 11118 - protein, 7 aa, Artificial Sequence
  Description of Artificial Sequence: Synthetic peptide
GITSSNK

SEQ ID NO: 11119 - protein, 7 aa, Artificial Sequence
  Description of Artificial Sequence: Synthetic peptide
GKGNSTA

SEQ ID NO: 11120 - protein, 7 aa, Artificial Sequence
  Description of Artificial Sequence: Synthetic peptide
STNAHSG

SEQ ID NO: 11121 - protein, 7 aa, Artificial Sequence
  Description of Artificial Sequence: Synthetic peptide
SDSRATV

SEQ ID NO: 11122 - protein, 7 aa, Artificial Sequence
  Description of Artificial Sequence: Synthetic peptide
SVNSPAL

SEQ ID NO: 11123 - protein, 7 aa, Artificial Sequence
  Description of Artificial Sequence: Synthetic peptide
GSSKGSG

SEQ ID NO: 11124 - protein, 7 aa, Artificial Sequence
  Description of Artificial Sequence: Synthetic peptide
AGGERPN

SEQ ID NO: 11125 - protein, 7 aa, Artificial Sequence
  Description of Artificial Sequence: Synthetic peptide
SGSDRTR

SEQ ID NO: 11126 - protein, 7 aa, Artificial Sequence
  Description of Artificial Sequence: Synthetic peptide
ATTSDRS

SEQ ID NO: 11127 - protein, 7 aa, Artificial Sequence
  Description of Artificial Sequence: Synthetic peptide
ERSQSVS

SEQ ID NO: 11128 - protein, 7 aa, Artificial Sequence
  Description of Artificial Sequence: Synthetic peptide
SRTQSVS

SEQ ID NO: 11129 - protein, 7 aa, Artificial Sequence
  Description of Artificial Sequence: Synthetic peptide
DGSSTHI

SEQ ID NO: 11130 - protein, 7 aa, Artificial Sequence
  Description of Artificial Sequence: Synthetic peptide
TATQAST

SEQ ID NO: 11131 - protein, 7 aa, Artificial Sequence
  Description of Artificial Sequence: Synthetic peptide
GSATQHS

SEQ ID NO: 11132 - protein, 7 aa, Artificial Sequence
  Description of Artificial Sequence: Synthetic peptide
FTEPSSK

SEQ ID NO: 11133 - protein, 7 aa, Artificial Sequence
  Description of Artificial Sequence: Synthetic peptide
DQTMKTG

SEQ ID NO: 11134 - protein, 7 aa, Artificial Sequence
  Description of Artificial Sequence: Synthetic peptide
DLQPTSR

SEQ ID NO: 11135 - protein, 7 aa, Artificial Sequence
  Description of Artificial Sequence: Synthetic peptide
VQSGKGS

SEQ ID NO: 11136 - protein, 7 aa, Artificial Sequence
  Description of Artificial Sequence: Synthetic peptide
SRSDSVS

SEQ ID NO: 11137 - protein, 7 aa, Artificial Sequence
  Description of Artificial Sequence: Synthetic peptide
QTSKPSA

SEQ ID NO: 11138 - protein, 7 aa, Artificial Sequence
  Description of Artificial Sequence: Synthetic peptide
QTSERPV

SEQ ID NO: 11139 - protein, 7 aa, Artificial Sequence
  Description of Artificial Sequence: Synthetic peptide
DSSRVSS

SEQ ID NO: 11140 - protein, 7 aa, Artificial Sequence
  Description of Artificial Sequence: Synthetic peptide
GIGNDTT

SEQ ID NO: 11141 - protein, 7 aa, Artificial Sequence
  Description of Artificial Sequence: Synthetic peptide
STVVKSE

SEQ ID NO: 11142 - protein, 7 aa, Artificial Sequence
  Description of Artificial Sequence: Synthetic peptide
SPVTSEG

SEQ ID NO: 11143 - protein, 7 aa, Artificial Sequence
  Description of Artificial Sequence: Synthetic peptide
FGSTSAH

SEQ ID NO: 11144 - protein, 7 aa, Artificial Sequence
  Description of Artificial Sequence: Synthetic peptide
VGKGPSN

SEQ ID NO: 11145 - protein, 7 aa, Artificial Sequence
  Description of Artificial Sequence: Synthetic peptide
GDRPSAM

SEQ ID NO: 11146 - protein, 7 aa, Artificial Sequence
  Description of Artificial Sequence: Synthetic peptide
QRDVGAK

SEQ ID NO: 11147 - protein, 7 aa, Artificial Sequence
  Description of Artificial Sequence: Synthetic peptide
TQGTTPV

SEQ ID NO: 11148 - protein, 7 aa, Artificial Sequence
  Description of Artificial Sequence: Synthetic peptide
AKSEQGT

SEQ ID NO: 11149 - protein, 7 aa, Artificial Sequence
  Description of Artificial Sequence: Synthetic peptide
ALNSSKS

SEQ ID NO: 11150 - protein, 7 aa, Artificial Sequence
  Description of Artificial Sequence: Synthetic peptide
GSSGSKS

SEQ ID NO: 11151 - protein, 7 aa, Artificial Sequence
  Description of Artificial Sequence: Synthetic peptide
SSSSQAN

SEQ ID NO: 11152 - protein, 7 aa, Artificial Sequence
  Description of Artificial Sequence: Synthetic peptide
VLTKGSA

SEQ ID NO: 11153 - protein, 7 aa, Artificial Sequence
  Description of Artificial Sequence: Synthetic peptide
NRAPNSA

SEQ ID NO: 11154 - protein, 7 aa, Artificial Sequence
  Description of Artificial Sequence: Synthetic peptide
EGSSASG

SEQ ID NO: 11155 - protein, 7 aa, Artificial Sequence
  Description of Artificial Sequence: Synthetic peptide
TTASSPG

SEQ ID NO: 11156 - protein, 7 aa, Artificial Sequence
  Description of Artificial Sequence: Synthetic peptide
SEARGNN

SEQ ID NO: 11157 - protein, 7 aa, Artificial Sequence
  Description of Artificial Sequence: Synthetic peptide
NEKGATK

SEQ ID NO: 11158 - protein, 7 aa, Artificial Sequence
  Description of Artificial Sequence: Synthetic peptide
SSSEKLQ

SEQ ID NO: 11159 - protein, 7 aa, Artificial Sequence
  Description of Artificial Sequence: Synthetic peptide
DGNPTKE

SEQ ID NO: 11160 - protein, 7 aa, Artificial Sequence
  Description of Artificial Sequence: Synthetic peptide
SGRDTNS

SEQ ID NO: 11161 - protein, 7 aa, Artificial Sequence
  Description of Artificial Sequence: Synthetic peptide
RTTTDSK

SEQ ID NO: 11162 - protein, 7 aa, Artificial Sequence
  Description of Artificial Sequence: Synthetic peptide
ESRAPVS

SEQ ID NO: 11163 - protein, 7 aa, Artificial Sequence
  Description of Artificial Sequence: Synthetic peptide
ARNDSMI

SEQ ID NO: 11164 - protein, 7 aa, Artificial Sequence
  Description of Artificial Sequence: Synthetic peptide
STNQAPM

SEQ ID NO: 11165 - protein, 7 aa, Artificial Sequence
  Description of Artificial Sequence: Synthetic peptide
AGMQKFT

SEQ ID NO: 11166 - protein, 7 aa, Artificial Sequence
  Description of Artificial Sequence: Synthetic peptide
SSQPSNK

SEQ ID NO: 11167 - protein, 7 aa, Artificial Sequence
  Description of Artificial Sequence: Synthetic peptide
QPGKIAT

SEQ ID NO: 11168 - protein, 7 aa, Artificial Sequence
  Description of Artificial Sequence: Synthetic peptide
LQKSPSI

SEQ ID NO: 11169 - protein, 7 aa, Artificial Sequence
  Description of Artificial Sequence: Synthetic peptide
APTQGSG

SEQ ID NO: 11170 - protein, 7 aa, Artificial Sequence
  Description of Artificial Sequence: Synthetic peptide
LPDGLKG

SEQ ID NO: 11171 - protein, 7 aa, Artificial Sequence
  Description of Artificial Sequence: Synthetic peptide
TTEQNRQ

SEQ ID NO: 11172 - protein, 7 aa, Artificial Sequence
  Description of Artificial Sequence: Synthetic peptide
AANDKLR

SEQ ID NO: 11173 - protein, 7 aa, Artificial Sequence
  Description of Artificial Sequence: Synthetic peptide
TSGDKQL

SEQ ID NO: 11174 - protein, 7 aa, Artificial Sequence
  Description of Artificial Sequence: Synthetic peptide
TVTPATS

SEQ ID NO: 11175 - protein, 7 aa, Artificial Sequence
  Description of Artificial Sequence: Synthetic peptide
HSQKGGM

SEQ ID NO: 11176 - protein, 7 aa, Artificial Sequence
  Description of Artificial Sequence: Synthetic peptide
DPGVSAR

SEQ ID NO: 11177 - protein, 7 aa, Artificial Sequence
  Description of Artificial Sequence: Synthetic peptide
GTSKTQS

SEQ ID NO: 11178 - protein, 7 aa, Artificial Sequence
  Description of Artificial Sequence: Synthetic peptide
TGSSQSH

SEQ ID NO: 11179 - protein, 7 aa, Artificial Sequence
  Description of Artificial Sequence: Synthetic peptide
ELLQKPT

SEQ ID NO: 11180 - protein, 7 aa, Artificial Sequence
  Description of Artificial Sequence: Synthetic peptide
EASSNRG

SEQ ID NO: 11181 - protein, 7 aa, Artificial Sequence
  Description of Artificial Sequence: Synthetic peptide
GPGPSTN

SEQ ID NO: 11182 - protein, 7 aa, Artificial Sequence
  Description of Artificial Sequence: Synthetic peptide
GTGSKLG

SEQ ID NO: 11183 - protein, 7 aa, Artificial Sequence
  Description of Artificial Sequence: Synthetic peptide
GIHQNSG

SEQ ID NO: 11184 - protein, 7 aa, Artificial Sequence
  Description of Artificial Sequence: Synthetic peptide
STGNPPR

SEQ ID NO: 11185 - protein, 7 aa, Artificial Sequence
  Description of Artificial Sequence: Synthetic peptide
DQHDRRA

SEQ ID NO: 11186 - protein, 7 aa, Artificial Sequence
  Description of Artificial Sequence: Synthetic peptide
GSGANKP

SEQ ID NO: 11187 - protein, 7 aa, Artificial Sequence
  Description of Artificial Sequence: Synthetic peptide
QGSSNGI

SEQ ID NO: 11188 - protein, 7 aa, Artificial Sequence
  Description of Artificial Sequence: Synthetic peptide
DRPGEKA

SEQ ID NO: 11189 - protein, 7 aa, Artificial Sequence
  Description of Artificial Sequence: Synthetic peptide
EGGSSGS

SEQ ID NO: 11190 - protein, 7 aa, Artificial Sequence
  Description of Artificial Sequence: Synthetic peptide
VQGKHTQ

SEQ ID NO: 11191 - protein, 7 aa, Artificial Sequence
  Description of Artificial Sequence: Synthetic peptide
NPKSTVT

SEQ ID NO: 11192 - protein, 7 aa, Artificial Sequence
  Description of Artificial Sequence: Synthetic peptide
LASSSQT

SEQ ID NO: 11193 - protein, 7 aa, Artificial Sequence
  Description of Artificial Sequence: Synthetic peptide
SPNGASR

SEQ ID NO: 11194 - protein, 7 aa, Artificial Sequence
  Description of Artificial Sequence: Synthetic peptide
AGDKIRL

SEQ ID NO: 11195 - protein, 7 aa, Artificial Sequence
  Description of Artificial Sequence: Synthetic peptide
NGMKTGT

SEQ ID NO: 11196 - protein, 7 aa, Artificial Sequence
  Description of Artificial Sequence: Synthetic peptide
SNGSKVS

SEQ ID NO: 11197 - protein, 7 aa, Artificial Sequence
  Description of Artificial Sequence: Synthetic peptide
KNTSTSQ

SEQ ID NO: 11198 - protein, 7 aa, Artificial Sequence
  Description of Artificial Sequence: Synthetic peptide
KGQPPKE

SEQ ID NO: 11199 - protein, 7 aa, Artificial Sequence
  Description of Artificial Sequence: Synthetic peptide
NVHTATA

SEQ ID NO: 11200 - protein, 7 aa, Artificial Sequence
  Description of Artificial Sequence: Synthetic peptide
SNSKDTL

SEQ ID NO: 11201 - protein, 7 aa, Artificial Sequence
  Description of Artificial Sequence: Synthetic peptide
MPNGSNK

SEQ ID NO: 11202 - protein, 7 aa, Artificial Sequence
  Description of Artificial Sequence: Synthetic peptide
ERGAHSV

SEQ ID NO: 11203 - protein, 7 aa, Artificial Sequence
  Description of Artificial Sequence: Synthetic peptide
EGSPLGH

SEQ ID NO: 11204 - protein, 7 aa, Artificial Sequence
  Description of Artificial Sequence: Synthetic peptide
DNNNARQ

SEQ ID NO: 11205 - protein, 7 aa, Artificial Sequence
  Description of Artificial Sequence: Synthetic peptide
GGKGNNV

SEQ ID NO: 11206 - protein, 7 aa, Artificial Sequence
  Description of Artificial Sequence: Synthetic peptide
SQAQSNN

SEQ ID NO: 11207 - protein, 7 aa, Artificial Sequence
  Description of Artificial Sequence: Synthetic peptide
THTSPSI

SEQ ID NO: 11208 - protein, 7 aa, Artificial Sequence
  Description of Artificial Sequence: Synthetic peptide
ETATSRG

SEQ ID NO: 11209 - protein, 7 aa, Artificial Sequence
  Description of Artificial Sequence: Synthetic peptide
ATEDNRK

SEQ ID NO: 11210 - protein, 7 aa, Artificial Sequence
  Description of Artificial Sequence: Synthetic peptide
NAVGTHS

SEQ ID NO: 11211 - protein, 7 aa, Artificial Sequence
  Description of Artificial Sequence: Synthetic peptide
GNTERKG

SEQ ID NO: 11212 - protein, 7 aa, Artificial Sequence
  Description of Artificial Sequence: Synthetic peptide
GHSQGLA

SEQ ID NO: 11213 - protein, 7 aa, Artificial Sequence
  Description of Artificial Sequence: Synthetic peptide
VKSTSTE

SEQ ID NO: 11214 - protein, 7 aa, Artificial Sequence
  Description of Artificial Sequence: Synthetic peptide
SRSGQGP

SEQ ID NO: 11215 - protein, 7 aa, Artificial Sequence
  Description of Artificial Sequence: Synthetic peptide
SATGSGV

SEQ ID NO: 11216 - protein, 7 aa, Artificial Sequence
  Description of Artificial Sequence: Synthetic peptide
HSSNGTQ

SEQ ID NO: 11217 - protein, 7 aa, Artificial Sequence
  Description of Artificial Sequence: Synthetic peptide
TTVSGST

SEQ ID NO: 11218 - protein, 7 aa, Artificial Sequence
  Description of Artificial Sequence: Synthetic peptide
SKVSSPP

SEQ ID NO: 11219 - protein, 7 aa, Artificial Sequence
  Description of Artificial Sequence: Synthetic peptide
SNGERSN

SEQ ID NO: 11220 - protein, 7 aa, Artificial Sequence
  Description of Artificial Sequence: Synthetic peptide
SNAKGVV

SEQ ID NO: 11221 - protein, 7 aa, Artificial Sequence
  Description of Artificial Sequence: Synthetic peptide
FKNTKDG

SEQ ID NO: 11222 - protein, 7 aa, Artificial Sequence
  Description of Artificial Sequence: Synthetic peptide
TTNTAVA

SEQ ID NO: 11223 - protein, 7 aa, Artificial Sequence
  Description of Artificial Sequence: Synthetic peptide
TNGNGGS

SEQ ID NO: 11224 - protein, 7 aa, Artificial Sequence
  Description of Artificial Sequence: Synthetic peptide
TIGSSST

SEQ ID NO: 11225 - protein, 7 aa, Artificial Sequence
  Description of Artificial Sequence: Synthetic peptide
SMANLKD

SEQ ID NO: 11226 - protein, 7 aa, Artificial Sequence
  Description of Artificial Sequence: Synthetic peptide
DVSKATS

SEQ ID NO: 11227 - protein, 7 aa, Artificial Sequence
  Description of Artificial Sequence: Synthetic peptide
AVSGAKG

SEQ ID NO: 11228 - protein, 7 aa, Artificial Sequence
  Description of Artificial Sequence: Synthetic peptide
GSIPSSS

SEQ ID NO: 11229 - protein, 7 aa, Artificial Sequence
  Description of Artificial Sequence: Synthetic peptide
GSGNTAE

SEQ ID NO: 11230 - protein, 7 aa, Artificial Sequence
  Description of Artificial Sequence: Synthetic peptide
GSGSAKL

SEQ ID NO: 11231 - protein, 7 aa, Artificial Sequence
  Description of Artificial Sequence: Synthetic peptide
TTRSKNE

SEQ ID NO: 11232 - protein, 7 aa, Artificial Sequence
  Description of Artificial Sequence: Synthetic peptide
GLSASIR

SEQ ID NO: 11233 - protein, 7 aa, Artificial Sequence
  Description of Artificial Sequence: Synthetic peptide
TQMKPTR

SEQ ID NO: 11234 - protein, 7 aa, Artificial Sequence
  Description of Artificial Sequence: Synthetic peptide
SQTNGAV

SEQ ID NO: 11235 - protein, 7 aa, Artificial Sequence
  Description of Artificial Sequence: Synthetic peptide
AGDQTRI

SEQ ID NO: 11236 - protein, 7 aa, Artificial Sequence
  Description of Artificial Sequence: Synthetic peptide
ATTSSPK

SEQ ID NO: 11237 - protein, 7 aa, Artificial Sequence
  Description of Artificial Sequence: Synthetic peptide
GTIANAR

SEQ ID NO: 11238 - protein, 7 aa, Artificial Sequence
  Description of Artificial Sequence: Synthetic peptide
GSGSPSA

SEQ ID NO: 11239 - protein, 7 aa, Artificial Sequence
  Description of Artificial Sequence: Synthetic peptide
NSNSREK

SEQ ID NO: 11240 - protein, 7 aa, Artificial Sequence
  Description of Artificial Sequence: Synthetic peptide
NSTGTGS

SEQ ID NO: 11241 - protein, 7 aa, Artificial Sequence
  Description of Artificial Sequence: Synthetic peptide
NQSNVPL

SEQ ID NO: 11242 - protein, 7 aa, Artificial Sequence
  Description of Artificial Sequence: Synthetic peptide
TPANAQA

SEQ ID NO: 11243 - protein, 7 aa, Artificial Sequence
  Description of Artificial Sequence: Synthetic peptide
SIGNKTL

SEQ ID NO: 11244 - protein, 7 aa, Artificial Sequence
  Description of Artificial Sequence: Synthetic peptide
SSYKGEG

SEQ ID NO: 11245 - protein, 7 aa, Artificial Sequence
  Description of Artificial Sequence: Synthetic peptide
LDKVKTT

SEQ ID NO: 11246 - protein, 7 aa, Artificial Sequence
  Description of Artificial Sequence: Synthetic peptide
ESDGGKS

SEQ ID NO: 11247 - protein, 7 aa, Artificial Sequence
  Description of Artificial Sequence: Synthetic peptide
DRTQDAH

SEQ ID NO: 11248 - protein, 7 aa, Artificial Sequence
  Description of Artificial Sequence: Synthetic peptide
ANTDKRV

SEQ ID NO: 11249 - protein, 7 aa, Artificial Sequence
  Description of Artificial Sequence: Synthetic peptide
AGNTLAA

SEQ ID NO: 11250 - protein, 7 aa, Artificial Sequence
  Description of Artificial Sequence: Synthetic peptide
AGTSTMS

SEQ ID NO: 11251 - protein, 7 aa, Artificial Sequence
  Description of Artificial Sequence: Synthetic peptide
AMSKKEA

SEQ ID NO: 11252 - protein, 7 aa, Artificial Sequence
  Description of Artificial Sequence: Synthetic peptide
GRKDAAV

SEQ ID NO: 11253 - protein, 7 aa, Artificial Sequence
  Description of Artificial Sequence: Synthetic peptide
VAGSSTV

SEQ ID NO: 11254 - protein, 7 aa, Artificial Sequence
  Description of Artificial Sequence: Synthetic peptide
YKVGTES

SEQ ID NO: 11255 - protein, 7 aa, Artificial Sequence
  Description of Artificial Sequence: Synthetic peptide
TNANVPR

SEQ ID NO: 11256 - protein, 7 aa, Artificial Sequence
  Description of Artificial Sequence: Synthetic peptide
LGSGRPE

SEQ ID NO: 11257 - protein, 7 aa, Artificial Sequence
  Description of Artificial Sequence: Synthetic peptide
LGNASNN

SEQ ID NO: 11258 - protein, 7 aa, Artificial Sequence
  Description of Artificial Sequence: Synthetic peptide
TPSTPAS

SEQ ID NO: 11259 - protein, 7 aa, Artificial Sequence
  Description of Artificial Sequence: Synthetic peptide
LSGSNSS

SEQ ID NO: 11260 - protein, 7 aa, Artificial Sequence
  Description of Artificial Sequence: Synthetic peptide
DLSVKTQ

SEQ ID NO: 11261 - protein, 7 aa, Artificial Sequence
  Description of Artificial Sequence: Synthetic peptide
GLATSSQ

SEQ ID NO: 11262 - protein, 7 aa, Artificial Sequence
  Description of Artificial Sequence: Synthetic peptide
IGAERSV

SEQ ID NO: 11263 - protein, 7 aa, Artificial Sequence
  Description of Artificial Sequence: Synthetic peptide
GNLTTTK

SEQ ID NO: 11264 - protein, 7 aa, Artificial Sequence
  Description of Artificial Sequence: Synthetic peptide
DGSAKLV

SEQ ID NO: 11265 - protein, 7 aa, Artificial Sequence
  Description of Artificial Sequence: Synthetic peptide
SDSRAGG

SEQ ID NO: 11266 - protein, 7 aa, Artificial Sequence
  Description of Artificial Sequence: Synthetic peptide
LSHSKAT

SEQ ID NO: 11267 - protein, 7 aa, Artificial Sequence
  Description of Artificial Sequence: Synthetic peptide
RSESAST

SEQ ID NO: 11268 - protein, 7 aa, Artificial Sequence
  Description of Artificial Sequence: Synthetic peptide
STNRSSG

SEQ ID NO: 11269 - protein, 7 aa, Artificial Sequence
  Description of Artificial Sequence: Synthetic peptide
ASEKKVL

SEQ ID NO: 11270 - protein, 7 aa, Artificial Sequence
  Description of Artificial Sequence: Synthetic peptide
GNKAVSG

SEQ ID NO: 11271 - protein, 7 aa, Artificial Sequence
  Description of Artificial Sequence: Synthetic peptide
GGSKAVD

SEQ ID NO: 11272 - protein, 7 aa, Artificial Sequence
  Description of Artificial Sequence: Synthetic peptide
GVDKKSP

SEQ ID NO: 11273 - protein, 7 aa, Artificial Sequence
  Description of Artificial Sequence: Synthetic peptide
SAGNSKI

SEQ ID NO: 11274 - protein, 7 aa, Artificial Sequence
  Description of Artificial Sequence: Synthetic peptide
HNGGSNK

SEQ ID NO: 11275 - protein, 7 aa, Artificial Sequence
  Description of Artificial Sequence: Synthetic peptide
TGSGHIS

SEQ ID NO: 11276 - protein, 7 aa, Artificial Sequence
  Description of Artificial Sequence: Synthetic peptide
LQKPSGT

SEQ ID NO: 11277 - protein, 7 aa, Artificial Sequence
  Description of Artificial Sequence: Synthetic peptide
MSTSSSR

SEQ ID NO: 11278 - protein, 7 aa, Artificial Sequence
  Description of Artificial Sequence: Synthetic peptide
ANSTNHT

SEQ ID NO: 11279 - protein, 7 aa, Artificial Sequence
  Description of Artificial Sequence: Synthetic peptide
NSSPVSN

SEQ ID NO: 11280 - protein, 7 aa, Artificial Sequence
  Description of Artificial Sequence: Synthetic peptide
TNNATAT

SEQ ID NO: 11281 - protein, 7 aa, Artificial Sequence
  Description of Artificial Sequence: Synthetic peptide
TGTNPNG

SEQ ID NO: 11282 - protein, 7 aa, Artificial Sequence
  Description of Artificial Sequence: Synthetic peptide
RNGDQAA

SEQ ID NO: 11283 - protein, 7 aa, Artificial Sequence
  Description of Artificial Sequence: Synthetic peptide
SRGESKS

SEQ ID NO: 11284 - protein, 7 aa, Artificial Sequence
  Description of Artificial Sequence: Synthetic peptide
EVGKHSS

SEQ ID NO: 11285 - protein, 7 aa, Artificial Sequence
  Description of Artificial Sequence: Synthetic peptide
ANREKIL

SEQ ID NO: 11286 - protein, 7 aa, Artificial Sequence
  Description of Artificial Sequence: Synthetic peptide
AGTNANK

SEQ ID NO: 11287 - protein, 7 aa, Artificial Sequence
  Description of Artificial Sequence: Synthetic peptide
VPDNKQL

SEQ ID NO: 11288 - protein, 7 aa, Artificial Sequence
  Description of Artificial Sequence: Synthetic peptide
AGPSGKI

SEQ ID NO: 11289 - protein, 7 aa, Artificial Sequence
  Description of Artificial Sequence: Synthetic peptide
DTGRGGN

SEQ ID NO: 11290 - protein, 7 aa, Artificial Sequence
  Description of Artificial Sequence: Synthetic peptide
RDGTSPE

SEQ ID NO: 11291 - protein, 7 aa, Artificial Sequence
  Description of Artificial Sequence: Synthetic peptide
QSAQASK

SEQ ID NO: 11292 - protein, 7 aa, Artificial Sequence
  Description of Artificial Sequence: Synthetic peptide
TTDKGGR

SEQ ID NO: 11293 - protein, 7 aa, Artificial Sequence
  Description of Artificial Sequence: Synthetic peptide
QASTSPL

SEQ ID NO: 11294 - protein, 7 aa, Artificial Sequence
  Description of Artificial Sequence: Synthetic peptide
DRSPSAV

SEQ ID NO: 11295 - protein, 7 aa, Artificial Sequence
  Description of Artificial Sequence: Synthetic peptide
AAPGAGG

SEQ ID NO: 11296 - protein, 7 aa, Artificial Sequence
  Description of Artificial Sequence: Synthetic peptide
LPNQKDT

SEQ ID NO: 11297 - protein, 7 aa, Artificial Sequence
  Description of Artificial Sequence: Synthetic peptide
FPNNKNG

SEQ ID NO: 11298 - protein, 7 aa, Artificial Sequence
  Description of Artificial Sequence: Synthetic peptide
GPLTRDG

SEQ ID NO: 11299 - protein, 7 aa, Artificial Sequence
  Description of Artificial Sequence: Synthetic peptide
TPNSSNG

SEQ ID NO: 11300 - protein, 7 aa, Artificial Sequence
  Description of Artificial Sequence: Synthetic peptide
HKEVATA

SEQ ID NO: 11301 - protein, 7 aa, Artificial Sequence
  Description of Artificial Sequence: Synthetic peptide
KTGSPQD

SEQ ID NO: 11302 - protein, 7 aa, Artificial Sequence
  Description of Artificial Sequence: Synthetic peptide
TDGNSTR

SEQ ID NO: 11303 - protein, 7 aa, Artificial Sequence
  Description of Artificial Sequence: Synthetic peptide
RKDTETH

SEQ ID NO: 11304 - protein, 7 aa, Artificial Sequence
  Description of Artificial Sequence: Synthetic peptide
SSSTTRV

SEQ ID NO: 11305 - protein, 7 aa, Artificial Sequence
  Description of Artificial Sequence: Synthetic peptide
QSGGVSG

SEQ ID NO: 11306 - protein, 7 aa, Artificial Sequence
  Description of Artificial Sequence: Synthetic peptide
VPSGGSN

SEQ ID NO: 11307 - protein, 7 aa, Artificial Sequence
  Description of Artificial Sequence: Synthetic peptide
SNQRGNS

SEQ ID NO: 11308 - protein, 7 aa, Artificial Sequence
  Description of Artificial Sequence: Synthetic peptide
SSGNGLH

SEQ ID NO: 11309 - protein, 7 aa, Artificial Sequence
  Description of Artificial Sequence: Synthetic peptide
RDGSSKD

SEQ ID NO: 11310 - protein, 7 aa, Artificial Sequence
  Description of Artificial Sequence: Synthetic peptide
STSGNHA

SEQ ID NO: 11311 - protein, 7 aa, Artificial Sequence
  Description of Artificial Sequence: Synthetic peptide
LPAKTDS

SEQ ID NO: 11312 - protein, 7 aa, Artificial Sequence
  Description of Artificial Sequence: Synthetic peptide
LAEKTTP

SEQ ID NO: 11313 - protein, 7 aa, Artificial Sequence
  Description of Artificial Sequence: Synthetic peptide
AHNDTKK

SEQ ID NO: 11314 - protein, 7 aa, Artificial Sequence
  Description of Artificial Sequence: Synthetic peptide
GVTGPRS

SEQ ID NO: 11315 - protein, 7 aa, Artificial Sequence
  Description of Artificial Sequence: Synthetic peptide
VTNAHNS

SEQ ID NO: 11316 - protein, 7 aa, Artificial Sequence
  Description of Artificial Sequence: Synthetic peptide
SSTSSGG

SEQ ID NO: 11317 - protein, 7 aa, Artificial Sequence
  Description of Artificial Sequence: Synthetic peptide
SPSDKVS

SEQ ID NO: 11318 - protein, 7 aa, Artificial Sequence
  Description of Artificial Sequence: Synthetic peptide
QNASPGN

SEQ ID NO: 11319 - protein, 7 aa, Artificial Sequence
  Description of Artificial Sequence: Synthetic peptide
SIDQARS

SEQ ID NO: 11320 - protein, 7 aa, Artificial Sequence
  Description of Artificial Sequence: Synthetic peptide
VASPGGN

SEQ ID NO: 11321 - protein, 7 aa, Artificial Sequence
  Description of Artificial Sequence: Synthetic peptide
TGTQGSS

SEQ ID NO: 11322 - protein, 7 aa, Artificial Sequence
  Description of Artificial Sequence: Synthetic peptide
VKLDRSV

SEQ ID NO: 11323 - protein, 7 aa, Artificial Sequence
  Description of Artificial Sequence: Synthetic peptide
VTSTASV

SEQ ID NO: 11324 - protein, 7 aa, Artificial Sequence
  Description of Artificial Sequence: Synthetic peptide
STDTSAS

SEQ ID NO: 11325 - protein, 7 aa, Artificial Sequence
  Description of Artificial Sequence: Synthetic peptide
GDSSRAS

SEQ ID NO: 11326 - protein, 7 aa, Artificial Sequence
  Description of Artificial Sequence: Synthetic peptide
STQSPTR

SEQ ID NO: 11327 - protein, 7 aa, Artificial Sequence
  Description of Artificial Sequence: Synthetic peptide
KVGGTNT

SEQ ID NO: 11328 - protein, 7 aa, Artificial Sequence
  Description of Artificial Sequence: Synthetic peptide
NRTSGEK

SEQ ID NO: 11329 - protein, 7 aa, Artificial Sequence
  Description of Artificial Sequence: Synthetic peptide
TLASPHG

SEQ ID NO: 11330 - protein, 7 aa, Artificial Sequence
  Description of Artificial Sequence: Synthetic peptide
TGLNNPS

SEQ ID NO: 11331 - protein, 7 aa, Artificial Sequence
  Description of Artificial Sequence: Synthetic peptide
TKDNVHK

SEQ ID NO: 11332 - protein, 7 aa, Artificial Sequence
  Description of Artificial Sequence: Synthetic peptide
STSSAPY

SEQ ID NO: 11333 - protein, 7 aa, Artificial Sequence
  Description of Artificial Sequence: Synthetic peptide
RHDATSQ

SEQ ID NO: 11334 - protein, 7 aa, Artificial Sequence
  Description of Artificial Sequence: Synthetic peptide
SPNPTGS

SEQ ID NO: 11335 - protein, 7 aa, Artificial Sequence
  Description of Artificial Sequence: Synthetic peptide
SGSAHGL

SEQ ID NO: 11336 - protein, 7 aa, Artificial Sequence
  Description of Artificial Sequence: Synthetic peptide
SSGSGIG

SEQ ID NO: 11337 - protein, 7 aa, Artificial Sequence
  Description of Artificial Sequence: Synthetic peptide
MNSSGGK

SEQ ID NO: 11338 - protein, 7 aa, Artificial Sequence
  Description of Artificial Sequence: Synthetic peptide
QNDRTST

SEQ ID NO: 11339 - protein, 7 aa, Artificial Sequence
  Description of Artificial Sequence: Synthetic peptide
QGQEPKR

SEQ ID NO: 11340 - protein, 7 aa, Artificial Sequence
  Description of Artificial Sequence: Synthetic peptide
HSSPPNS

SEQ ID NO: 11341 - protein, 7 aa, Artificial Sequence
  Description of Artificial Sequence: Synthetic peptide
EISSSKL

SEQ ID NO: 11342 - protein, 7 aa, Artificial Sequence
  Description of Artificial Sequence: Synthetic peptide
EQRSTSS

SEQ ID NO: 11343 - protein, 7 aa, Artificial Sequence
  Description of Artificial Sequence: Synthetic peptide
DATSPKV

SEQ ID NO: 11344 - protein, 7 aa, Artificial Sequence
  Description of Artificial Sequence: Synthetic peptide
EDGRSSA

SEQ ID NO: 11345 - protein, 7 aa, Artificial Sequence
  Description of Artificial Sequence: Synthetic peptide
AQSQTNT

SEQ ID NO: 11346 - protein, 7 aa, Artificial Sequence
  Description of Artificial Sequence: Synthetic peptide
AGQKQGM

SEQ ID NO: 11347 - protein, 7 aa, Artificial Sequence
  Description of Artificial Sequence: Synthetic peptide
GTAGTNT

SEQ ID NO: 11348 - protein, 7 aa, Artificial Sequence
  Description of Artificial Sequence: Synthetic peptide
GGHSERR

SEQ ID NO: 11349 - protein, 7 aa, Artificial Sequence
  Description of Artificial Sequence: Synthetic peptide
GTIGVHK

SEQ ID NO: 11350 - protein, 7 aa, Artificial Sequence
  Description of Artificial Sequence: Synthetic peptide
GSPSNQG

SEQ ID NO: 11351 - protein, 7 aa, Artificial Sequence
  Description of Artificial Sequence: Synthetic peptide
VNQSHSM

SEQ ID NO: 11352 - protein, 7 aa, Artificial Sequence
  Description of Artificial Sequence: Synthetic peptide
SPQGSLG

SEQ ID NO: 11353 - protein, 7 aa, Artificial Sequence
  Description of Artificial Sequence: Synthetic peptide
STQPRSQ

SEQ ID NO: 11354 - protein, 7 aa, Artificial Sequence
  Description of Artificial Sequence: Synthetic peptide
FKESGGG

SEQ ID NO: 11355 - protein, 7 aa, Artificial Sequence
  Description of Artificial Sequence: Synthetic peptide
DRNRDTT

SEQ ID NO: 11356 - protein, 7 aa, Artificial Sequence
  Description of Artificial Sequence: Synthetic peptide
LNNSQHA

SEQ ID NO: 11357 - protein, 7 aa, Artificial Sequence
  Description of Artificial Sequence: Synthetic peptide
HSGSGLS

SEQ ID NO: 11358 - protein, 7 aa, Artificial Sequence
  Description of Artificial Sequence: Synthetic peptide
TTGGTMQ

SEQ ID NO: 11359 - protein, 7 aa, Artificial Sequence
  Description of Artificial Sequence: Synthetic peptide
TGQRSAS

SEQ ID NO: 11360 - protein, 7 aa, Artificial Sequence
  Description of Artificial Sequence: Synthetic peptide
MDTGPRE

SEQ ID NO: 11361 - protein, 7 aa, Artificial Sequence
  Description of Artificial Sequence: Synthetic peptide
EPLSSPK

SEQ ID NO: 11362 - protein, 7 aa, Artificial Sequence
  Description of Artificial Sequence: Synthetic peptide
SIESKSA

SEQ ID NO: 11363 - protein, 7 aa, Artificial Sequence
  Description of Artificial Sequence: Synthetic peptide
SGSNASS

SEQ ID NO: 11364 - protein, 7 aa, Artificial Sequence
  Description of Artificial Sequence: Synthetic peptide
RVNGGSG

SEQ ID NO: 11365 - protein, 7 aa, Artificial Sequence
  Description of Artificial Sequence: Synthetic peptide
SGMESRV

SEQ ID NO: 11366 - protein, 7 aa, Artificial Sequence
  Description of Artificial Sequence: Synthetic peptide
EGGNGQM

SEQ ID NO: 11367 - protein, 7 aa, Artificial Sequence
  Description of Artificial Sequence: Synthetic peptide
GQTKERP

SEQ ID NO: 11368 - protein, 7 aa, Artificial Sequence
  Description of Artificial Sequence: Synthetic peptide
GDLPSSG

SEQ ID NO: 11369 - protein, 7 aa, Artificial Sequence
  Description of Artificial Sequence: Synthetic peptide
SGKGGTV

SEQ ID NO: 11370 - protein, 7 aa, Artificial Sequence
  Description of Artificial Sequence: Synthetic peptide
MNNSPTK

SEQ ID NO: 11371 - protein, 7 aa, Artificial Sequence
  Description of Artificial Sequence: Synthetic peptide
VSAGAPS

SEQ ID NO: 11372 - protein, 7 aa, Artificial Sequence
  Description of Artificial Sequence: Synthetic peptide
TQGVSRE

SEQ ID NO: 11373 - protein, 7 aa, Artificial Sequence
  Description of Artificial Sequence: Synthetic peptide
SSTSPSR

SEQ ID NO: 11374 - protein, 7 aa, Artificial Sequence
  Description of Artificial Sequence: Synthetic peptide
HNQGKSA

SEQ ID NO: 11375 - protein, 7 aa, Artificial Sequence
  Description of Artificial Sequence: Synthetic peptide
AGIKDVR

SEQ ID NO: 11376 - protein, 7 aa, Artificial Sequence
  Description of Artificial Sequence: Synthetic peptide
TTHKATV

SEQ ID NO: 11377 - protein, 7 aa, Artificial Sequence
  Description of Artificial Sequence: Synthetic peptide
TPEKGTV

SEQ ID NO: 11378 - protein, 7 aa, Artificial Sequence
  Description of Artificial Sequence: Synthetic peptide
STGSTLG

SEQ ID NO: 11379 - protein, 7 aa, Artificial Sequence
  Description of Artificial Sequence: Synthetic peptide
DPVSERK

SEQ ID NO: 11380 - protein, 7 aa, Artificial Sequence
  Description of Artificial Sequence: Synthetic peptide
AGNSGLG

SEQ ID NO: 11381 - protein, 7 aa, Artificial Sequence
  Description of Artificial Sequence: Synthetic peptide
ANGSTRA

SEQ ID NO: 11382 - protein, 7 aa, Artificial Sequence
  Description of Artificial Sequence: Synthetic peptide
DSRKGSN

SEQ ID NO: 11383 - protein, 7 aa, Artificial Sequence
  Description of Artificial Sequence: Synthetic peptide
LPSDKQS

SEQ ID NO: 11384 - protein, 7 aa, Artificial Sequence
  Description of Artificial Sequence: Synthetic peptide
ERDRVTA

SEQ ID NO: 11385 - protein, 7 aa, Artificial Sequence
  Description of Artificial Sequence: Synthetic peptide
AATAPNR

SEQ ID NO: 11386 - protein, 7 aa, Artificial Sequence
  Description of Artificial Sequence: Synthetic peptide
STGNGPS

SEQ ID NO: 11387 - protein, 7 aa, Artificial Sequence
  Description of Artificial Sequence: Synthetic peptide
NGVTGNH

SEQ ID NO: 11388 - protein, 7 aa, Artificial Sequence
  Description of Artificial Sequence: Synthetic peptide
GNPSAAT

SEQ ID NO: 11389 - protein, 7 aa, Artificial Sequence
  Description of Artificial Sequence: Synthetic peptide
SGGDNAR

SEQ ID NO: 11390 - protein, 7 aa, Artificial Sequence
  Description of Artificial Sequence: Synthetic peptide
SSSSKTF

SEQ ID NO: 11391 - protein, 7 aa, Artificial Sequence
  Description of Artificial Sequence: Synthetic peptide
IGTGSPP

SEQ ID NO: 11392 - protein, 7 aa, Artificial Sequence
  Description of Artificial Sequence: Synthetic peptide
VPSGQPV

SEQ ID NO: 11393 - protein, 7 aa, Artificial Sequence
  Description of Artificial Sequence: Synthetic peptide
SDARSST

SEQ ID NO: 11394 - protein, 7 aa, Artificial Sequence
  Description of Artificial Sequence: Synthetic peptide
KQQPSPT

SEQ ID NO: 11395 - protein, 7 aa, Artificial Sequence
  Description of Artificial Sequence: Synthetic peptide
SSVKSNA

SEQ ID NO: 11396 - protein, 7 aa, Artificial Sequence
  Description of Artificial Sequence: Synthetic peptide
TLSRSSS

SEQ ID NO: 11397 - protein, 7 aa, Artificial Sequence
  Description of Artificial Sequence: Synthetic peptide
SRTNTSL

SEQ ID NO: 11398 - protein, 7 aa, Artificial Sequence
  Description of Artificial Sequence: Synthetic peptide
QQGESSH

SEQ ID NO: 11399 - protein, 7 aa, Artificial Sequence
  Description of Artificial Sequence: Synthetic peptide
RQDSSSG

SEQ ID NO: 11400 - protein, 7 aa, Artificial Sequence
  Description of Artificial Sequence: Synthetic peptide
LATSDTK

SEQ ID NO: 11401 - protein, 7 aa, Artificial Sequence
  Description of Artificial Sequence: Synthetic peptide
EVASGGK

SEQ ID NO: 11402 - protein, 7 aa, Artificial Sequence
  Description of Artificial Sequence: Synthetic peptide
GSNDLRT

SEQ ID NO: 11403 - protein, 7 aa, Artificial Sequence
  Description of Artificial Sequence: Synthetic peptide
VTGSTLG

SEQ ID NO: 11404 - protein, 7 aa, Artificial Sequence
  Description of Artificial Sequence: Synthetic peptide
VTGGSGV

SEQ ID NO: 11405 - protein, 7 aa, Artificial Sequence
  Description of Artificial Sequence: Synthetic peptide
TIGSHPT

SEQ ID NO: 11406 - protein, 7 aa, Artificial Sequence
  Description of Artificial Sequence: Synthetic peptide
NNTPQSG

SEQ ID NO: 11407 - protein, 7 aa, Artificial Sequence
  Description of Artificial Sequence: Synthetic peptide
SSSKSDG

SEQ ID NO: 11408 - protein, 7 aa, Artificial Sequence
  Description of Artificial Sequence: Synthetic peptide
MREGQMM

SEQ ID NO: 11409 - protein, 7 aa, Artificial Sequence
  Description of Artificial Sequence: Synthetic peptide
QKGESST

SEQ ID NO: 11410 - protein, 7 aa, Artificial Sequence
  Description of Artificial Sequence: Synthetic peptide
HGGPTSS

SEQ ID NO: 11411 - protein, 7 aa, Artificial Sequence
  Description of Artificial Sequence: Synthetic peptide
DVRTTSS

SEQ ID NO: 11412 - protein, 7 aa, Artificial Sequence
  Description of Artificial Sequence: Synthetic peptide
GIESHKM

SEQ ID NO: 11413 - protein, 7 aa, Artificial Sequence
  Description of Artificial Sequence: Synthetic peptide
YGNPTPG

SEQ ID NO: 11414 - protein, 7 aa, Artificial Sequence
  Description of Artificial Sequence: Synthetic peptide
SPNGHLK

SEQ ID NO: 11415 - protein, 7 aa, Artificial Sequence
  Description of Artificial Sequence: Synthetic peptide
LRSDSQS

SEQ ID NO: 11416 - protein, 7 aa, Artificial Sequence
  Description of Artificial Sequence: Synthetic peptide
QQGNNIT

SEQ ID NO: 11417 - protein, 7 aa, Artificial Sequence
  Description of Artificial Sequence: Synthetic peptide
DRTNAKG

SEQ ID NO: 11418 - protein, 7 aa, Artificial Sequence
  Description of Artificial Sequence: Synthetic peptide
NGSGQNH

SEQ ID NO: 11419 - protein, 7 aa, Artificial Sequence
  Description of Artificial Sequence: Synthetic peptide
MSSHSST

SEQ ID NO: 11420 - protein, 7 aa, Artificial Sequence
  Description of Artificial Sequence: Synthetic peptide
QAVSSNS

SEQ ID NO: 11421 - protein, 7 aa, Artificial Sequence
  Description of Artificial Sequence: Synthetic peptide
GTSGNLN

SEQ ID NO: 11422 - protein, 7 aa, Artificial Sequence
  Description of Artificial Sequence: Synthetic peptide
STKERAD

SEQ ID NO: 11423 - protein, 7 aa, Artificial Sequence
  Description of Artificial Sequence: Synthetic peptide
SPSVNPA

SEQ ID NO: 11424 - protein, 7 aa, Artificial Sequence
  Description of Artificial Sequence: Synthetic peptide
SAGREHA

SEQ ID NO: 11425 - protein, 7 aa, Artificial Sequence
  Description of Artificial Sequence: Synthetic peptide
QSGAASK

SEQ ID NO: 11426 - protein, 7 aa, Artificial Sequence
  Description of Artificial Sequence: Synthetic peptide
TRADSSS

SEQ ID NO: 11427 - protein, 7 aa, Artificial Sequence
  Description of Artificial Sequence: Synthetic peptide
SVSTSSS

SEQ ID NO: 11428 - protein, 7 aa, Artificial Sequence
  Description of Artificial Sequence: Synthetic peptide
EGMDRGS

SEQ ID NO: 11429 - protein, 7 aa, Artificial Sequence
  Description of Artificial Sequence: Synthetic peptide
AAGPSAG

SEQ ID NO: 11430 - protein, 7 aa, Artificial Sequence
  Description of Artificial Sequence: Synthetic peptide
SEKSRPN

SEQ ID NO: 11431 - protein, 7 aa, Artificial Sequence
  Description of Artificial Sequence: Synthetic peptide
GTMDTKV

SEQ ID NO: 11432 - protein, 7 aa, Artificial Sequence
  Description of Artificial Sequence: Synthetic peptide
GTVIGDK

SEQ ID NO: 11433 - protein, 7 aa, Artificial Sequence
  Description of Artificial Sequence: Synthetic peptide
NKVERQE

SEQ ID NO: 11434 - protein, 7 aa, Artificial Sequence
  Description of Artificial Sequence: Synthetic peptide
TPAISGS

SEQ ID NO: 11435 - protein, 7 aa, Artificial Sequence
  Description of Artificial Sequence: Synthetic peptide
MGTQSRE

SEQ ID NO: 11436 - protein, 7 aa, Artificial Sequence
  Description of Artificial Sequence: Synthetic peptide
QNGSGVS

SEQ ID NO: 11437 - protein, 7 aa, Artificial Sequence
  Description of Artificial Sequence: Synthetic peptide
LGDKGAR

SEQ ID NO: 11438 - protein, 7 aa, Artificial Sequence
  Description of Artificial Sequence: Synthetic peptide
EAVQRGT

SEQ ID NO: 11439 - protein, 7 aa, Artificial Sequence
  Description of Artificial Sequence: Synthetic peptide
ANASGSK

SEQ ID NO: 11440 - protein, 7 aa, Artificial Sequence
  Description of Artificial Sequence: Synthetic peptide
GSTVKSG

SEQ ID NO: 11441 - protein, 7 aa, Artificial Sequence
  Description of Artificial Sequence: Synthetic peptide
GVNDVNK

SEQ ID NO: 11442 - protein, 7 aa, Artificial Sequence
  Description of Artificial Sequence: Synthetic peptide
VTNKGTT

SEQ ID NO: 11443 - protein, 7 aa, Artificial Sequence
  Description of Artificial Sequence: Synthetic peptide
NSVNGIT

SEQ ID NO: 11444 - protein, 7 aa, Artificial Sequence
  Description of Artificial Sequence: Synthetic peptide
NHGDVQK

SEQ ID NO: 11445 - protein, 7 aa, Artificial Sequence
  Description of Artificial Sequence: Synthetic peptide
SQSSSVS

SEQ ID NO: 11446 - protein, 7 aa, Artificial Sequence
  Description of Artificial Sequence: Synthetic peptide
AGSGQAR

SEQ ID NO: 11447 - protein, 7 aa, Artificial Sequence
  Description of Artificial Sequence: Synthetic peptide
TQSQSVT

SEQ ID NO: 11448 - protein, 7 aa, Artificial Sequence
  Description of Artificial Sequence: Synthetic peptide
TADAVPK

SEQ ID NO: 11449 - protein, 7 aa, Artificial Sequence
  Description of Artificial Sequence: Synthetic peptide
QATNTPL

SEQ ID NO: 11450 - protein, 7 aa, Artificial Sequence
  Description of Artificial Sequence: Synthetic peptide
GTTSRNV

SEQ ID NO: 11451 - protein, 7 aa, Artificial Sequence
  Description of Artificial Sequence: Synthetic peptide
ENSTRSG

SEQ ID NO: 11452 - protein, 7 aa, Artificial Sequence
  Description of Artificial Sequence: Synthetic peptide
DSGKSRE

SEQ ID NO: 11453 - protein, 7 aa, Artificial Sequence
  Description of Artificial Sequence: Synthetic peptide
GTSGALT

SEQ ID NO: 11454 - protein, 7 aa, Artificial Sequence
  Description of Artificial Sequence: Synthetic peptide
GRTENRT

SEQ ID NO: 11455 - protein, 7 aa, Artificial Sequence
  Description of Artificial Sequence: Synthetic peptide
HPTNNGL

SEQ ID NO: 11456 - protein, 7 aa, Artificial Sequence
  Description of Artificial Sequence: Synthetic peptide
NTSPVGN

SEQ ID NO: 11457 - protein, 7 aa, Artificial Sequence
  Description of Artificial Sequence: Synthetic peptide
NHSKDTS

SEQ ID NO: 11458 - protein, 7 aa, Artificial Sequence
  Description of Artificial Sequence: Synthetic peptide
TGTGGMT

SEQ ID NO: 11459 - protein, 7 aa, Artificial Sequence
  Description of Artificial Sequence: Synthetic peptide
TSNQRNS

SEQ ID NO: 11460 - protein, 7 aa, Artificial Sequence
  Description of Artificial Sequence: Synthetic peptide
TTGNSTG

SEQ ID NO: 11461 - protein, 7 aa, Artificial Sequence
  Description of Artificial Sequence: Synthetic peptide
RVAASGG

SEQ ID NO: 11462 - protein, 7 aa, Artificial Sequence
  Description of Artificial Sequence: Synthetic peptide
ITGDKPI

SEQ ID NO: 11463 - protein, 7 aa, Artificial Sequence
  Description of Artificial Sequence: Synthetic peptide
QKQGPTA

SEQ ID NO: 11464 - protein, 7 aa, Artificial Sequence
  Description of Artificial Sequence: Synthetic peptide
QAKGAQQ

SEQ ID NO: 11465 - protein, 7 aa, Artificial Sequence
  Description of Artificial Sequence: Synthetic peptide
HTQTTSS

SEQ ID NO: 11466 - protein, 7 aa, Artificial Sequence
  Description of Artificial Sequence: Synthetic peptide
HTAAGVT

SEQ ID NO: 11467 - protein, 7 aa, Artificial Sequence
  Description of Artificial Sequence: Synthetic peptide
LKTEHTT

SEQ ID NO: 11468 - protein, 7 aa, Artificial Sequence
  Description of Artificial Sequence: Synthetic peptide
LASSSVQ

SEQ ID NO: 11469 - protein, 7 aa, Artificial Sequence
  Description of Artificial Sequence: Synthetic peptide
LGNKSNS

SEQ ID NO: 11470 - protein, 7 aa, Artificial Sequence
  Description of Artificial Sequence: Synthetic peptide
GSTGSHK

SEQ ID NO: 11471 - protein, 7 aa, Artificial Sequence
  Description of Artificial Sequence: Synthetic peptide
GNTGTTF

SEQ ID NO: 11472 - protein, 7 aa, Artificial Sequence
  Description of Artificial Sequence: Synthetic peptide
VHTSSTT

SEQ ID NO: 11473 - protein, 7 aa, Artificial Sequence
  Description of Artificial Sequence: Synthetic peptide
LNAQQTA

SEQ ID NO: 11474 - protein, 7 aa, Artificial Sequence
  Description of Artificial Sequence: Synthetic peptide
TSGDSRN

SEQ ID NO: 11475 - protein, 7 aa, Artificial Sequence
  Description of Artificial Sequence: Synthetic peptide
VGNSTHQ

SEQ ID NO: 11476 - protein, 7 aa, Artificial Sequence
  Description of Artificial Sequence: Synthetic peptide
QVSTTPA

SEQ ID NO: 11477 - protein, 7 aa, Artificial Sequence
  Description of Artificial Sequence: Synthetic peptide
HTAGTNG

SEQ ID NO: 11478 - protein, 7 aa, Artificial Sequence
  Description of Artificial Sequence: Synthetic peptide
LGNSSSR

SEQ ID NO: 11479 - protein, 7 aa, Artificial Sequence
  Description of Artificial Sequence: Synthetic peptide
GDRSSQH

SEQ ID NO: 11480 - protein, 7 aa, Artificial Sequence
  Description of Artificial Sequence: Synthetic peptide
GLASARE

SEQ ID NO: 11481 - protein, 7 aa, Artificial Sequence
  Description of Artificial Sequence: Synthetic peptide
SGNAPRT

SEQ ID NO: 11482 - protein, 7 aa, Artificial Sequence
  Description of Artificial Sequence: Synthetic peptide
NGIKSSM

SEQ ID NO: 11483 - protein, 7 aa, Artificial Sequence
  Description of Artificial Sequence: Synthetic peptide
TIKPNSG

SEQ ID NO: 11484 - protein, 7 aa, Artificial Sequence
  Description of Artificial Sequence: Synthetic peptide
SAERATT

SEQ ID NO: 11485 - protein, 7 aa, Artificial Sequence
  Description of Artificial Sequence: Synthetic peptide
NGTGSGR

SEQ ID NO: 11486 - protein, 7 aa, Artificial Sequence
  Description of Artificial Sequence: Synthetic peptide
NGTNTGG

SEQ ID NO: 11487 - protein, 7 aa, Artificial Sequence
  Description of Artificial Sequence: Synthetic peptide
MNTKGPI

SEQ ID NO: 11488 - protein, 7 aa, Artificial Sequence
  Description of Artificial Sequence: Synthetic peptide
EHTGSKL

SEQ ID NO: 11489 - protein, 7 aa, Artificial Sequence
  Description of Artificial Sequence: Synthetic peptide
GQNRETV

SEQ ID NO: 11490 - protein, 7 aa, Artificial Sequence
  Description of Artificial Sequence: Synthetic peptide
NSNRSPA

SEQ ID NO: 11491 - protein, 7 aa, Artificial Sequence
  Description of Artificial Sequence: Synthetic peptide
TKAAATI

SEQ ID NO: 11492 - protein, 7 aa, Artificial Sequence
  Description of Artificial Sequence: Synthetic peptide
GVSNGAQ

SEQ ID NO: 11493 - protein, 7 aa, Artificial Sequence
  Description of Artificial Sequence: Synthetic peptide
NPAATPA

SEQ ID NO: 11494 - protein, 7 aa, Artificial Sequence
  Description of Artificial Sequence: Synthetic peptide
NPGDNRL

SEQ ID NO: 11495 - protein, 7 aa, Artificial Sequence
  Description of Artificial Sequence: Synthetic peptide
TGSHNPS

SEQ ID NO: 11496 - protein, 7 aa, Artificial Sequence
  Description of Artificial Sequence: Synthetic peptide
SSLNTTS

SEQ ID NO: 11497 - protein, 7 aa, Artificial Sequence
  Description of Artificial Sequence: Synthetic peptide
QPGNTRL

SEQ ID NO: 11498 - protein, 7 aa, Artificial Sequence
  Description of Artificial Sequence: Synthetic peptide
QTSRESG

SEQ ID NO: 11499 - protein, 7 aa, Artificial Sequence
  Description of Artificial Sequence: Synthetic peptide
LPREHSV

SEQ ID NO: 11500 - protein, 7 aa, Artificial Sequence
  Description of Artificial Sequence: Synthetic peptide
DRLSQTN

SEQ ID NO: 11501 - protein, 7 aa, Artificial Sequence
  Description of Artificial Sequence: Synthetic peptide
DTGTKNS

SEQ ID NO: 11502 - protein, 7 aa, Artificial Sequence
  Description of Artificial Sequence: Synthetic peptide
AHEQRNA

SEQ ID NO: 11503 - protein, 7 aa, Artificial Sequence
  Description of Artificial Sequence: Synthetic peptide
GSSPGPN

SEQ ID NO: 11504 - protein, 7 aa, Artificial Sequence
  Description of Artificial Sequence: Synthetic peptide
GPSSGTP

SEQ ID NO: 11505 - protein, 7 aa, Artificial Sequence
  Description of Artificial Sequence: Synthetic peptide
TSGNANN

SEQ ID NO: 11506 - protein, 7 aa, Artificial Sequence
  Description of Artificial Sequence: Synthetic peptide
AGISSTS

SEQ ID NO: 11507 - protein, 7 aa, Artificial Sequence
  Description of Artificial Sequence: Synthetic peptide
SGGNLNA

SEQ ID NO: 11508 - protein, 7 aa, Artificial Sequence
  Description of Artificial Sequence: Synthetic peptide
TSASKGT

SEQ ID NO: 11509 - protein, 7 aa, Artificial Sequence
  Description of Artificial Sequence: Synthetic peptide
SVTGNSK

SEQ ID NO: 11510 - protein, 7 aa, Artificial Sequence
  Description of Artificial Sequence: Synthetic peptide
EGKSQGR

SEQ ID NO: 11511 - protein, 7 aa, Artificial Sequence
  Description of Artificial Sequence: Synthetic peptide
AANKSKE

SEQ ID NO: 11512 - protein, 7 aa, Artificial Sequence
  Description of Artificial Sequence: Synthetic peptide
VSTGPTT

SEQ ID NO: 11513 - protein, 7 aa, Artificial Sequence
  Description of Artificial Sequence: Synthetic peptide
LLQGSGA

SEQ ID NO: 11514 - protein, 7 aa, Artificial Sequence
  Description of Artificial Sequence: Synthetic peptide
NAHSAGG

SEQ ID NO: 11515 - protein, 7 aa, Artificial Sequence
  Description of Artificial Sequence: Synthetic peptide
TRASPAS

SEQ ID NO: 11516 - protein, 7 aa, Artificial Sequence
  Description of Artificial Sequence: Synthetic peptide
TLDVGGK

SEQ ID NO: 11517 - protein, 7 aa, Artificial Sequence
  Description of Artificial Sequence: Synthetic peptide
TVGSAQG

SEQ ID NO: 11518 - protein, 7 aa, Artificial Sequence
  Description of Artificial Sequence: Synthetic peptide
TPIPSKG

SEQ ID NO: 11519 - protein, 7 aa, Artificial Sequence
  Description of Artificial Sequence: Synthetic peptide
DRVSASS

SEQ ID NO: 11520 - protein, 7 aa, Artificial Sequence
  Description of Artificial Sequence: Synthetic peptide
GAQSNRA

SEQ ID NO: 11521 - protein, 7 aa, Artificial Sequence
  Description of Artificial Sequence: Synthetic peptide
RSAGTSA

SEQ ID NO: 11522 - protein, 7 aa, Artificial Sequence
  Description of Artificial Sequence: Synthetic peptide
RNGVSPA

SEQ ID NO: 11523 - protein, 7 aa, Artificial Sequence
  Description of Artificial Sequence: Synthetic peptide
DQSSSHV

SEQ ID NO: 11524 - protein, 7 aa, Artificial Sequence
  Description of Artificial Sequence: Synthetic peptide
GSGNQRT

SEQ ID NO: 11525 - protein, 7 aa, Artificial Sequence
  Description of Artificial Sequence: Synthetic peptide
MRDAKTQ

SEQ ID NO: 11526 - protein, 7 aa, Artificial Sequence
  Description of Artificial Sequence: Synthetic peptide
TTHTPNQ

SEQ ID NO: 11527 - protein, 7 aa, Artificial Sequence
  Description of Artificial Sequence: Synthetic peptide
KVDSRGE

SEQ ID NO: 11528 - protein, 7 aa, Artificial Sequence
  Description of Artificial Sequence: Synthetic peptide
NGDQKLV

SEQ ID NO: 11529 - protein, 7 aa, Artificial Sequence
  Description of Artificial Sequence: Synthetic peptide
NGSNHGT

SEQ ID NO: 11530 - protein, 7 aa, Artificial Sequence
  Description of Artificial Sequence: Synthetic peptide
TPSKTNT

SEQ ID NO: 11531 - protein, 7 aa, Artificial Sequence
  Description of Artificial Sequence: Synthetic peptide
TDAGTQS

SEQ ID NO: 11532 - protein, 7 aa, Artificial Sequence
  Description of Artificial Sequence: Synthetic peptide
SVVTSQG

SEQ ID NO: 11533 - protein, 7 aa, Artificial Sequence
  Description of Artificial Sequence: Synthetic peptide
MNQKSTY

SEQ ID NO: 11534 - protein, 7 aa, Artificial Sequence
  Description of Artificial Sequence: Synthetic peptide
HPSQGGS

SEQ ID NO: 11535 - protein, 7 aa, Artificial Sequence
  Description of Artificial Sequence: Synthetic peptide
HPSASVG

SEQ ID NO: 11536 - protein, 7 aa, Artificial Sequence
  Description of Artificial Sequence: Synthetic peptide
EAGSKSV

SEQ ID NO: 11537 - protein, 7 aa, Artificial Sequence
  Description of Artificial Sequence: Synthetic peptide
ARDRNNT

SEQ ID NO: 11538 - protein, 7 aa, Artificial Sequence
  Description of Artificial Sequence: Synthetic peptide
ASKDSTA

SEQ ID NO: 11539 - protein, 7 aa, Artificial Sequence
  Description of Artificial Sequence: Synthetic peptide
ASNSPIG

SEQ ID NO: 11540 - protein, 7 aa, Artificial Sequence
  Description of Artificial Sequence: Synthetic peptide
AMSETSR

SEQ ID NO: 11541 - protein, 7 aa, Artificial Sequence
  Description of Artificial Sequence: Synthetic peptide
GASNSKL

SEQ ID NO: 11542 - protein, 7 aa, Artificial Sequence
  Description of Artificial Sequence: Synthetic peptide
GANKTAP

SEQ ID NO: 11543 - protein, 7 aa, Artificial Sequence
  Description of Artificial Sequence: Synthetic peptide
SNSERSN

SEQ ID NO: 11544 - protein, 7 aa, Artificial Sequence
  Description of Artificial Sequence: Synthetic peptide
SSNQSSA

SEQ ID NO: 11545 - protein, 7 aa, Artificial Sequence
  Description of Artificial Sequence: Synthetic peptide
LPATSAR

SEQ ID NO: 11546 - protein, 7 aa, Artificial Sequence
  Description of Artificial Sequence: Synthetic peptide
TPDRTSI

SEQ ID NO: 11547 - protein, 7 aa, Artificial Sequence
  Description of Artificial Sequence: Synthetic peptide
DTLQATK

SEQ ID NO: 11548 - protein, 7 aa, Artificial Sequence
  Description of Artificial Sequence: Synthetic peptide
DSNSVSK

SEQ ID NO: 11549 - protein, 7 aa, Artificial Sequence
  Description of Artificial Sequence: Synthetic peptide
TPTSHAQ

SEQ ID NO: 11550 - protein, 7 aa, Artificial Sequence
  Description of Artificial Sequence: Synthetic peptide
TSDVTAT

SEQ ID NO: 11551 - protein, 7 aa, Artificial Sequence
  Description of Artificial Sequence: Synthetic peptide
ASNSHAG

SEQ ID NO: 11552 - protein, 7 aa, Artificial Sequence
  Description of Artificial Sequence: Synthetic peptide
VTEQKVG

SEQ ID NO: 11553 - protein, 7 aa, Artificial Sequence
  Description of Artificial Sequence: Synthetic peptide
VGSTGNH

SEQ ID NO: 11554 - protein, 7 aa, Artificial Sequence
  Description of Artificial Sequence: Synthetic peptide
VSQSGPT

SEQ ID NO: 11555 - protein, 7 aa, Artificial Sequence
  Description of Artificial Sequence: Synthetic peptide
SPHGGSN

SEQ ID NO: 11556 - protein, 7 aa, Artificial Sequence
  Description of Artificial Sequence: Synthetic peptide
KPMAQAE

SEQ ID NO: 11557 - protein, 7 aa, Artificial Sequence
  Description of Artificial Sequence: Synthetic peptide
TQSGHPT

SEQ ID NO: 11558 - protein, 7 aa, Artificial Sequence
  Description of Artificial Sequence: Synthetic peptide
ISGQVNS

SEQ ID NO: 11559 - protein, 7 aa, Artificial Sequence
  Description of Artificial Sequence: Synthetic peptide
ETVSKQS

SEQ ID NO: 11560 - protein, 7 aa, Artificial Sequence
  Description of Artificial Sequence: Synthetic peptide
DPTGGSG

SEQ ID NO: 11561 - protein, 7 aa, Artificial Sequence
  Description of Artificial Sequence: Synthetic peptide
GSSNGSH

SEQ ID NO: 11562 - protein, 7 aa, Artificial Sequence
  Description of Artificial Sequence: Synthetic peptide
YKNAATS

SEQ ID NO: 11563 - protein, 7 aa, Artificial Sequence
  Description of Artificial Sequence: Synthetic peptide
ANATPLK

SEQ ID NO: 11564 - protein, 7 aa, Artificial Sequence
  Description of Artificial Sequence: Synthetic peptide
NTSEVAR

SEQ ID NO: 11565 - protein, 7 aa, Artificial Sequence
  Description of Artificial Sequence: Synthetic peptide
NGTGNGI

SEQ ID NO: 11566 - protein, 7 aa, Artificial Sequence
  Description of Artificial Sequence: Synthetic peptide
RTGTETR

SEQ ID NO: 11567 - protein, 7 aa, Artificial Sequence
  Description of Artificial Sequence: Synthetic peptide
SETNKSS

SEQ ID NO: 11568 - protein, 7 aa, Artificial Sequence
  Description of Artificial Sequence: Synthetic peptide
MKDTGPV

SEQ ID NO: 11569 - protein, 7 aa, Artificial Sequence
  Description of Artificial Sequence: Synthetic peptide
DPSSGNV

SEQ ID NO: 11570 - protein, 7 aa, Artificial Sequence
  Description of Artificial Sequence: Synthetic peptide
AVTGSTN

SEQ ID NO: 11571 - protein, 7 aa, Artificial Sequence
  Description of Artificial Sequence: Synthetic peptide
ESGTQGK

SEQ ID NO: 11572 - protein, 7 aa, Artificial Sequence
  Description of Artificial Sequence: Synthetic peptide
SGGANHL

SEQ ID NO: 11573 - protein, 7 aa, Artificial Sequence
  Description of Artificial Sequence: Synthetic peptide
DRQGSAR

SEQ ID NO: 11574 - protein, 7 aa, Artificial Sequence
  Description of Artificial Sequence: Synthetic peptide
GSKGNGS

SEQ ID NO: 11575 - protein, 7 aa, Artificial Sequence
  Description of Artificial Sequence: Synthetic peptide
QVSGHNE

SEQ ID NO: 11576 - protein, 7 aa, Artificial Sequence
  Description of Artificial Sequence: Synthetic peptide
GTSKSIG

SEQ ID NO: 11577 - protein, 7 aa, Artificial Sequence
  Description of Artificial Sequence: Synthetic peptide
YATERTQ

SEQ ID NO: 11578 - protein, 7 aa, Artificial Sequence
  Description of Artificial Sequence: Synthetic peptide
ASTTRTG

SEQ ID NO: 11579 - protein, 7 aa, Artificial Sequence
  Description of Artificial Sequence: Synthetic peptide
GSQGSHA

SEQ ID NO: 11580 - protein, 7 aa, Artificial Sequence
  Description of Artificial Sequence: Synthetic peptide
SQSTSHL

SEQ ID NO: 11581 - protein, 7 aa, Artificial Sequence
  Description of Artificial Sequence: Synthetic peptide
DGARSSA

SEQ ID NO: 11582 - protein, 7 aa, Artificial Sequence
  Description of Artificial Sequence: Synthetic peptide
IRESPAK

SEQ ID NO: 11583 - protein, 7 aa, Artificial Sequence
  Description of Artificial Sequence: Synthetic peptide
SSQPALV

SEQ ID NO: 11584 - protein, 7 aa, Artificial Sequence
  Description of Artificial Sequence: Synthetic peptide
NISKATI

SEQ ID NO: 11585 - protein, 7 aa, Artificial Sequence
  Description of Artificial Sequence: Synthetic peptide
NGSGQNL

SEQ ID NO: 11586 - protein, 7 aa, Artificial Sequence
  Description of Artificial Sequence: Synthetic peptide
TRNDTSN

SEQ ID NO: 11587 - protein, 7 aa, Artificial Sequence
  Description of Artificial Sequence: Synthetic peptide
TPSDNTR

SEQ ID NO: 11588 - protein, 7 aa, Artificial Sequence
  Description of Artificial Sequence: Synthetic peptide
SDTARTA

SEQ ID NO: 11589 - protein, 7 aa, Artificial Sequence
  Description of Artificial Sequence: Synthetic peptide
SGTSATV

SEQ ID NO: 11590 - protein, 7 aa, Artificial Sequence
  Description of Artificial Sequence: Synthetic peptide
HSGGSTS

SEQ ID NO: 11591 - protein, 7 aa, Artificial Sequence
  Description of Artificial Sequence: Synthetic peptide
DRASSST

SEQ ID NO: 11592 - protein, 7 aa, Artificial Sequence
  Description of Artificial Sequence: Synthetic peptide
DTSLSPH

SEQ ID NO: 11593 - protein, 7 aa, Artificial Sequence
  Description of Artificial Sequence: Synthetic peptide
VDSDRAK

SEQ ID NO: 11594 - protein, 7 aa, Artificial Sequence
  Description of Artificial Sequence: Synthetic peptide
GPTRDTT

SEQ ID NO: 11595 - protein, 7 aa, Artificial Sequence
  Description of Artificial Sequence: Synthetic peptide
TNDAPGR

SEQ ID NO: 11596 - protein, 7 aa, Artificial Sequence
  Description of Artificial Sequence: Synthetic peptide
IRDKSSV

SEQ ID NO: 11597 - protein, 7 aa, Artificial Sequence
  Description of Artificial Sequence: Synthetic peptide
AQNGAGT

SEQ ID NO: 11598 - protein, 7 aa, Artificial Sequence
  Description of Artificial Sequence: Synthetic peptide
AGQSTHA

SEQ ID NO: 11599 - protein, 7 aa, Artificial Sequence
  Description of Artificial Sequence: Synthetic peptide
AQVKTPI

SEQ ID NO: 11600 - protein, 7 aa, Artificial Sequence
  Description of Artificial Sequence: Synthetic peptide
TQASNPH

SEQ ID NO: 11601 - protein, 7 aa, Artificial Sequence
  Description of Artificial Sequence: Synthetic peptide
NPKNGSS

SEQ ID NO: 11602 - protein, 7 aa, Artificial Sequence
  Description of Artificial Sequence: Synthetic peptide
TSTSGNA

SEQ ID NO: 11603 - protein, 7 aa, Artificial Sequence
  Description of Artificial Sequence: Synthetic peptide
SSSSPKM

SEQ ID NO: 11604 - protein, 7 aa, Artificial Sequence
  Description of Artificial Sequence: Synthetic peptide
SSANRSE

SEQ ID NO: 11605 - protein, 7 aa, Artificial Sequence
  Description of Artificial Sequence: Synthetic peptide
SVSKDKY

SEQ ID NO: 11606 - protein, 7 aa, Artificial Sequence
  Description of Artificial Sequence: Synthetic peptide
HLGKNGE

SEQ ID NO: 11607 - protein, 7 aa, Artificial Sequence
  Description of Artificial Sequence: Synthetic peptide
EAGRGPS

SEQ ID NO: 11608 - protein, 7 aa, Artificial Sequence
  Description of Artificial Sequence: Synthetic peptide
EQHNNSG

SEQ ID NO: 11609 - protein, 7 aa, Artificial Sequence
  Description of Artificial Sequence: Synthetic peptide
ASSGEQR

SEQ ID NO: 11610 - protein, 7 aa, Artificial Sequence
  Description of Artificial Sequence: Synthetic peptide
SESPKLA

SEQ ID NO: 11611 - protein, 7 aa, Artificial Sequence
  Description of Artificial Sequence: Synthetic peptide
SGSPSIV

SEQ ID NO: 11612 - protein, 7 aa, Artificial Sequence
  Description of Artificial Sequence: Synthetic peptide
TSTKPYD

SEQ ID NO: 11613 - protein, 7 aa, Artificial Sequence
  Description of Artificial Sequence: Synthetic peptide
SNDGPLK

SEQ ID NO: 11614 - protein, 7 aa, Artificial Sequence
  Description of Artificial Sequence: Synthetic peptide
STLKTGS

SEQ ID NO: 11615 - protein, 7 aa, Artificial Sequence
  Description of Artificial Sequence: Synthetic peptide
LPHDKPR

SEQ ID NO: 11616 - protein, 7 aa, Artificial Sequence
  Description of Artificial Sequence: Synthetic peptide
MSSTSST

SEQ ID NO: 11617 - protein, 7 aa, Artificial Sequence
  Description of Artificial Sequence: Synthetic peptide
KHSSPVE

SEQ ID NO: 11618 - protein, 7 aa, Artificial Sequence
  Description of Artificial Sequence: Synthetic peptide
RSDGDKQ

SEQ ID NO: 11619 - protein, 7 aa, Artificial Sequence
  Description of Artificial Sequence: Synthetic peptide
SKEGKYE

SEQ ID NO: 11620 - protein, 7 aa, Artificial Sequence
  Description of Artificial Sequence: Synthetic peptide
DRTGQRG

SEQ ID NO: 11621 - protein, 7 aa, Artificial Sequence
  Description of Artificial Sequence: Synthetic peptide
DSVPTSA

SEQ ID NO: 11622 - protein, 7 aa, Artificial Sequence
  Description of Artificial Sequence: Synthetic peptide
DLSTPTK

SEQ ID NO: 11623 - protein, 7 aa, Artificial Sequence
  Description of Artificial Sequence: Synthetic peptide
ARGANSM

SEQ ID NO: 11624 - protein, 7 aa, Artificial Sequence
  Description of Artificial Sequence: Synthetic peptide
AVDNQRI

SEQ ID NO: 11625 - protein, 7 aa, Artificial Sequence
  Description of Artificial Sequence: Synthetic peptide
VQASSNA

SEQ ID NO: 11626 - protein, 7 aa, Artificial Sequence
  Description of Artificial Sequence: Synthetic peptide
SASSERN

SEQ ID NO: 11627 - protein, 7 aa, Artificial Sequence
  Description of Artificial Sequence: Synthetic peptide
GNGSPVV

SEQ ID NO: 11628 - protein, 7 aa, Artificial Sequence
  Description of Artificial Sequence: Synthetic peptide
GATGKQA

SEQ ID NO: 11629 - protein, 7 aa, Artificial Sequence
  Description of Artificial Sequence: Synthetic peptide
TTSKGNS

SEQ ID NO: 11630 - protein, 7 aa, Artificial Sequence
  Description of Artificial Sequence: Synthetic peptide
TRDTGHS

SEQ ID NO: 11631 - protein, 7 aa, Artificial Sequence
  Description of Artificial Sequence: Synthetic peptide
GRTPPSA

SEQ ID NO: 11632 - protein, 7 aa, Artificial Sequence
  Description of Artificial Sequence: Synthetic peptide
SDDKSLK

SEQ ID NO: 11633 - protein, 7 aa, Artificial Sequence
  Description of Artificial Sequence: Synthetic peptide
RQNDKSV

SEQ ID NO: 11634 - protein, 7 aa, Artificial Sequence
  Description of Artificial Sequence: Synthetic peptide
LNNSSSG

SEQ ID NO: 11635 - protein, 7 aa, Artificial Sequence
  Description of Artificial Sequence: Synthetic peptide
ASSVPTK

SEQ ID NO: 11636 - protein, 7 aa, Artificial Sequence
  Description of Artificial Sequence: Synthetic peptide
GSSTTMK

SEQ ID NO: 11637 - protein, 7 aa, Artificial Sequence
  Description of Artificial Sequence: Synthetic peptide
QSGSGQG

SEQ ID NO: 11638 - protein, 7 aa, Artificial Sequence
  Description of Artificial Sequence: Synthetic peptide
NSSDRAT

SEQ ID NO: 11639 - protein, 7 aa, Artificial Sequence
  Description of Artificial Sequence: Synthetic peptide
DSVNART

SEQ ID NO: 11640 - protein, 7 aa, Artificial Sequence
  Description of Artificial Sequence: Synthetic peptide
TSSGSNL

SEQ ID NO: 11641 - protein, 7 aa, Artificial Sequence
  Description of Artificial Sequence: Synthetic peptide
QMTTKAN

SEQ ID NO: 11642 - protein, 7 aa, Artificial Sequence
  Description of Artificial Sequence: Synthetic peptide
GYDSERR

SEQ ID NO: 11643 - protein, 7 aa, Artificial Sequence
  Description of Artificial Sequence: Synthetic peptide
GSAQKAF

SEQ ID NO: 11644 - protein, 7 aa, Artificial Sequence
  Description of Artificial Sequence: Synthetic peptide
VGVQSVS

SEQ ID NO: 11645 - protein, 7 aa, Artificial Sequence
  Description of Artificial Sequence: Synthetic peptide
RSGTPDR

SEQ ID NO: 11646 - protein, 7 aa, Artificial Sequence
  Description of Artificial Sequence: Synthetic peptide
GQPNLNK

SEQ ID NO: 11647 - protein, 7 aa, Artificial Sequence
  Description of Artificial Sequence: Synthetic peptide
EPVSKNM

SEQ ID NO: 11648 - protein, 7 aa, Artificial Sequence
  Description of Artificial Sequence: Synthetic peptide
DTRSPST

SEQ ID NO: 11649 - protein, 7 aa, Artificial Sequence
  Description of Artificial Sequence: Synthetic peptide
AAGTGTT

SEQ ID NO: 11650 - protein, 7 aa, Artificial Sequence
  Description of Artificial Sequence: Synthetic peptide
GESKSGK

SEQ ID NO: 11651 - protein, 7 aa, Artificial Sequence
  Description of Artificial Sequence: Synthetic peptide
TGNSALT

SEQ ID NO: 11652 - protein, 7 aa, Artificial Sequence
  Description of Artificial Sequence: Synthetic peptide
ARTEASR

SEQ ID NO: 11653 - protein, 7 aa, Artificial Sequence
  Description of Artificial Sequence: Synthetic peptide
SPSKPGS

SEQ ID NO: 11654 - protein, 7 aa, Artificial Sequence
  Description of Artificial Sequence: Synthetic peptide
SVGGKGA

SEQ ID NO: 11655 - protein, 7 aa, Artificial Sequence
  Description of Artificial Sequence: Synthetic peptide
TQASTAQ

SEQ ID NO: 11656 - protein, 7 aa, Artificial Sequence
  Description of Artificial Sequence: Synthetic peptide
QGGHGSA

SEQ ID NO: 11657 - protein, 7 aa, Artificial Sequence
  Description of Artificial Sequence: Synthetic peptide
LPNPTSG

SEQ ID NO: 11658 - protein, 7 aa, Artificial Sequence
  Description of Artificial Sequence: Synthetic peptide
DSIGGKN

SEQ ID NO: 11659 - protein, 7 aa, Artificial Sequence
  Description of Artificial Sequence: Synthetic peptide
AKSSETS

SEQ ID NO: 11660 - protein, 7 aa, Artificial Sequence
  Description of Artificial Sequence: Synthetic peptide
SASGSMK

SEQ ID NO: 11661 - protein, 7 aa, Artificial Sequence
  Description of Artificial Sequence: Synthetic peptide
SGSQTMK

SEQ ID NO: 11662 - protein, 7 aa, Artificial Sequence
  Description of Artificial Sequence: Synthetic peptide
LLKSPPT

SEQ ID NO: 11663 - protein, 7 aa, Artificial Sequence
  Description of Artificial Sequence: Synthetic peptide
NSISNVK

SEQ ID NO: 11664 - protein, 7 aa, Artificial Sequence
  Description of Artificial Sequence: Synthetic peptide
AMGGSKQ

SEQ ID NO: 11665 - protein, 7 aa, Artificial Sequence
  Description of Artificial Sequence: Synthetic peptide
NSADRGA

SEQ ID NO: 11666 - protein, 7 aa, Artificial Sequence
  Description of Artificial Sequence: Synthetic peptide
SAGSAAQ

SEQ ID NO: 11667 - protein, 7 aa, Artificial Sequence
  Description of Artificial Sequence: Synthetic peptide
LVNSTGG

SEQ ID NO: 11668 - protein, 7 aa, Artificial Sequence
  Description of Artificial Sequence: Synthetic peptide
DSGKGHE

SEQ ID NO: 11669 - protein, 7 aa, Artificial Sequence
  Description of Artificial Sequence: Synthetic peptide
DPLQNRN

SEQ ID NO: 11670 - protein, 7 aa, Artificial Sequence
  Description of Artificial Sequence: Synthetic peptide
GKEALPQ

SEQ ID NO: 11671 - protein, 7 aa, Artificial Sequence
  Description of Artificial Sequence: Synthetic peptide
GNGKTKD

SEQ ID NO: 11672 - protein, 7 aa, Artificial Sequence
  Description of Artificial Sequence: Synthetic peptide
GTAASQL

SEQ ID NO: 11673 - protein, 7 aa, Artificial Sequence
  Description of Artificial Sequence: Synthetic peptide
QMDTPTK

SEQ ID NO: 11674 - protein, 7 aa, Artificial Sequence
  Description of Artificial Sequence: Synthetic peptide
DSVPTAA

SEQ ID NO: 11675 - protein, 7 aa, Artificial Sequence
  Description of Artificial Sequence: Synthetic peptide
DRVSSPM

SEQ ID NO: 11676 - protein, 7 aa, Artificial Sequence
  Description of Artificial Sequence: Synthetic peptide
ANGAPQK

SEQ ID NO: 11677 - protein, 7 aa, Artificial Sequence
  Description of Artificial Sequence: Synthetic peptide
STSDGNR

SEQ ID NO: 11678 - protein, 7 aa, Artificial Sequence
  Description of Artificial Sequence: Synthetic peptide
TTGSNTH

SEQ ID NO: 11679 - protein, 7 aa, Artificial Sequence
  Description of Artificial Sequence: Synthetic peptide
RSSKELD

SEQ ID NO: 11680 - protein, 7 aa, Artificial Sequence
  Description of Artificial Sequence: Synthetic peptide
QKTDSLK

SEQ ID NO: 11681 - protein, 7 aa, Artificial Sequence
  Description of Artificial Sequence: Synthetic peptide
DAATKPN

SEQ ID NO: 11682 - protein, 7 aa, Artificial Sequence
  Description of Artificial Sequence: Synthetic peptide
NANPERG

SEQ ID NO: 11683 - protein, 7 aa, Artificial Sequence
  Description of Artificial Sequence: Synthetic peptide
TSNNGPR

SEQ ID NO: 11684 - protein, 7 aa, Artificial Sequence
  Description of Artificial Sequence: Synthetic peptide
HRDVKPD

SEQ ID NO: 11685 - protein, 7 aa, Artificial Sequence
  Description of Artificial Sequence: Synthetic peptide
LTGSGIS

SEQ ID NO: 11686 - protein, 7 aa, Artificial Sequence
  Description of Artificial Sequence: Synthetic peptide
SHNATNT

SEQ ID NO: 11687 - protein, 7 aa, Artificial Sequence
  Description of Artificial Sequence: Synthetic peptide
QSDARAK

SEQ ID NO: 11688 - protein, 7 aa, Artificial Sequence
  Description of Artificial Sequence: Synthetic peptide
YRESEAR

SEQ ID NO: 11689 - protein, 7 aa, Artificial Sequence
  Description of Artificial Sequence: Synthetic peptide
HTTKESY

SEQ ID NO: 11690 - protein, 7 aa, Artificial Sequence
  Description of Artificial Sequence: Synthetic peptide
SATGNHS

SEQ ID NO: 11691 - protein, 7 aa, Artificial Sequence
  Description of Artificial Sequence: Synthetic peptide
DLPTKHT

SEQ ID NO: 11692 - protein, 7 aa, Artificial Sequence
  Description of Artificial Sequence: Synthetic peptide
GLGTNKL

SEQ ID NO: 11693 - protein, 7 aa, Artificial Sequence
  Description of Artificial Sequence: Synthetic peptide
TSDSKVG

SEQ ID NO: 11694 - protein, 7 aa, Artificial Sequence
  Description of Artificial Sequence: Synthetic peptide
MGQNAPQ

SEQ ID NO: 11695 - protein, 7 aa, Artificial Sequence
  Description of Artificial Sequence: Synthetic peptide
LPSHETR

SEQ ID NO: 11696 - protein, 7 aa, Artificial Sequence
  Description of Artificial Sequence: Synthetic peptide
GSESALR

SEQ ID NO: 11697 - protein, 7 aa, Artificial Sequence
  Description of Artificial Sequence: Synthetic peptide
SHSPSNM

SEQ ID NO: 11698 - protein, 7 aa, Artificial Sequence
  Description of Artificial Sequence: Synthetic peptide
FVEKPNS

SEQ ID NO: 11699 - protein, 7 aa, Artificial Sequence
  Description of Artificial Sequence: Synthetic peptide
ANSQGNL

SEQ ID NO: 11700 - protein, 7 aa, Artificial Sequence
  Description of Artificial Sequence: Synthetic peptide
STSRTPV

SEQ ID NO: 11701 - protein, 7 aa, Artificial Sequence
  Description of Artificial Sequence: Synthetic peptide
RDSGAKN

SEQ ID NO: 11702 - protein, 7 aa, Artificial Sequence
  Description of Artificial Sequence: Synthetic peptide
TQAGDHR

SEQ ID NO: 11703 - protein, 7 aa, Artificial Sequence
  Description of Artificial Sequence: Synthetic peptide
ASGVQGQ

SEQ ID NO: 11704 - protein, 7 aa, Artificial Sequence
  Description of Artificial Sequence: Synthetic peptide
GANGRGS

SEQ ID NO: 11705 - protein, 7 aa, Artificial Sequence
  Description of Artificial Sequence: Synthetic peptide
YATKEPR

SEQ ID NO: 11706 - protein, 7 aa, Artificial Sequence
  Description of Artificial Sequence: Synthetic peptide
NVTTSTQ

SEQ ID NO: 11707 - protein, 7 aa, Artificial Sequence
  Description of Artificial Sequence: Synthetic peptide
DGQPRSA

SEQ ID NO: 11708 - protein, 7 aa, Artificial Sequence
  Description of Artificial Sequence: Synthetic peptide
GDRNQPH

SEQ ID NO: 11709 - protein, 7 aa, Artificial Sequence
  Description of Artificial Sequence: Synthetic peptide
DGARTPT

SEQ ID NO: 11710 - protein, 7 aa, Artificial Sequence
  Description of Artificial Sequence: Synthetic peptide
KSHDKSS

SEQ ID NO: 11711 - protein, 7 aa, Artificial Sequence
  Description of Artificial Sequence: Synthetic peptide
HLGSDKS

SEQ ID NO: 11712 - protein, 7 aa, Artificial Sequence
  Description of Artificial Sequence: Synthetic peptide
TSSKPYT

SEQ ID NO: 11713 - protein, 7 aa, Artificial Sequence
  Description of Artificial Sequence: Synthetic peptide
SKTNTAS

SEQ ID NO: 11714 - protein, 7 aa, Artificial Sequence
  Description of Artificial Sequence: Synthetic peptide
SLSKSHE

SEQ ID NO: 11715 - protein, 7 aa, Artificial Sequence
  Description of Artificial Sequence: Synthetic peptide
ESSAKVP

SEQ ID NO: 11716 - protein, 7 aa, Artificial Sequence
  Description of Artificial Sequence: Synthetic peptide
AGDGRVN

SEQ ID NO: 11717 - protein, 7 aa, Artificial Sequence
  Description of Artificial Sequence: Synthetic peptide
GLTKPTA

SEQ ID NO: 11718 - protein, 7 aa, Artificial Sequence
  Description of Artificial Sequence: Synthetic peptide
VGKGQAP

SEQ ID NO: 11719 - protein, 7 aa, Artificial Sequence
  Description of Artificial Sequence: Synthetic peptide
STSTHQG

SEQ ID NO: 11720 - protein, 7 aa, Artificial Sequence
  Description of Artificial Sequence: Synthetic peptide
SAIGANT

SEQ ID NO: 11721 - protein, 7 aa, Artificial Sequence
  Description of Artificial Sequence: Synthetic peptide
TSTNVKE

SEQ ID NO: 11722 - protein, 7 aa, Artificial Sequence
  Description of Artificial Sequence: Synthetic peptide
THQEHNS

SEQ ID NO: 11723 - protein, 7 aa, Artificial Sequence
  Description of Artificial Sequence: Synthetic peptide
SRSPDTT

SEQ ID NO: 11724 - protein, 7 aa, Artificial Sequence
  Description of Artificial Sequence: Synthetic peptide
RNADPQQ

SEQ ID NO: 11725 - protein, 7 aa, Artificial Sequence
  Description of Artificial Sequence: Synthetic peptide
GPNNEPR

SEQ ID NO: 11726 - protein, 7 aa, Artificial Sequence
  Description of Artificial Sequence: Synthetic peptide
LPSKSTG

SEQ ID NO: 11727 - protein, 7 aa, Artificial Sequence
  Description of Artificial Sequence: Synthetic peptide
GTSGDSH

SEQ ID NO: 11728 - protein, 7 aa, Artificial Sequence
  Description of Artificial Sequence: Synthetic peptide
TANGTNS

SEQ ID NO: 11729 - protein, 7 aa, Artificial Sequence
  Description of Artificial Sequence: Synthetic peptide
TNSNMHT

SEQ ID NO: 11730 - protein, 7 aa, Artificial Sequence
  Description of Artificial Sequence: Synthetic peptide
TSPGAGR

SEQ ID NO: 11731 - protein, 7 aa, Artificial Sequence
  Description of Artificial Sequence: Synthetic peptide
TGRSSMS

SEQ ID NO: 11732 - protein, 7 aa, Artificial Sequence
  Description of Artificial Sequence: Synthetic peptide
TGMADKG

SEQ ID NO: 11733 - protein, 7 aa, Artificial Sequence
  Description of Artificial Sequence: Synthetic peptide
TSGTSSL

SEQ ID NO: 11734 - protein, 7 aa, Artificial Sequence
  Description of Artificial Sequence: Synthetic peptide
SQTSHTV

SEQ ID NO: 11735 - protein, 7 aa, Artificial Sequence
  Description of Artificial Sequence: Synthetic peptide
GLMGASK

SEQ ID NO: 11736 - protein, 7 aa, Artificial Sequence
  Description of Artificial Sequence: Synthetic peptide
VPNNSPN

SEQ ID NO: 11737 - protein, 7 aa, Artificial Sequence
  Description of Artificial Sequence: Synthetic peptide
GHSKSPI

SEQ ID NO: 11738 - protein, 7 aa, Artificial Sequence
  Description of Artificial Sequence: Synthetic peptide
TDVKTPH

SEQ ID NO: 11739 - protein, 7 aa, Artificial Sequence
  Description of Artificial Sequence: Synthetic peptide
TASRSNS

SEQ ID NO: 11740 - protein, 7 aa, Artificial Sequence
  Description of Artificial Sequence: Synthetic peptide
HNGDIKG

SEQ ID NO: 11741 - protein, 7 aa, Artificial Sequence
  Description of Artificial Sequence: Synthetic peptide
AGSSHTG

SEQ ID NO: 11742 - protein, 7 aa, Artificial Sequence
  Description of Artificial Sequence: Synthetic peptide
GSLGNER

SEQ ID NO: 11743 - protein, 7 aa, Artificial Sequence
  Description of Artificial Sequence: Synthetic peptide
NRTHTNV

SEQ ID NO: 11744 - protein, 7 aa, Artificial Sequence
  Description of Artificial Sequence: Synthetic peptide
TERAASV

SEQ ID NO: 11745 - protein, 7 aa, Artificial Sequence
  Description of Artificial Sequence: Synthetic peptide
INQTKPE

SEQ ID NO: 11746 - protein, 7 aa, Artificial Sequence
  Description of Artificial Sequence: Synthetic peptide
RTSNGTS

SEQ ID NO: 11747 - protein, 7 aa, Artificial Sequence
  Description of Artificial Sequence: Synthetic peptide
GRANGVA

SEQ ID NO: 11748 - protein, 7 aa, Artificial Sequence
  Description of Artificial Sequence: Synthetic peptide
STNPVNV

SEQ ID NO: 11749 - protein, 7 aa, Artificial Sequence
  Description of Artificial Sequence: Synthetic peptide
DGKSSPV

SEQ ID NO: 11750 - protein, 7 aa, Artificial Sequence
  Description of Artificial Sequence: Synthetic peptide
MQQTSTA

SEQ ID NO: 11751 - protein, 7 aa, Artificial Sequence
  Description of Artificial Sequence: Synthetic peptide
LGASSAA

SEQ ID NO: 11752 - protein, 7 aa, Artificial Sequence
  Description of Artificial Sequence: Synthetic peptide
AKTTSLA

SEQ ID NO: 11753 - protein, 7 aa, Artificial Sequence
  Description of Artificial Sequence: Synthetic peptide
SSSTTNT

SEQ ID NO: 11754 - protein, 7 aa, Artificial Sequence
  Description of Artificial Sequence: Synthetic peptide
NTGSGNS

SEQ ID NO: 11755 - protein, 7 aa, Artificial Sequence
  Description of Artificial Sequence: Synthetic peptide
TTATNFA

SEQ ID NO: 11756 - protein, 7 aa, Artificial Sequence
  Description of Artificial Sequence: Synthetic peptide
QSPGAHN

SEQ ID NO: 11757 - protein, 7 aa, Artificial Sequence
  Description of Artificial Sequence: Synthetic peptide
SVASDRI

SEQ ID NO: 11758 - protein, 7 aa, Artificial Sequence
  Description of Artificial Sequence: Synthetic peptide
LADRSNT

SEQ ID NO: 11759 - protein, 7 aa, Artificial Sequence
  Description of Artificial Sequence: Synthetic peptide
SQATVSR

SEQ ID NO: 11760 - protein, 7 aa, Artificial Sequence
  Description of Artificial Sequence: Synthetic peptide
NGRGTVV

SEQ ID NO: 11761 - protein, 7 aa, Artificial Sequence
  Description of Artificial Sequence: Synthetic peptide
VSSASPT

SEQ ID NO: 11762 - protein, 7 aa, Artificial Sequence
  Description of Artificial Sequence: Synthetic peptide
SGSDVSR

SEQ ID NO: 11763 - protein, 7 aa, Artificial Sequence
  Description of Artificial Sequence: Synthetic peptide
TNVAAQG

SEQ ID NO: 11764 - protein, 7 aa, Artificial Sequence
  Description of Artificial Sequence: Synthetic peptide
VTSSPTL

SEQ ID NO: 11765 - protein, 7 aa, Artificial Sequence
  Description of Artificial Sequence: Synthetic peptide
STTTPST

SEQ ID NO: 11766 - protein, 7 aa, Artificial Sequence
  Description of Artificial Sequence: Synthetic peptide
GDGTRPK

SEQ ID NO: 11767 - protein, 7 aa, Artificial Sequence
  Description of Artificial Sequence: Synthetic peptide
SSTTHSK

SEQ ID NO: 11768 - protein, 7 aa, Artificial Sequence
  Description of Artificial Sequence: Synthetic peptide
ASQPKGG

SEQ ID NO: 11769 - protein, 7 aa, Artificial Sequence
  Description of Artificial Sequence: Synthetic peptide
SASSSPV

SEQ ID NO: 11770 - protein, 7 aa, Artificial Sequence
  Description of Artificial Sequence: Synthetic peptide
HQNGPQK

SEQ ID NO: 11771 - protein, 7 aa, Artificial Sequence
  Description of Artificial Sequence: Synthetic peptide
GNGEQRG

SEQ ID NO: 11772 - protein, 7 aa, Artificial Sequence
  Description of Artificial Sequence: Synthetic peptide
GTQNSKL

SEQ ID NO: 11773 - protein, 7 aa, Artificial Sequence
  Description of Artificial Sequence: Synthetic peptide
NRLPSAS

SEQ ID NO: 11774 - protein, 7 aa, Artificial Sequence
  Description of Artificial Sequence: Synthetic peptide
LPTAPRD

SEQ ID NO: 11775 - protein, 7 aa, Artificial Sequence
  Description of Artificial Sequence: Synthetic peptide
QGDNQFK

SEQ ID NO: 11776 - protein, 7 aa, Artificial Sequence
  Description of Artificial Sequence: Synthetic peptide
STGSTTG

SEQ ID NO: 11777 - protein, 7 aa, Artificial Sequence
  Description of Artificial Sequence: Synthetic peptide
TGASSGN

SEQ ID NO: 11778 - protein, 7 aa, Artificial Sequence
  Description of Artificial Sequence: Synthetic peptide
DHGKTSV

SEQ ID NO: 11779 - protein, 7 aa, Artificial Sequence
  Description of Artificial Sequence: Synthetic peptide
ESDRAKH

SEQ ID NO: 11780 - protein, 7 aa, Artificial Sequence
  Description of Artificial Sequence: Synthetic peptide
NNGHADR

SEQ ID NO: 11781 - protein, 7 aa, Artificial Sequence
  Description of Artificial Sequence: Synthetic peptide
NSATNSL

SEQ ID NO: 11782 - protein, 7 aa, Artificial Sequence
  Description of Artificial Sequence: Synthetic peptide
KQSPPDK

SEQ ID NO: 11783 - protein, 7 aa, Artificial Sequence
  Description of Artificial Sequence: Synthetic peptide
KGTEQPH

SEQ ID NO: 11784 - protein, 7 aa, Artificial Sequence
  Description of Artificial Sequence: Synthetic peptide
NATSNPH

SEQ ID NO: 11785 - protein, 7 aa, Artificial Sequence
  Description of Artificial Sequence: Synthetic peptide
TTQKATM

SEQ ID NO: 11786 - protein, 7 aa, Artificial Sequence
  Description of Artificial Sequence: Synthetic peptide
TTLDGAK

SEQ ID NO: 11787 - protein, 7 aa, Artificial Sequence
  Description of Artificial Sequence: Synthetic peptide
TTDMKLG

SEQ ID NO: 11788 - protein, 7 aa, Artificial Sequence
  Description of Artificial Sequence: Synthetic peptide
TSRESPP

SEQ ID NO: 11789 - protein, 7 aa, Artificial Sequence
  Description of Artificial Sequence: Synthetic peptide
TLSKSSI

SEQ ID NO: 11790 - protein, 7 aa, Artificial Sequence
  Description of Artificial Sequence: Synthetic peptide
TDATSSG

SEQ ID NO: 11791 - protein, 7 aa, Artificial Sequence
  Description of Artificial Sequence: Synthetic peptide
TGTTSTM

SEQ ID NO: 11792 - protein, 7 aa, Artificial Sequence
  Description of Artificial Sequence: Synthetic peptide
SKVSSQE

SEQ ID NO: 11793 - protein, 7 aa, Artificial Sequence
  Description of Artificial Sequence: Synthetic peptide
SSMPAAG

SEQ ID NO: 11794 - protein, 7 aa, Artificial Sequence
  Description of Artificial Sequence: Synthetic peptide
SSGSAQP

SEQ ID NO: 11795 - protein, 7 aa, Artificial Sequence
  Description of Artificial Sequence: Synthetic peptide
SQAHVTK

SEQ ID NO: 11796 - protein, 7 aa, Artificial Sequence
  Description of Artificial Sequence: Synthetic peptide
SPATNKI

SEQ ID NO: 11797 - protein, 7 aa, Artificial Sequence
  Description of Artificial Sequence: Synthetic peptide
SESTRTT

SEQ ID NO: 11798 - protein, 7 aa, Artificial Sequence
  Description of Artificial Sequence: Synthetic peptide
SGHSKLP

SEQ ID NO: 11799 - protein, 7 aa, Artificial Sequence
  Description of Artificial Sequence: Synthetic peptide
SVSAAKG

SEQ ID NO: 11800 - protein, 7 aa, Artificial Sequence
  Description of Artificial Sequence: Synthetic peptide
RTEQGSN

SEQ ID NO: 11801 - protein, 7 aa, Artificial Sequence
  Description of Artificial Sequence: Synthetic peptide
SSSSRNT

SEQ ID NO: 11802 - protein, 7 aa, Artificial Sequence
  Description of Artificial Sequence: Synthetic peptide
MAGQRDS

SEQ ID NO: 11803 - protein, 7 aa, Artificial Sequence
  Description of Artificial Sequence: Synthetic peptide
QSTPNLK

SEQ ID NO: 11804 - protein, 7 aa, Artificial Sequence
  Description of Artificial Sequence: Synthetic peptide
QGVQAAS

SEQ ID NO: 11805 - protein, 7 aa, Artificial Sequence
  Description of Artificial Sequence: Synthetic peptide
QSSHSSA

SEQ ID NO: 11806 - protein, 7 aa, Artificial Sequence
  Description of Artificial Sequence: Synthetic peptide
QLGKPDS

SEQ ID NO: 11807 - protein, 7 aa, Artificial Sequence
  Description of Artificial Sequence: Synthetic peptide
LQPGSAG

SEQ ID NO: 11808 - protein, 7 aa, Artificial Sequence
  Description of Artificial Sequence: Synthetic peptide
LTDTKGA

SEQ ID NO: 11809 - protein, 7 aa, Artificial Sequence
  Description of Artificial Sequence: Synthetic peptide
LSVKPMS

SEQ ID NO: 11810 - protein, 7 aa, Artificial Sequence
  Description of Artificial Sequence: Synthetic peptide
EDSARSN

SEQ ID NO: 11811 - protein, 7 aa, Artificial Sequence
  Description of Artificial Sequence: Synthetic peptide
EGNGVHN

SEQ ID NO: 11812 - protein, 7 aa, Artificial Sequence
  Description of Artificial Sequence: Synthetic peptide
DSKDRSI

SEQ ID NO: 11813 - protein, 7 aa, Artificial Sequence
  Description of Artificial Sequence: Synthetic peptide
DPPKTSP

SEQ ID NO: 11814 - protein, 7 aa, Artificial Sequence
  Description of Artificial Sequence: Synthetic peptide
EKGASSA

SEQ ID NO: 11815 - protein, 7 aa, Artificial Sequence
  Description of Artificial Sequence: Synthetic peptide
EPGTSPN

SEQ ID NO: 11816 - protein, 7 aa, Artificial Sequence
  Description of Artificial Sequence: Synthetic peptide
DNHSSKS

SEQ ID NO: 11817 - protein, 7 aa, Artificial Sequence
  Description of Artificial Sequence: Synthetic peptide
DSSKSMV

SEQ ID NO: 11818 - protein, 7 aa, Artificial Sequence
  Description of Artificial Sequence: Synthetic peptide
ASTGDKR

SEQ ID NO: 11819 - protein, 7 aa, Artificial Sequence
  Description of Artificial Sequence: Synthetic peptide
AMNTASS

SEQ ID NO: 11820 - protein, 7 aa, Artificial Sequence
  Description of Artificial Sequence: Synthetic peptide
ADQQPTR

SEQ ID NO: 11821 - protein, 7 aa, Artificial Sequence
  Description of Artificial Sequence: Synthetic peptide
AGDVARQ

SEQ ID NO: 11822 - protein, 7 aa, Artificial Sequence
  Description of Artificial Sequence: Synthetic peptide
AGGSTSK

SEQ ID NO: 11823 - protein, 7 aa, Artificial Sequence
  Description of Artificial Sequence: Synthetic peptide
AMASGSS

SEQ ID NO: 11824 - protein, 7 aa, Artificial Sequence
  Description of Artificial Sequence: Synthetic peptide
GNPTDQK

SEQ ID NO: 11825 - protein, 7 aa, Artificial Sequence
  Description of Artificial Sequence: Synthetic peptide
GSTPSTL

SEQ ID NO: 11826 - protein, 7 aa, Artificial Sequence
  Description of Artificial Sequence: Synthetic peptide
GPQTSKS

SEQ ID NO: 11827 - protein, 7 aa, Artificial Sequence
  Description of Artificial Sequence: Synthetic peptide
GGTNGIQ

SEQ ID NO: 11828 - protein, 7 aa, Artificial Sequence
  Description of Artificial Sequence: Synthetic peptide
GSKGDLT

SEQ ID NO: 11829 - protein, 7 aa, Artificial Sequence
  Description of Artificial Sequence: Synthetic peptide
GSEKDRH

SEQ ID NO: 11830 - protein, 7 aa, Artificial Sequence
  Description of Artificial Sequence: Synthetic peptide
VSAKGVM

SEQ ID NO: 11831 - protein, 7 aa, Artificial Sequence
  Description of Artificial Sequence: Synthetic peptide
VESKINS

SEQ ID NO: 11832 - protein, 7 aa, Artificial Sequence
  Description of Artificial Sequence: Synthetic peptide
VGASSIA

SEQ ID NO: 11833 - protein, 7 aa, Artificial Sequence
  Description of Artificial Sequence: Synthetic peptide
STKAPSG

SEQ ID NO: 11834 - protein, 7 aa, Artificial Sequence
  Description of Artificial Sequence: Synthetic peptide
SSKSQPS

SEQ ID NO: 11835 - protein, 7 aa, Artificial Sequence
  Description of Artificial Sequence: Synthetic peptide
SGRGSSE

SEQ ID NO: 11836 - protein, 7 aa, Artificial Sequence
  Description of Artificial Sequence: Synthetic peptide
LKTTGSG

SEQ ID NO: 11837 - protein, 7 aa, Artificial Sequence
  Description of Artificial Sequence: Synthetic peptide
LPSGKDP

SEQ ID NO: 11838 - protein, 7 aa, Artificial Sequence
  Description of Artificial Sequence: Synthetic peptide
TGNPGNT

SEQ ID NO: 11839 - protein, 7 aa, Artificial Sequence
  Description of Artificial Sequence: Synthetic peptide
MGQTSLS

SEQ ID NO: 11840 - protein, 7 aa, Artificial Sequence
  Description of Artificial Sequence: Synthetic peptide
TPSAPSN

SEQ ID NO: 11841 - protein, 7 aa, Artificial Sequence
  Description of Artificial Sequence: Synthetic peptide
SSSNHPT

SEQ ID NO: 11842 - protein, 7 aa, Artificial Sequence
  Description of Artificial Sequence: Synthetic peptide
ASEQSAK

SEQ ID NO: 11843 - protein, 7 aa, Artificial Sequence
  Description of Artificial Sequence: Synthetic peptide
SGTSHVL

SEQ ID NO: 11844 - protein, 7 aa, Artificial Sequence
  Description of Artificial Sequence: Synthetic peptide
VGSPSAS

SEQ ID NO: 11845 - protein, 7 aa, Artificial Sequence
  Description of Artificial Sequence: Synthetic peptide
NINSAHS

SEQ ID NO: 11846 - protein, 7 aa, Artificial Sequence
  Description of Artificial Sequence: Synthetic peptide
LTGTSTP

SEQ ID NO: 11847 - protein, 7 aa, Artificial Sequence
  Description of Artificial Sequence: Synthetic peptide
SGGQPLN

SEQ ID NO: 11848 - protein, 7 aa, Artificial Sequence
  Description of Artificial Sequence: Synthetic peptide
ENTSTVH

SEQ ID NO: 11849 - protein, 7 aa, Artificial Sequence
  Description of Artificial Sequence: Synthetic peptide
NGGDVSR

SEQ ID NO: 11850 - protein, 7 aa, Artificial Sequence
  Description of Artificial Sequence: Synthetic peptide
DFGKTST

SEQ ID NO: 11851 - protein, 7 aa, Artificial Sequence
  Description of Artificial Sequence: Synthetic peptide
GIVHSER

SEQ ID NO: 11852 - protein, 7 aa, Artificial Sequence
  Description of Artificial Sequence: Synthetic peptide
RGSEPVN

SEQ ID NO: 11853 - protein, 7 aa, Artificial Sequence
  Description of Artificial Sequence: Synthetic peptide
STTSSSR

SEQ ID NO: 11854 - protein, 7 aa, Artificial Sequence
  Description of Artificial Sequence: Synthetic peptide
GGVDTSR

SEQ ID NO: 11855 - protein, 7 aa, Artificial Sequence
  Description of Artificial Sequence: Synthetic peptide
GSGGVRG

SEQ ID NO: 11856 - protein, 7 aa, Artificial Sequence
  Description of Artificial Sequence: Synthetic peptide
NQSTRPD

SEQ ID NO: 11857 - protein, 7 aa, Artificial Sequence
  Description of Artificial Sequence: Synthetic peptide
TRDSTKS

SEQ ID NO: 11858 - protein, 7 aa, Artificial Sequence
  Description of Artificial Sequence: Synthetic peptide
SNTTHSA

SEQ ID NO: 11859 - protein, 7 aa, Artificial Sequence
  Description of Artificial Sequence: Synthetic peptide
SRNATSA

SEQ ID NO: 11860 - protein, 7 aa, Artificial Sequence
  Description of Artificial Sequence: Synthetic peptide
SGSGTVR

SEQ ID NO: 11861 - protein, 7 aa, Artificial Sequence
  Description of Artificial Sequence: Synthetic peptide
SRTVSST

SEQ ID NO: 11862 - protein, 7 aa, Artificial Sequence
  Description of Artificial Sequence: Synthetic peptide
APGEAQS

SEQ ID NO: 11863 - protein, 7 aa, Artificial Sequence
  Description of Artificial Sequence: Synthetic peptide
EPSNNSK

SEQ ID NO: 11864 - protein, 7 aa, Artificial Sequence
  Description of Artificial Sequence: Synthetic peptide
DQQSTNR

SEQ ID NO: 11865 - protein, 7 aa, Artificial Sequence
  Description of Artificial Sequence: Synthetic peptide
GLTKQET

SEQ ID NO: 11866 - protein, 7 aa, Artificial Sequence
  Description of Artificial Sequence: Synthetic peptide
SDKSGIV

SEQ ID NO: 11867 - protein, 7 aa, Artificial Sequence
  Description of Artificial Sequence: Synthetic peptide
EGQKTES

SEQ ID NO: 11868 - protein, 7 aa, Artificial Sequence
  Description of Artificial Sequence: Synthetic peptide
ARDSHTT

SEQ ID NO: 11869 - protein, 7 aa, Artificial Sequence
  Description of Artificial Sequence: Synthetic peptide
SNPQSMG

SEQ ID NO: 11870 - protein, 7 aa, Artificial Sequence
  Description of Artificial Sequence: Synthetic peptide
QNKESYK

SEQ ID NO: 11871 - protein, 7 aa, Artificial Sequence
  Description of Artificial Sequence: Synthetic peptide
GNRGGTS

SEQ ID NO: 11872 - protein, 7 aa, Artificial Sequence
  Description of Artificial Sequence: Synthetic peptide
NPMVNGK

SEQ ID NO: 11873 - protein, 7 aa, Artificial Sequence
  Description of Artificial Sequence: Synthetic peptide
NVQAATK

SEQ ID NO: 11874 - protein, 7 aa, Artificial Sequence
  Description of Artificial Sequence: Synthetic peptide
SSSSKGV

SEQ ID NO: 11875 - protein, 7 aa, Artificial Sequence
  Description of Artificial Sequence: Synthetic peptide
IRTKESH

SEQ ID NO: 11876 - protein, 7 aa, Artificial Sequence
  Description of Artificial Sequence: Synthetic peptide
QSSPPKT

SEQ ID NO: 11877 - protein, 7 aa, Artificial Sequence
  Description of Artificial Sequence: Synthetic peptide
DTRGKGI

SEQ ID NO: 11878 - protein, 7 aa, Artificial Sequence
  Description of Artificial Sequence: Synthetic peptide
EVNSARA

SEQ ID NO: 11879 - protein, 7 aa, Artificial Sequence
  Description of Artificial Sequence: Synthetic peptide
EVGKHSN

SEQ ID NO: 11880 - protein, 7 aa, Artificial Sequence
  Description of Artificial Sequence: Synthetic peptide
SIGGTNG

SEQ ID NO: 11881 - protein, 7 aa, Artificial Sequence
  Description of Artificial Sequence: Synthetic peptide
TPTTKRE

SEQ ID NO: 11882 - protein, 7 aa, Artificial Sequence
  Description of Artificial Sequence: Synthetic peptide
QVASANP

SEQ ID NO: 11883 - protein, 7 aa, Artificial Sequence
  Description of Artificial Sequence: Synthetic peptide
DQAKSIR

SEQ ID NO: 11884 - protein, 7 aa, Artificial Sequence
  Description of Artificial Sequence: Synthetic peptide
GSMGTAK

SEQ ID NO: 11885 - protein, 7 aa, Artificial Sequence
  Description of Artificial Sequence: Synthetic peptide
VNGGHGK

SEQ ID NO: 11886 - protein, 7 aa, Artificial Sequence
  Description of Artificial Sequence: Synthetic peptide
VSSGGTA

SEQ ID NO: 11887 - protein, 7 aa, Artificial Sequence
  Description of Artificial Sequence: Synthetic peptide
SLGQSTA

SEQ ID NO: 11888 - protein, 7 aa, Artificial Sequence
  Description of Artificial Sequence: Synthetic peptide
QGVTNKS

SEQ ID NO: 11889 - protein, 7 aa, Artificial Sequence
  Description of Artificial Sequence: Synthetic peptide
EGVTTGS

SEQ ID NO: 11890 - protein, 7 aa, Artificial Sequence
  Description of Artificial Sequence: Synthetic peptide
SQSAQNQ

SEQ ID NO: 11891 - protein, 7 aa, Artificial Sequence
  Description of Artificial Sequence: Synthetic peptide
SSANGTR

SEQ ID NO: 11892 - protein, 7 aa, Artificial Sequence
  Description of Artificial Sequence: Synthetic peptide
EVNAPRK

SEQ ID NO: 11893 - protein, 7 aa, Artificial Sequence
  Description of Artificial Sequence: Synthetic peptide
TMTSSAA

SEQ ID NO: 11894 - protein, 7 aa, Artificial Sequence
  Description of Artificial Sequence: Synthetic peptide
RDPPSSS

SEQ ID NO: 11895 - protein, 7 aa, Artificial Sequence
  Description of Artificial Sequence: Synthetic peptide
RVNKSSE

SEQ ID NO: 11896 - protein, 7 aa, Artificial Sequence
  Description of Artificial Sequence: Synthetic peptide
QSDKEPR

SEQ ID NO: 11897 - protein, 7 aa, Artificial Sequence
  Description of Artificial Sequence: Synthetic peptide
VSVPPSN

SEQ ID NO: 11898 - protein, 7 aa, Artificial Sequence
  Description of Artificial Sequence: Synthetic peptide
NSDGKVR

SEQ ID NO: 11899 - protein, 7 aa, Artificial Sequence
  Description of Artificial Sequence: Synthetic peptide
SGNNGNA

SEQ ID NO: 11900 - protein, 7 aa, Artificial Sequence
  Description of Artificial Sequence: Synthetic peptide
QVNTNGG

SEQ ID NO: 11901 - protein, 7 aa, Artificial Sequence
  Description of Artificial Sequence: Synthetic peptide
AHKATNV

SEQ ID NO: 11902 - protein, 7 aa, Artificial Sequence
  Description of Artificial Sequence: Synthetic peptide
AASQATV

SEQ ID NO: 11903 - protein, 7 aa, Artificial Sequence
  Description of Artificial Sequence: Synthetic peptide
VGGSPNS

SEQ ID NO: 11904 - protein, 7 aa, Artificial Sequence
  Description of Artificial Sequence: Synthetic peptide
VGGSSKG

SEQ ID NO: 11905 - protein, 7 aa, Artificial Sequence
  Description of Artificial Sequence: Synthetic peptide
GTTTVAG

SEQ ID NO: 11906 - protein, 7 aa, Artificial Sequence
  Description of Artificial Sequence: Synthetic peptide
TQVTSPA

SEQ ID NO: 11907 - protein, 7 aa, Artificial Sequence
  Description of Artificial Sequence: Synthetic peptide
GTESQRL

SEQ ID NO: 11908 - protein, 7 aa, Artificial Sequence
  Description of Artificial Sequence: Synthetic peptide
TGAAANH

SEQ ID NO: 11909 - protein, 7 aa, Artificial Sequence
  Description of Artificial Sequence: Synthetic peptide
SNNNGST

SEQ ID NO: 11910 - protein, 7 aa, Artificial Sequence
  Description of Artificial Sequence: Synthetic peptide
SSDQRNG

SEQ ID NO: 11911 - protein, 7 aa, Artificial Sequence
  Description of Artificial Sequence: Synthetic peptide
SGLNKSG

SEQ ID NO: 11912 - protein, 7 aa, Artificial Sequence
  Description of Artificial Sequence: Synthetic peptide
QVNAPNS

SEQ ID NO: 11913 - protein, 7 aa, Artificial Sequence
  Description of Artificial Sequence: Synthetic peptide
SGHDRSG

SEQ ID NO: 11914 - protein, 7 aa, Artificial Sequence
  Description of Artificial Sequence: Synthetic peptide
STRSGEG

SEQ ID NO: 11915 - protein, 7 aa, Artificial Sequence
  Description of Artificial Sequence: Synthetic peptide
STSSHPI

SEQ ID NO: 11916 - protein, 7 aa, Artificial Sequence
  Description of Artificial Sequence: Synthetic peptide
ATDRQGA

SEQ ID NO: 11917 - protein, 7 aa, Artificial Sequence
  Description of Artificial Sequence: Synthetic peptide
SPVERKS

SEQ ID NO: 11918 - protein, 7 aa, Artificial Sequence
  Description of Artificial Sequence: Synthetic peptide
SPSNSRT

SEQ ID NO: 11919 - protein, 7 aa, Artificial Sequence
  Description of Artificial Sequence: Synthetic peptide
ADNQKSQ

SEQ ID NO: 11920 - protein, 7 aa, Artificial Sequence
  Description of Artificial Sequence: Synthetic peptide
NATTTGH

SEQ ID NO: 11921 - protein, 7 aa, Artificial Sequence
  Description of Artificial Sequence: Synthetic peptide
TSDKQFP

SEQ ID NO: 11922 - protein, 7 aa, Artificial Sequence
  Description of Artificial Sequence: Synthetic peptide
TPEGRTS

SEQ ID NO: 11923 - protein, 7 aa, Artificial Sequence
  Description of Artificial Sequence: Synthetic peptide
SNNKAML

SEQ ID NO: 11924 - protein, 7 aa, Artificial Sequence
  Description of Artificial Sequence: Synthetic peptide
SDSRKDG

SEQ ID NO: 11925 - protein, 7 aa, Artificial Sequence
  Description of Artificial Sequence: Synthetic peptide
LTSQGKN

SEQ ID NO: 11926 - protein, 7 aa, Artificial Sequence
  Description of Artificial Sequence: Synthetic peptide
GSKTSLT

SEQ ID NO: 11927 - protein, 7 aa, Artificial Sequence
  Description of Artificial Sequence: Synthetic peptide
YGTGSVV

SEQ ID NO: 11928 - protein, 7 aa, Artificial Sequence
  Description of Artificial Sequence: Synthetic peptide
STGSGAN

SEQ ID NO: 11929 - protein, 7 aa, Artificial Sequence
  Description of Artificial Sequence: Synthetic peptide
IPNAKEQ

SEQ ID NO: 11930 - protein, 7 aa, Artificial Sequence
  Description of Artificial Sequence: Synthetic peptide
SADKSLS

SEQ ID NO: 11931 - protein, 7 aa, Artificial Sequence
  Description of Artificial Sequence: Synthetic peptide
DPGIPKS

SEQ ID NO: 11932 - protein, 7 aa, Artificial Sequence
  Description of Artificial Sequence: Synthetic peptide
GLSVPPN

SEQ ID NO: 11933 - protein, 7 aa, Artificial Sequence
  Description of Artificial Sequence: Synthetic peptide
SVDNKGL

SEQ ID NO: 11934 - protein, 7 aa, Artificial Sequence
  Description of Artificial Sequence: Synthetic peptide
HTDASRS

SEQ ID NO: 11935 - protein, 7 aa, Artificial Sequence
  Description of Artificial Sequence: Synthetic peptide
SSNSSTV

SEQ ID NO: 11936 - protein, 7 aa, Artificial Sequence
  Description of Artificial Sequence: Synthetic peptide
AQRAEMK

SEQ ID NO: 11937 - protein, 7 aa, Artificial Sequence
  Description of Artificial Sequence: Synthetic peptide
TSANAST

SEQ ID NO: 11938 - protein, 7 aa, Artificial Sequence
  Description of Artificial Sequence: Synthetic peptide
SNRTPTT

SEQ ID NO: 11939 - protein, 7 aa, Artificial Sequence
  Description of Artificial Sequence: Synthetic peptide
SGDSHSR

SEQ ID NO: 11940 - protein, 7 aa, Artificial Sequence
  Description of Artificial Sequence: Synthetic peptide
DQTSTAR

SEQ ID NO: 11941 - protein, 7 aa, Artificial Sequence
  Description of Artificial Sequence: Synthetic peptide
DSHSPGS

SEQ ID NO: 11942 - protein, 7 aa, Artificial Sequence
  Description of Artificial Sequence: Synthetic peptide
ASSSSTL

SEQ ID NO: 11943 - protein, 7 aa, Artificial Sequence
  Description of Artificial Sequence: Synthetic peptide
AEHSKIQ

SEQ ID NO: 11944 - protein, 7 aa, Artificial Sequence
  Description of Artificial Sequence: Synthetic peptide
SAATSNI

SEQ ID NO: 11945 - protein, 7 aa, Artificial Sequence
  Description of Artificial Sequence: Synthetic peptide
SSDTRPS

SEQ ID NO: 11946 - protein, 7 aa, Artificial Sequence
  Description of Artificial Sequence: Synthetic peptide
LPSTSGS

SEQ ID NO: 11947 - protein, 7 aa, Artificial Sequence
  Description of Artificial Sequence: Synthetic peptide
NTDTSRN

SEQ ID NO: 11948 - protein, 7 aa, Artificial Sequence
  Description of Artificial Sequence: Synthetic peptide
TPTNDRS

SEQ ID NO: 11949 - protein, 7 aa, Artificial Sequence
  Description of Artificial Sequence: Synthetic peptide
TGGSALG

SEQ ID NO: 11950 - protein, 7 aa, Artificial Sequence
  Description of Artificial Sequence: Synthetic peptide
SSNTSQG

SEQ ID NO: 11951 - protein, 7 aa, Artificial Sequence
  Description of Artificial Sequence: Synthetic peptide
SGVGSMN

SEQ ID NO: 11952 - protein, 7 aa, Artificial Sequence
  Description of Artificial Sequence: Synthetic peptide
SSSQSSH

SEQ ID NO: 11953 - protein, 7 aa, Artificial Sequence
  Description of Artificial Sequence: Synthetic peptide
HELSGTK

SEQ ID NO: 11954 - protein, 7 aa, Artificial Sequence
  Description of Artificial Sequence: Synthetic peptide
QMATGNV

SEQ ID NO: 11955 - protein, 7 aa, Artificial Sequence
  Description of Artificial Sequence: Synthetic peptide
DESVKPQ

SEQ ID NO: 11956 - protein, 7 aa, Artificial Sequence
  Description of Artificial Sequence: Synthetic peptide
DSVNTRT

SEQ ID NO: 11957 - protein, 7 aa, Artificial Sequence
  Description of Artificial Sequence: Synthetic peptide
DSVTKRA

SEQ ID NO: 11958 - protein, 7 aa, Artificial Sequence
  Description of Artificial Sequence: Synthetic peptide
GTGTSVL

SEQ ID NO: 11959 - protein, 7 aa, Artificial Sequence
  Description of Artificial Sequence: Synthetic peptide
SLSNSSG

SEQ ID NO: 11960 - protein, 7 aa, Artificial Sequence
  Description of Artificial Sequence: Synthetic peptide
TQASRVS

SEQ ID NO: 11961 - protein, 7 aa, Artificial Sequence
  Description of Artificial Sequence: Synthetic peptide
ISNTATP

SEQ ID NO: 11962 - protein, 7 aa, Artificial Sequence
  Description of Artificial Sequence: Synthetic peptide
LRDSATH

SEQ ID NO: 11963 - protein, 7 aa, Artificial Sequence
  Description of Artificial Sequence: Synthetic peptide
NDAKSGN

SEQ ID NO: 11964 - protein, 7 aa, Artificial Sequence
  Description of Artificial Sequence: Synthetic peptide
TDPTPSK

SEQ ID NO: 11965 - protein, 7 aa, Artificial Sequence
  Description of Artificial Sequence: Synthetic peptide
ADTPRNQ

SEQ ID NO: 11966 - protein, 7 aa, Artificial Sequence
  Description of Artificial Sequence: Synthetic peptide
AGNNAPS

SEQ ID NO: 11967 - protein, 7 aa, Artificial Sequence
  Description of Artificial Sequence: Synthetic peptide
GSTNSHN

SEQ ID NO: 11968 - protein, 7 aa, Artificial Sequence
  Description of Artificial Sequence: Synthetic peptide
LAAGAGA

SEQ ID NO: 11969 - protein, 7 aa, Artificial Sequence
  Description of Artificial Sequence: Synthetic peptide
SGSGKMV

SEQ ID NO: 11970 - protein, 7 aa, Artificial Sequence
  Description of Artificial Sequence: Synthetic peptide
RPKPSDG

SEQ ID NO: 11971 - protein, 7 aa, Artificial Sequence
  Description of Artificial Sequence: Synthetic peptide
SATNSKL

SEQ ID NO: 11972 - protein, 7 aa, Artificial Sequence
  Description of Artificial Sequence: Synthetic peptide
NSDTRTA

SEQ ID NO: 11973 - protein, 7 aa, Artificial Sequence
  Description of Artificial Sequence: Synthetic peptide
TTPAQHA

SEQ ID NO: 11974 - protein, 7 aa, Artificial Sequence
  Description of Artificial Sequence: Synthetic peptide
TRSSPSM

SEQ ID NO: 11975 - protein, 7 aa, Artificial Sequence
  Description of Artificial Sequence: Synthetic peptide
TGGNNMQ

SEQ ID NO: 11976 - protein, 7 aa, Artificial Sequence
  Description of Artificial Sequence: Synthetic peptide
SKDHQNA

SEQ ID NO: 11977 - protein, 7 aa, Artificial Sequence
  Description of Artificial Sequence: Synthetic peptide
QSSGTNL

SEQ ID NO: 11978 - protein, 7 aa, Artificial Sequence
  Description of Artificial Sequence: Synthetic peptide
LVSENGR

SEQ ID NO: 11979 - protein, 7 aa, Artificial Sequence
  Description of Artificial Sequence: Synthetic peptide
LQGTGGS

SEQ ID NO: 11980 - protein, 7 aa, Artificial Sequence
  Description of Artificial Sequence: Synthetic peptide
DSVSART

SEQ ID NO: 11981 - protein, 7 aa, Artificial Sequence
  Description of Artificial Sequence: Synthetic peptide
ATQGSSV

SEQ ID NO: 11982 - protein, 7 aa, Artificial Sequence
  Description of Artificial Sequence: Synthetic peptide
NLKASSG

SEQ ID NO: 11983 - protein, 7 aa, Artificial Sequence
  Description of Artificial Sequence: Synthetic peptide
SGKSSSQ

SEQ ID NO: 11984 - protein, 7 aa, Artificial Sequence
  Description of Artificial Sequence: Synthetic peptide
NPSTPHH

SEQ ID NO: 11985 - protein, 7 aa, Artificial Sequence
  Description of Artificial Sequence: Synthetic peptide
STKTQSS

SEQ ID NO: 11986 - protein, 7 aa, Artificial Sequence
  Description of Artificial Sequence: Synthetic peptide
SLDSSRN

SEQ ID NO: 11987 - protein, 7 aa, Artificial Sequence
  Description of Artificial Sequence: Synthetic peptide
ISSNSSS

SEQ ID NO: 11988 - protein, 7 aa, Artificial Sequence
  Description of Artificial Sequence: Synthetic peptide
QGNSQFT

SEQ ID NO: 11989 - protein, 7 aa, Artificial Sequence
  Description of Artificial Sequence: Synthetic peptide
DTGSSSH

SEQ ID NO: 11990 - protein, 7 aa, Artificial Sequence
  Description of Artificial Sequence: Synthetic peptide
GVNGGSN

SEQ ID NO: 11991 - protein, 7 aa, Artificial Sequence
  Description of Artificial Sequence: Synthetic peptide
GSGDKVL

SEQ ID NO: 11992 - protein, 7 aa, Artificial Sequence
  Description of Artificial Sequence: Synthetic peptide
DGKTKNG

SEQ ID NO: 11993 - protein, 7 aa, Artificial Sequence
  Description of Artificial Sequence: Synthetic peptide
RTSDTSV

SEQ ID NO: 11994 - protein, 7 aa, Artificial Sequence
  Description of Artificial Sequence: Synthetic peptide
SQPDKAN

SEQ ID NO: 11995 - protein, 7 aa, Artificial Sequence
  Description of Artificial Sequence: Synthetic peptide
SQAQPVS

SEQ ID NO: 11996 - protein, 7 aa, Artificial Sequence
  Description of Artificial Sequence: Synthetic peptide
MQQTSAL

SEQ ID NO: 11997 - protein, 7 aa, Artificial Sequence
  Description of Artificial Sequence: Synthetic peptide
GVKSPHQ

SEQ ID NO: 11998 - protein, 7 aa, Artificial Sequence
  Description of Artificial Sequence: Synthetic peptide
RNGPPSQ

SEQ ID NO: 11999 - protein, 7 aa, Artificial Sequence
  Description of Artificial Sequence: Synthetic peptide
NSSEKVK

SEQ ID NO: 12000 - protein, 7 aa, Artificial Sequence
  Description of Artificial Sequence: Synthetic peptide
TGNHGPS

SEQ ID NO: 12001 - protein, 7 aa, Artificial Sequence
  Description of Artificial Sequence: Synthetic peptide
SGMDGKH

SEQ ID NO: 12002 - protein, 7 aa, Artificial Sequence
  Description of Artificial Sequence: Synthetic peptide
ILDSKSA

SEQ ID NO: 12003 - protein, 7 aa, Artificial Sequence
  Description of Artificial Sequence: Synthetic peptide
DRSASDK

SEQ ID NO: 12004 - protein, 7 aa, Artificial Sequence
  Description of Artificial Sequence: Synthetic peptide
SSTSSKT

SEQ ID NO: 12005 - protein, 7 aa, Artificial Sequence
  Description of Artificial Sequence: Synthetic peptide
LEGRTNS

SEQ ID NO: 12006 - protein, 7 aa, Artificial Sequence
  Description of Artificial Sequence: Synthetic peptide
RQAPALS

SEQ ID NO: 12007 - protein, 7 aa, Artificial Sequence
  Description of Artificial Sequence: Synthetic peptide
SKVTAEA

SEQ ID NO: 12008 - protein, 7 aa, Artificial Sequence
  Description of Artificial Sequence: Synthetic peptide
QSTSTSA

SEQ ID NO: 12009 - protein, 7 aa, Artificial Sequence
  Description of Artificial Sequence: Synthetic peptide
QGLTDKN

SEQ ID NO: 12010 - protein, 7 aa, Artificial Sequence
  Description of Artificial Sequence: Synthetic peptide
GLNNTTT

SEQ ID NO: 12011 - protein, 7 aa, Artificial Sequence
  Description of Artificial Sequence: Synthetic peptide
VSDKNLP

SEQ ID NO: 12012 - protein, 7 aa, Artificial Sequence
  Description of Artificial Sequence: Synthetic peptide
SSGGDSR

SEQ ID NO: 12013 - protein, 7 aa, Artificial Sequence
  Description of Artificial Sequence: Synthetic peptide
NGASNAR

SEQ ID NO: 12014 - protein, 7 aa, Artificial Sequence
  Description of Artificial Sequence: Synthetic peptide
SGVPSMN

SEQ ID NO: 12015 - protein, 7 aa, Artificial Sequence
  Description of Artificial Sequence: Synthetic peptide
APAVSSG

SEQ ID NO: 12016 - protein, 7 aa, Artificial Sequence
  Description of Artificial Sequence: Synthetic peptide
KAAGPNG

SEQ ID NO: 12017 - protein, 7 aa, Artificial Sequence
  Description of Artificial Sequence: Synthetic peptide
KTSGGTE

SEQ ID NO: 12018 - protein, 7 aa, Artificial Sequence
  Description of Artificial Sequence: Synthetic peptide
SANSSNT

SEQ ID NO: 12019 - protein, 7 aa, Artificial Sequence
  Description of Artificial Sequence: Synthetic peptide
SGSTQAP

SEQ ID NO: 12020 - protein, 7 aa, Artificial Sequence
  Description of Artificial Sequence: Synthetic peptide
HAGSSSA

SEQ ID NO: 12021 - protein, 7 aa, Artificial Sequence
  Description of Artificial Sequence: Synthetic peptide
QEKTGTS

SEQ ID NO: 12022 - protein, 7 aa, Artificial Sequence
  Description of Artificial Sequence: Synthetic peptide
QGSSTGV

SEQ ID NO: 12023 - protein, 7 aa, Artificial Sequence
  Description of Artificial Sequence: Synthetic peptide
GLEGNSK

SEQ ID NO: 12024 - protein, 7 aa, Artificial Sequence
  Description of Artificial Sequence: Synthetic peptide
GTPERAN

SEQ ID NO: 12025 - protein, 7 aa, Artificial Sequence
  Description of Artificial Sequence: Synthetic peptide
GVTNKSF

SEQ ID NO: 12026 - protein, 7 aa, Artificial Sequence
  Description of Artificial Sequence: Synthetic peptide
VSDKPLM

SEQ ID NO: 12027 - protein, 7 aa, Artificial Sequence
  Description of Artificial Sequence: Synthetic peptide
VQAPTLG

SEQ ID NO: 12028 - protein, 7 aa, Artificial Sequence
  Description of Artificial Sequence: Synthetic peptide
DSKTPTV

SEQ ID NO: 12029 - protein, 7 aa, Artificial Sequence
  Description of Artificial Sequence: Synthetic peptide
GNSTAIK

SEQ ID NO: 12030 - protein, 7 aa, Artificial Sequence
  Description of Artificial Sequence: Synthetic peptide
TKETQTI

SEQ ID NO: 12031 - protein, 7 aa, Artificial Sequence
  Description of Artificial Sequence: Synthetic peptide
LQRGTQG

SEQ ID NO: 12032 - protein, 7 aa, Artificial Sequence
  Description of Artificial Sequence: Synthetic peptide
LSGSGSS

SEQ ID NO: 12033 - protein, 7 aa, Artificial Sequence
  Description of Artificial Sequence: Synthetic peptide
GSSNKTL

SEQ ID NO: 12034 - protein, 7 aa, Artificial Sequence
  Description of Artificial Sequence: Synthetic peptide
DTDARAH

SEQ ID NO: 12035 - protein, 7 aa, Artificial Sequence
  Description of Artificial Sequence: Synthetic peptide
SKIRSSE

SEQ ID NO: 12036 - protein, 7 aa, Artificial Sequence
  Description of Artificial Sequence: Synthetic peptide
GMTSKPI

SEQ ID NO: 12037 - protein, 7 aa, Artificial Sequence
  Description of Artificial Sequence: Synthetic peptide
VLSSNNS

SEQ ID NO: 12038 - protein, 7 aa, Artificial Sequence
  Description of Artificial Sequence: Synthetic peptide
SASKGSQ

SEQ ID NO: 12039 - protein, 7 aa, Artificial Sequence
  Description of Artificial Sequence: Synthetic peptide
NTSSKSQ

SEQ ID NO: 12040 - protein, 7 aa, Artificial Sequence
  Description of Artificial Sequence: Synthetic peptide
STPSSKT

SEQ ID NO: 12041 - protein, 7 aa, Artificial Sequence
  Description of Artificial Sequence: Synthetic peptide
SLGSKGT

SEQ ID NO: 12042 - protein, 7 aa, Artificial Sequence
  Description of Artificial Sequence: Synthetic peptide
SVSSSVG

SEQ ID NO: 12043 - protein, 7 aa, Artificial Sequence
  Description of Artificial Sequence: Synthetic peptide
DVAGNRL

SEQ ID NO: 12044 - protein, 7 aa, Artificial Sequence
  Description of Artificial Sequence: Synthetic peptide
GGGQSSF

SEQ ID NO: 12045 - protein, 7 aa, Artificial Sequence
  Description of Artificial Sequence: Synthetic peptide
HNTPPSG

SEQ ID NO: 12046 - protein, 7 aa, Artificial Sequence
  Description of Artificial Sequence: Synthetic peptide
LPNSSTT

SEQ ID NO: 12047 - protein, 7 aa, Artificial Sequence
  Description of Artificial Sequence: Synthetic peptide
QGTGKFI

SEQ ID NO: 12048 - protein, 7 aa, Artificial Sequence
  Description of Artificial Sequence: Synthetic peptide
GTTASHG

SEQ ID NO: 12049 - protein, 7 aa, Artificial Sequence
  Description of Artificial Sequence: Synthetic peptide
TVSSNPA

SEQ ID NO: 12050 - protein, 7 aa, Artificial Sequence
  Description of Artificial Sequence: Synthetic peptide
SSDKVRD

SEQ ID NO: 12051 - protein, 7 aa, Artificial Sequence
  Description of Artificial Sequence: Synthetic peptide
IGIGTSH

SEQ ID NO: 12052 - protein, 7 aa, Artificial Sequence
  Description of Artificial Sequence: Synthetic peptide
QPSSTSV

SEQ ID NO: 12053 - protein, 7 aa, Artificial Sequence
  Description of Artificial Sequence: Synthetic peptide
ESASGVS

SEQ ID NO: 12054 - protein, 7 aa, Artificial Sequence
  Description of Artificial Sequence: Synthetic peptide
DMSAHGK

SEQ ID NO: 12055 - protein, 7 aa, Artificial Sequence
  Description of Artificial Sequence: Synthetic peptide
GNGNTMQ

SEQ ID NO: 12056 - protein, 7 aa, Artificial Sequence
  Description of Artificial Sequence: Synthetic peptide
GESNKMT

SEQ ID NO: 12057 - protein, 7 aa, Artificial Sequence
  Description of Artificial Sequence: Synthetic peptide
GSTSARD

SEQ ID NO: 12058 - protein, 7 aa, Artificial Sequence
  Description of Artificial Sequence: Synthetic peptide
VGLKSGG

SEQ ID NO: 12059 - protein, 7 aa, Artificial Sequence
  Description of Artificial Sequence: Synthetic peptide
YGDSVVR

SEQ ID NO: 12060 - protein, 7 aa, Artificial Sequence
  Description of Artificial Sequence: Synthetic peptide
QGSPSHH

SEQ ID NO: 12061 - protein, 7 aa, Artificial Sequence
  Description of Artificial Sequence: Synthetic peptide
NQAAHSA

SEQ ID NO: 12062 - protein, 7 aa, Artificial Sequence
  Description of Artificial Sequence: Synthetic peptide
KSTGSSV

SEQ ID NO: 12063 - protein, 7 aa, Artificial Sequence
  Description of Artificial Sequence: Synthetic peptide
NPQSSSS

SEQ ID NO: 12064 - protein, 7 aa, Artificial Sequence
  Description of Artificial Sequence: Synthetic peptide
TPAQDSR

SEQ ID NO: 12065 - protein, 7 aa, Artificial Sequence
  Description of Artificial Sequence: Synthetic peptide
DKAQHTL

SEQ ID NO: 12066 - protein, 7 aa, Artificial Sequence
  Description of Artificial Sequence: Synthetic peptide
GNTQALG

SEQ ID NO: 12067 - protein, 7 aa, Artificial Sequence
  Description of Artificial Sequence: Synthetic peptide
TSNSPSL

SEQ ID NO: 12068 - protein, 7 aa, Artificial Sequence
  Description of Artificial Sequence: Synthetic peptide
SGIGSGQ

SEQ ID NO: 12069 - protein, 7 aa, Artificial Sequence
  Description of Artificial Sequence: Synthetic peptide
LGTKNGQ

SEQ ID NO: 12070 - protein, 7 aa, Artificial Sequence
  Description of Artificial Sequence: Synthetic peptide
STSGTQH

SEQ ID NO: 12071 - protein, 7 aa, Artificial Sequence
  Description of Artificial Sequence: Synthetic peptide
TTSNSNL

SEQ ID NO: 12072 - protein, 7 aa, Artificial Sequence
  Description of Artificial Sequence: Synthetic peptide
TSQPTHV

SEQ ID NO: 12073 - protein, 7 aa, Artificial Sequence
  Description of Artificial Sequence: Synthetic peptide
QQASGAM

SEQ ID NO: 12074 - protein, 7 aa, Artificial Sequence
  Description of Artificial Sequence: Synthetic peptide
HSKPQVT

SEQ ID NO: 12075 - protein, 7 aa, Artificial Sequence
  Description of Artificial Sequence: Synthetic peptide
NGSSSIS

SEQ ID NO: 12076 - protein, 7 aa, Artificial Sequence
  Description of Artificial Sequence: Synthetic peptide
TSATAAV

SEQ ID NO: 12077 - protein, 7 aa, Artificial Sequence
  Description of Artificial Sequence: Synthetic peptide
TESSKLG

SEQ ID NO: 12078 - protein, 7 aa, Artificial Sequence
  Description of Artificial Sequence: Synthetic peptide
IRETPTH

SEQ ID NO: 12079 - protein, 7 aa, Artificial Sequence
  Description of Artificial Sequence: Synthetic peptide
HGQSSLA

SEQ ID NO: 12080 - protein, 7 aa, Artificial Sequence
  Description of Artificial Sequence: Synthetic peptide
QSTSKAG

SEQ ID NO: 12081 - protein, 7 aa, Artificial Sequence
  Description of Artificial Sequence: Synthetic peptide
DNDQKRA

SEQ ID NO: 12082 - protein, 7 aa, Artificial Sequence
  Description of Artificial Sequence: Synthetic peptide
SSGDKSS

SEQ ID NO: 12083 - protein, 7 aa, Artificial Sequence
  Description of Artificial Sequence: Synthetic peptide
SESKDYT

SEQ ID NO: 12084 - protein, 7 aa, Artificial Sequence
  Description of Artificial Sequence: Synthetic peptide
SISDRNR

SEQ ID NO: 12085 - protein, 7 aa, Artificial Sequence
  Description of Artificial Sequence: Synthetic peptide
HASATPL

SEQ ID NO: 12086 - protein, 7 aa, Artificial Sequence
  Description of Artificial Sequence: Synthetic peptide
ASHGTNT

SEQ ID NO: 12087 - protein, 7 aa, Artificial Sequence
  Description of Artificial Sequence: Synthetic peptide
GQTPSAN

SEQ ID NO: 12088 - protein, 7 aa, Artificial Sequence
  Description of Artificial Sequence: Synthetic peptide
VRTGKEQ

SEQ ID NO: 12089 - protein, 7 aa, Artificial Sequence
  Description of Artificial Sequence: Synthetic peptide
LKDRSST

SEQ ID NO: 12090 - protein, 7 aa, Artificial Sequence
  Description of Artificial Sequence: Synthetic peptide
NARSPSS

SEQ ID NO: 12091 - protein, 7 aa, Artificial Sequence
  Description of Artificial Sequence: Synthetic peptide
KSDGSTG

SEQ ID NO: 12092 - protein, 7 aa, Artificial Sequence
  Description of Artificial Sequence: Synthetic peptide
SKNSSPS

SEQ ID NO: 12093 - protein, 7 aa, Artificial Sequence
  Description of Artificial Sequence: Synthetic peptide
QTEGTLR

SEQ ID NO: 12094 - protein, 7 aa, Artificial Sequence
  Description of Artificial Sequence: Synthetic peptide
RTGTNPS

SEQ ID NO: 12095 - protein, 7 aa, Artificial Sequence
  Description of Artificial Sequence: Synthetic peptide
AGSRSPA

SEQ ID NO: 12096 - protein, 7 aa, Artificial Sequence
  Description of Artificial Sequence: Synthetic peptide
SPQIAEK

SEQ ID NO: 12097 - protein, 7 aa, Artificial Sequence
  Description of Artificial Sequence: Synthetic peptide
KQSTASL

SEQ ID NO: 12098 - protein, 7 aa, Artificial Sequence
  Description of Artificial Sequence: Synthetic peptide
RTDGPVK

SEQ ID NO: 12099 - protein, 7 aa, Artificial Sequence
  Description of Artificial Sequence: Synthetic peptide
HSGSKET

SEQ ID NO: 12100 - protein, 7 aa, Artificial Sequence
  Description of Artificial Sequence: Synthetic peptide
QTSQHTS

SEQ ID NO: 12101 - protein, 7 aa, Artificial Sequence
  Description of Artificial Sequence: Synthetic peptide
DKGAGAP

SEQ ID NO: 12102 - protein, 7 aa, Artificial Sequence
  Description of Artificial Sequence: Synthetic peptide
APDNTSK

SEQ ID NO: 12103 - protein, 7 aa, Artificial Sequence
  Description of Artificial Sequence: Synthetic peptide
STSSPAT

SEQ ID NO: 12104 - protein, 7 aa, Artificial Sequence
  Description of Artificial Sequence: Synthetic peptide
HGSEQPR

SEQ ID NO: 12105 - protein, 7 aa, Artificial Sequence
  Description of Artificial Sequence: Synthetic peptide
HSDAKGK

SEQ ID NO: 12106 - protein, 7 aa, Artificial Sequence
  Description of Artificial Sequence: Synthetic peptide
GDTTPVR

SEQ ID NO: 12107 - protein, 7 aa, Artificial Sequence
  Description of Artificial Sequence: Synthetic peptide
EGQSSRG

SEQ ID NO: 12108 - protein, 7 aa, Artificial Sequence
  Description of Artificial Sequence: Synthetic peptide
DMAKSTK

SEQ ID NO: 12109 - protein, 7 aa, Artificial Sequence
  Description of Artificial Sequence: Synthetic peptide
DGHSSRV

SEQ ID NO: 12110 - protein, 7 aa, Artificial Sequence
  Description of Artificial Sequence: Synthetic peptide
STGVATK

SEQ ID NO: 12111 - protein, 7 aa, Artificial Sequence
  Description of Artificial Sequence: Synthetic peptide
VGGSRSQ

SEQ ID NO: 12112 - protein, 7 aa, Artificial Sequence
  Description of Artificial Sequence: Synthetic peptide
SQASAPR

SEQ ID NO: 12113 - protein, 7 aa, Artificial Sequence
  Description of Artificial Sequence: Synthetic peptide
NTGGDLR

SEQ ID NO: 12114 - protein, 7 aa, Artificial Sequence
  Description of Artificial Sequence: Synthetic peptide
NKVSAPS

SEQ ID NO: 12115 - protein, 7 aa, Artificial Sequence
  Description of Artificial Sequence: Synthetic peptide
NATVTPR

SEQ ID NO: 12116 - protein, 7 aa, Artificial Sequence
  Description of Artificial Sequence: Synthetic peptide
TQAGPKE

SEQ ID NO: 12117 - protein, 7 aa, Artificial Sequence
  Description of Artificial Sequence: Synthetic peptide
TKEGSIV

SEQ ID NO: 12118 - protein, 7 aa, Artificial Sequence
  Description of Artificial Sequence: Synthetic peptide
TGSPTSG

SEQ ID NO: 12119 - protein, 7 aa, Artificial Sequence
  Description of Artificial Sequence: Synthetic peptide
SETKGHP

SEQ ID NO: 12120 - protein, 7 aa, Artificial Sequence
  Description of Artificial Sequence: Synthetic peptide
SGPGSQV

SEQ ID NO: 12121 - protein, 7 aa, Artificial Sequence
  Description of Artificial Sequence: Synthetic peptide
SVTSATQ

SEQ ID NO: 12122 - protein, 7 aa, Artificial Sequence
  Description of Artificial Sequence: Synthetic peptide
ERTSGSY

SEQ ID NO: 12123 - protein, 7 aa, Artificial Sequence
  Description of Artificial Sequence: Synthetic peptide
DTLKDRF

SEQ ID NO: 12124 - protein, 7 aa, Artificial Sequence
  Description of Artificial Sequence: Synthetic peptide
DRAGSHT

SEQ ID NO: 12125 - protein, 7 aa, Artificial Sequence
  Description of Artificial Sequence: Synthetic peptide
EQGQNRI

SEQ ID NO: 12126 - protein, 7 aa, Artificial Sequence
  Description of Artificial Sequence: Synthetic peptide
ASGSTST

SEQ ID NO: 12127 - protein, 7 aa, Artificial Sequence
  Description of Artificial Sequence: Synthetic peptide
GHTAEVG

SEQ ID NO: 12128 - protein, 7 aa, Artificial Sequence
  Description of Artificial Sequence: Synthetic peptide
GASDNPR

SEQ ID NO: 12129 - protein, 7 aa, Artificial Sequence
  Description of Artificial Sequence: Synthetic peptide
VSTAKLA

SEQ ID NO: 12130 - protein, 7 aa, Artificial Sequence
  Description of Artificial Sequence: Synthetic peptide
SLNGASG

SEQ ID NO: 12131 - protein, 7 aa, Artificial Sequence
  Description of Artificial Sequence: Synthetic peptide
SSEMGSK

SEQ ID NO: 12132 - protein, 7 aa, Artificial Sequence
  Description of Artificial Sequence: Synthetic peptide
SDAQASS

SEQ ID NO: 12133 - protein, 7 aa, Artificial Sequence
  Description of Artificial Sequence: Synthetic peptide
CSGSSPG

SEQ ID NO: 12134 - protein, 7 aa, Artificial Sequence
  Description of Artificial Sequence: Synthetic peptide
NRGENSV

SEQ ID NO: 12135 - protein, 7 aa, Artificial Sequence
  Description of Artificial Sequence: Synthetic peptide
GGKSNAG

SEQ ID NO: 12136 - protein, 7 aa, Artificial Sequence
  Description of Artificial Sequence: Synthetic peptide
SNSTKSG

SEQ ID NO: 12137 - protein, 7 aa, Artificial Sequence
  Description of Artificial Sequence: Synthetic peptide
NTSGSKA

SEQ ID NO: 12138 - protein, 7 aa, Artificial Sequence
  Description of Artificial Sequence: Synthetic peptide
TVSQTPI

SEQ ID NO: 12139 - protein, 7 aa, Artificial Sequence
  Description of Artificial Sequence: Synthetic peptide
TGLNGVG

SEQ ID NO: 12140 - protein, 7 aa, Artificial Sequence
  Description of Artificial Sequence: Synthetic peptide
SSQGSGS

SEQ ID NO: 12141 - protein, 7 aa, Artificial Sequence
  Description of Artificial Sequence: Synthetic peptide
DRVKDVK

SEQ ID NO: 12142 - protein, 7 aa, Artificial Sequence
  Description of Artificial Sequence: Synthetic peptide
AETRAAS

SEQ ID NO: 12143 - protein, 7 aa, Artificial Sequence
  Description of Artificial Sequence: Synthetic peptide
GHGQSMH

SEQ ID NO: 12144 - protein, 7 aa, Artificial Sequence
  Description of Artificial Sequence: Synthetic peptide
TSSERPP

SEQ ID NO: 12145 - protein, 7 aa, Artificial Sequence
  Description of Artificial Sequence: Synthetic peptide
LRTTKES

SEQ ID NO: 12146 - protein, 7 aa, Artificial Sequence
  Description of Artificial Sequence: Synthetic peptide
TTEKNMH

SEQ ID NO: 12147 - protein, 7 aa, Artificial Sequence
  Description of Artificial Sequence: Synthetic peptide
TPSTHVT

SEQ ID NO: 12148 - protein, 7 aa, Artificial Sequence
  Description of Artificial Sequence: Synthetic peptide
GHSPPGG

SEQ ID NO: 12149 - protein, 7 aa, Artificial Sequence
  Description of Artificial Sequence: Synthetic peptide
GASPVNS

SEQ ID NO: 12150 - protein, 7 aa, Artificial Sequence
  Description of Artificial Sequence: Synthetic peptide
VQGQKME

SEQ ID NO: 12151 - protein, 7 aa, Artificial Sequence
  Description of Artificial Sequence: Synthetic peptide
VKNSSTH

SEQ ID NO: 12152 - protein, 7 aa, Artificial Sequence
  Description of Artificial Sequence: Synthetic peptide
HEDPRTK

SEQ ID NO: 12153 - protein, 7 aa, Artificial Sequence
  Description of Artificial Sequence: Synthetic peptide
MTGKTTT

SEQ ID NO: 12154 - protein, 7 aa, Artificial Sequence
  Description of Artificial Sequence: Synthetic peptide
HTDNAKG

SEQ ID NO: 12155 - protein, 7 aa, Artificial Sequence
  Description of Artificial Sequence: Synthetic peptide
EGINRNT

SEQ ID NO: 12156 - protein, 7 aa, Artificial Sequence
  Description of Artificial Sequence: Synthetic peptide
AGDAHKS

SEQ ID NO: 12157 - protein, 7 aa, Artificial Sequence
  Description of Artificial Sequence: Synthetic peptide
YGDRNNL

SEQ ID NO: 12158 - protein, 7 aa, Artificial Sequence
  Description of Artificial Sequence: Synthetic peptide
SDGSHHG

SEQ ID NO: 12159 - protein, 7 aa, Artificial Sequence
  Description of Artificial Sequence: Synthetic peptide
SSAAVPT

SEQ ID NO: 12160 - protein, 7 aa, Artificial Sequence
  Description of Artificial Sequence: Synthetic peptide
GPANSAT

SEQ ID NO: 12161 - protein, 7 aa, Artificial Sequence
  Description of Artificial Sequence: Synthetic peptide
NGSQTGQ

SEQ ID NO: 12162 - protein, 7 aa, Artificial Sequence
  Description of Artificial Sequence: Synthetic peptide
TKGESMN

SEQ ID NO: 12163 - protein, 7 aa, Artificial Sequence
  Description of Artificial Sequence: Synthetic peptide
HTTGSRD

SEQ ID NO: 12164 - protein, 7 aa, Artificial Sequence
  Description of Artificial Sequence: Synthetic peptide
LPRPDST

SEQ ID NO: 12165 - protein, 7 aa, Artificial Sequence
  Description of Artificial Sequence: Synthetic peptide
GNLNGSP

SEQ ID NO: 12166 - protein, 7 aa, Artificial Sequence
  Description of Artificial Sequence: Synthetic peptide
GDHDRKM

SEQ ID NO: 12167 - protein, 7 aa, Artificial Sequence
  Description of Artificial Sequence: Synthetic peptide
TTQSSAL

SEQ ID NO: 12168 - protein, 7 aa, Artificial Sequence
  Description of Artificial Sequence: Synthetic peptide
LAQTQPQ

SEQ ID NO: 12169 - protein, 7 aa, Artificial Sequence
  Description of Artificial Sequence: Synthetic peptide
LATSSQS

SEQ ID NO: 12170 - protein, 7 aa, Artificial Sequence
  Description of Artificial Sequence: Synthetic peptide
TTTQPVL

SEQ ID NO: 12171 - protein, 7 aa, Artificial Sequence
  Description of Artificial Sequence: Synthetic peptide
SGIPSGH

SEQ ID NO: 12172 - protein, 7 aa, Artificial Sequence
  Description of Artificial Sequence: Synthetic peptide
QSAGSRQ

SEQ ID NO: 12173 - protein, 7 aa, Artificial Sequence
  Description of Artificial Sequence: Synthetic peptide
DRVGSSA

SEQ ID NO: 12174 - protein, 7 aa, Artificial Sequence
  Description of Artificial Sequence: Synthetic peptide
AIGKDNT

SEQ ID NO: 12175 - protein, 7 aa, Artificial Sequence
  Description of Artificial Sequence: Synthetic peptide
GSEKKLP

SEQ ID NO: 12176 - protein, 7 aa, Artificial Sequence
  Description of Artificial Sequence: Synthetic peptide
VQGGNNS

SEQ ID NO: 12177 - protein, 7 aa, Artificial Sequence
  Description of Artificial Sequence: Synthetic peptide
TSKDSTT

SEQ ID NO: 12178 - protein, 7 aa, Artificial Sequence
  Description of Artificial Sequence: Synthetic peptide
ASVPASS

SEQ ID NO: 12179 - protein, 7 aa, Artificial Sequence
  Description of Artificial Sequence: Synthetic peptide
ESARSAP

SEQ ID NO: 12180 - protein, 7 aa, Artificial Sequence
  Description of Artificial Sequence: Synthetic peptide
MGQSTPS

SEQ ID NO: 12181 - protein, 7 aa, Artificial Sequence
  Description of Artificial Sequence: Synthetic peptide
GTAKSIS

SEQ ID NO: 12182 - protein, 7 aa, Artificial Sequence
  Description of Artificial Sequence: Synthetic peptide
SPDSKIH

SEQ ID NO: 12183 - protein, 7 aa, Artificial Sequence
  Description of Artificial Sequence: Synthetic peptide
HNNTTSQ

SEQ ID NO: 12184 - protein, 7 aa, Artificial Sequence
  Description of Artificial Sequence: Synthetic peptide
HPQTSPV

SEQ ID NO: 12185 - protein, 7 aa, Artificial Sequence
  Description of Artificial Sequence: Synthetic peptide
ETTKGSA

SEQ ID NO: 12186 - protein, 7 aa, Artificial Sequence
  Description of Artificial Sequence: Synthetic peptide
ESPQKAS

SEQ ID NO: 12187 - protein, 7 aa, Artificial Sequence
  Description of Artificial Sequence: Synthetic peptide
GDVSQRN

SEQ ID NO: 12188 - protein, 7 aa, Artificial Sequence
  Description of Artificial Sequence: Synthetic peptide
HASTPAR

SEQ ID NO: 12189 - protein, 7 aa, Artificial Sequence
  Description of Artificial Sequence: Synthetic peptide
DSGTHAV

SEQ ID NO: 12190 - protein, 7 aa, Artificial Sequence
  Description of Artificial Sequence: Synthetic peptide
VSGTPPA

SEQ ID NO: 12191 - protein, 7 aa, Artificial Sequence
  Description of Artificial Sequence: Synthetic peptide
SRGEAVS

SEQ ID NO: 12192 - protein, 7 aa, Artificial Sequence
  Description of Artificial Sequence: Synthetic peptide
SGAEVKQ

SEQ ID NO: 12193 - protein, 7 aa, Artificial Sequence
  Description of Artificial Sequence: Synthetic peptide
SQSGVNN

SEQ ID NO: 12194 - protein, 7 aa, Artificial Sequence
  Description of Artificial Sequence: Synthetic peptide
MGNTSLS

SEQ ID NO: 12195 - protein, 7 aa, Artificial Sequence
  Description of Artificial Sequence: Synthetic peptide
RETAKGD

SEQ ID NO: 12196 - protein, 7 aa, Artificial Sequence
  Description of Artificial Sequence: Synthetic peptide
LNASAPP

SEQ ID NO: 12197 - protein, 7 aa, Artificial Sequence
  Description of Artificial Sequence: Synthetic peptide
LRGNSNG

SEQ ID NO: 12198 - protein, 7 aa, Artificial Sequence
  Description of Artificial Sequence: Synthetic peptide
ERTAEVK

SEQ ID NO: 12199 - protein, 7 aa, Artificial Sequence
  Description of Artificial Sequence: Synthetic peptide
SSNRSNA

SEQ ID NO: 12200 - protein, 7 aa, Artificial Sequence
  Description of Artificial Sequence: Synthetic peptide
SSVPSPK

SEQ ID NO: 12201 - protein, 7 aa, Artificial Sequence
  Description of Artificial Sequence: Synthetic peptide
LTDQKGF

SEQ ID NO: 12202 - protein, 7 aa, Artificial Sequence
  Description of Artificial Sequence: Synthetic peptide
QVSDPKT

SEQ ID NO: 12203 - protein, 7 aa, Artificial Sequence
  Description of Artificial Sequence: Synthetic peptide
LTVGTHP

SEQ ID NO: 12204 - protein, 7 aa, Artificial Sequence
  Description of Artificial Sequence: Synthetic peptide
DRDKANT

SEQ ID NO: 12205 - protein, 7 aa, Artificial Sequence
  Description of Artificial Sequence: Synthetic peptide
SSGVASV

SEQ ID NO: 12206 - protein, 7 aa, Artificial Sequence
  Description of Artificial Sequence: Synthetic peptide
NTHGDKG

SEQ ID NO: 12207 - protein, 7 aa, Artificial Sequence
  Description of Artificial Sequence: Synthetic peptide
TTLQRPE

SEQ ID NO: 12208 - protein, 7 aa, Artificial Sequence
  Description of Artificial Sequence: Synthetic peptide
SQNLASG

SEQ ID NO: 12209 - protein, 7 aa, Artificial Sequence
  Description of Artificial Sequence: Synthetic peptide
STGSQNQ

SEQ ID NO: 12210 - protein, 7 aa, Artificial Sequence
  Description of Artificial Sequence: Synthetic peptide
IAGNVPT

SEQ ID NO: 12211 - protein, 7 aa, Artificial Sequence
  Description of Artificial Sequence: Synthetic peptide
MDSAQIK

SEQ ID NO: 12212 - protein, 7 aa, Artificial Sequence
  Description of Artificial Sequence: Synthetic peptide
ESGGKHP

SEQ ID NO: 12213 - protein, 7 aa, Artificial Sequence
  Description of Artificial Sequence: Synthetic peptide
ATTTQNH

SEQ ID NO: 12214 - protein, 7 aa, Artificial Sequence
  Description of Artificial Sequence: Synthetic peptide
GPSREGT

SEQ ID NO: 12215 - protein, 7 aa, Artificial Sequence
  Description of Artificial Sequence: Synthetic peptide
GGIPKKG

SEQ ID NO: 12216 - protein, 7 aa, Artificial Sequence
  Description of Artificial Sequence: Synthetic peptide
LPERSAS

SEQ ID NO: 12217 - protein, 7 aa, Artificial Sequence
  Description of Artificial Sequence: Synthetic peptide
DKVPSGT

SEQ ID NO: 12218 - protein, 7 aa, Artificial Sequence
  Description of Artificial Sequence: Synthetic peptide
NSSGTQI

SEQ ID NO: 12219 - protein, 7 aa, Artificial Sequence
  Description of Artificial Sequence: Synthetic peptide
KVGSNSG

SEQ ID NO: 12220 - protein, 7 aa, Artificial Sequence
  Description of Artificial Sequence: Synthetic peptide
NRTDRSL

SEQ ID NO: 12221 - protein, 7 aa, Artificial Sequence
  Description of Artificial Sequence: Synthetic peptide
TMDARSG

SEQ ID NO: 12222 - protein, 7 aa, Artificial Sequence
  Description of Artificial Sequence: Synthetic peptide
TTGDSRS

SEQ ID NO: 12223 - protein, 7 aa, Artificial Sequence
  Description of Artificial Sequence: Synthetic peptide
GSHGTAT

SEQ ID NO: 12224 - protein, 7 aa, Artificial Sequence
  Description of Artificial Sequence: Synthetic peptide
TTNESRA

SEQ ID NO: 12225 - protein, 7 aa, Artificial Sequence
  Description of Artificial Sequence: Synthetic peptide
TIDNVPK

SEQ ID NO: 12226 - protein, 7 aa, Artificial Sequence
  Description of Artificial Sequence: Synthetic peptide
LVGDKGN

SEQ ID NO: 12227 - protein, 7 aa, Artificial Sequence
  Description of Artificial Sequence: Synthetic peptide
SNTKVAV

SEQ ID NO: 12228 - protein, 7 aa, Artificial Sequence
  Description of Artificial Sequence: Synthetic peptide
LSSSSTL

SEQ ID NO: 12229 - protein, 7 aa, Artificial Sequence
  Description of Artificial Sequence: Synthetic peptide
VKTSSNN

SEQ ID NO: 12230 - protein, 7 aa, Artificial Sequence
  Description of Artificial Sequence: Synthetic peptide
HPISQPT

SEQ ID NO: 12231 - protein, 7 aa, Artificial Sequence
  Description of Artificial Sequence: Synthetic peptide
EANGQSR

SEQ ID NO: 12232 - protein, 7 aa, Artificial Sequence
  Description of Artificial Sequence: Synthetic peptide
STMSPTS

SEQ ID NO: 12233 - protein, 7 aa, Artificial Sequence
  Description of Artificial Sequence: Synthetic peptide
TGLNSPV

SEQ ID NO: 12234 - protein, 7 aa, Artificial Sequence
  Description of Artificial Sequence: Synthetic peptide
GNNSPVA

SEQ ID NO: 12235 - protein, 7 aa, Artificial Sequence
  Description of Artificial Sequence: Synthetic peptide
KEGSRSV

SEQ ID NO: 12236 - protein, 7 aa, Artificial Sequence
  Description of Artificial Sequence: Synthetic peptide
KRESSTL

SEQ ID NO: 12237 - protein, 7 aa, Artificial Sequence
  Description of Artificial Sequence: Synthetic peptide
NQTSSKS

SEQ ID NO: 12238 - protein, 7 aa, Artificial Sequence
  Description of Artificial Sequence: Synthetic peptide
NDSSRVT

SEQ ID NO: 12239 - protein, 7 aa, Artificial Sequence
  Description of Artificial Sequence: Synthetic peptide
TRTETTQ

SEQ ID NO: 12240 - protein, 7 aa, Artificial Sequence
  Description of Artificial Sequence: Synthetic peptide
TSNTSPT

SEQ ID NO: 12241 - protein, 7 aa, Artificial Sequence
  Description of Artificial Sequence: Synthetic peptide
SRTSSSG

SEQ ID NO: 12242 - protein, 7 aa, Artificial Sequence
  Description of Artificial Sequence: Synthetic peptide
SPDTHLK

SEQ ID NO: 12243 - protein, 7 aa, Artificial Sequence
  Description of Artificial Sequence: Synthetic peptide
SEIQSKG

SEQ ID NO: 12244 - protein, 7 aa, Artificial Sequence
  Description of Artificial Sequence: Synthetic peptide
MDSKGGP

SEQ ID NO: 12245 - protein, 7 aa, Artificial Sequence
  Description of Artificial Sequence: Synthetic peptide
QSHNGSL

SEQ ID NO: 12246 - protein, 7 aa, Artificial Sequence
  Description of Artificial Sequence: Synthetic peptide
QSGSDKV

SEQ ID NO: 12247 - protein, 7 aa, Artificial Sequence
  Description of Artificial Sequence: Synthetic peptide
QMQVSNQ

SEQ ID NO: 12248 - protein, 7 aa, Artificial Sequence
  Description of Artificial Sequence: Synthetic peptide
HQQKTPT

SEQ ID NO: 12249 - protein, 7 aa, Artificial Sequence
  Description of Artificial Sequence: Synthetic peptide
RVQGNSG

SEQ ID NO: 12250 - protein, 7 aa, Artificial Sequence
  Description of Artificial Sequence: Synthetic peptide
LADNTRG

SEQ ID NO: 12251 - protein, 7 aa, Artificial Sequence
  Description of Artificial Sequence: Synthetic peptide
ESGSNSS

SEQ ID NO: 12252 - protein, 7 aa, Artificial Sequence
  Description of Artificial Sequence: Synthetic peptide
DKGKAAA

SEQ ID NO: 12253 - protein, 7 aa, Artificial Sequence
  Description of Artificial Sequence: Synthetic peptide
ELTKPNE

SEQ ID NO: 12254 - protein, 7 aa, Artificial Sequence
  Description of Artificial Sequence: Synthetic peptide
ASDHPSR

SEQ ID NO: 12255 - protein, 7 aa, Artificial Sequence
  Description of Artificial Sequence: Synthetic peptide
ASGPARS

SEQ ID NO: 12256 - protein, 7 aa, Artificial Sequence
  Description of Artificial Sequence: Synthetic peptide
AQAEHSQ

SEQ ID NO: 12257 - protein, 7 aa, Artificial Sequence
  Description of Artificial Sequence: Synthetic peptide
AEKPGSL

SEQ ID NO: 12258 - protein, 7 aa, Artificial Sequence
  Description of Artificial Sequence: Synthetic peptide
GSTNDAR

SEQ ID NO: 12259 - protein, 7 aa, Artificial Sequence
  Description of Artificial Sequence: Synthetic peptide
VGTSHIQ

SEQ ID NO: 12260 - protein, 7 aa, Artificial Sequence
  Description of Artificial Sequence: Synthetic peptide
YGTSNVG

SEQ ID NO: 12261 - protein, 7 aa, Artificial Sequence
  Description of Artificial Sequence: Synthetic peptide
VTQSPPL

SEQ ID NO: 12262 - protein, 7 aa, Artificial Sequence
  Description of Artificial Sequence: Synthetic peptide
SGSQHVT

SEQ ID NO: 12263 - protein, 7 aa, Artificial Sequence
  Description of Artificial Sequence: Synthetic peptide
TAISKPA

SEQ ID NO: 12264 - protein, 7 aa, Artificial Sequence
  Description of Artificial Sequence: Synthetic peptide
AASANPL

SEQ ID NO: 12265 - protein, 7 aa, Artificial Sequence
  Description of Artificial Sequence: Synthetic peptide
ANASPNV

SEQ ID NO: 12266 - protein, 7 aa, Artificial Sequence
  Description of Artificial Sequence: Synthetic peptide
NVSPSSL

SEQ ID NO: 12267 - protein, 7 aa, Artificial Sequence
  Description of Artificial Sequence: Synthetic peptide
SGGSASA

SEQ ID NO: 12268 - protein, 7 aa, Artificial Sequence
  Description of Artificial Sequence: Synthetic peptide
LPLAQSQ

SEQ ID NO: 12269 - protein, 7 aa, Artificial Sequence
  Description of Artificial Sequence: Synthetic peptide
EASSNPT

SEQ ID NO: 12270 - protein, 7 aa, Artificial Sequence
  Description of Artificial Sequence: Synthetic peptide
GLGGDMK

SEQ ID NO: 12271 - protein, 7 aa, Artificial Sequence
  Description of Artificial Sequence: Synthetic peptide
GHLTGGS

SEQ ID NO: 12272 - protein, 7 aa, Artificial Sequence
  Description of Artificial Sequence: Synthetic peptide
GPSAKSA

SEQ ID NO: 12273 - protein, 7 aa, Artificial Sequence
  Description of Artificial Sequence: Synthetic peptide
SQTNTGT

SEQ ID NO: 12274 - protein, 7 aa, Artificial Sequence
  Description of Artificial Sequence: Synthetic peptide
GVSKANA

SEQ ID NO: 12275 - protein, 7 aa, Artificial Sequence
  Description of Artificial Sequence: Synthetic peptide
KTAPHTT

SEQ ID NO: 12276 - protein, 7 aa, Artificial Sequence
  Description of Artificial Sequence: Synthetic peptide
TPSDHAV

SEQ ID NO: 12277 - protein, 7 aa, Artificial Sequence
  Description of Artificial Sequence: Synthetic peptide
SIASSGS

SEQ ID NO: 12278 - protein, 7 aa, Artificial Sequence
  Description of Artificial Sequence: Synthetic peptide
LGSSAGG

SEQ ID NO: 12279 - protein, 7 aa, Artificial Sequence
  Description of Artificial Sequence: Synthetic peptide
DSRNVSG

SEQ ID NO: 12280 - protein, 7 aa, Artificial Sequence
  Description of Artificial Sequence: Synthetic peptide
DHRSEKS

SEQ ID NO: 12281 - protein, 7 aa, Artificial Sequence
  Description of Artificial Sequence: Synthetic peptide
DVDNQKK

SEQ ID NO: 12282 - protein, 7 aa, Artificial Sequence
  Description of Artificial Sequence: Synthetic peptide
AEGTGRV

SEQ ID NO: 12283 - protein, 7 aa, Artificial Sequence
  Description of Artificial Sequence: Synthetic peptide
MSGQDQK

SEQ ID NO: 12284 - protein, 7 aa, Artificial Sequence
  Description of Artificial Sequence: Synthetic peptide
TTNGSMT

SEQ ID NO: 12285 - protein, 7 aa, Artificial Sequence
  Description of Artificial Sequence: Synthetic peptide
NVKSGSG

SEQ ID NO: 12286 - protein, 7 aa, Artificial Sequence
  Description of Artificial Sequence: Synthetic peptide
AAGAHAS

SEQ ID NO: 12287 - protein, 7 aa, Artificial Sequence
  Description of Artificial Sequence: Synthetic peptide
STNNSNV

SEQ ID NO: 12288 - protein, 7 aa, Artificial Sequence
  Description of Artificial Sequence: Synthetic peptide
HTQSSSG

SEQ ID NO: 12289 - protein, 7 aa, Artificial Sequence
  Description of Artificial Sequence: Synthetic peptide
EGVGPLR

SEQ ID NO: 12290 - protein, 7 aa, Artificial Sequence
  Description of Artificial Sequence: Synthetic peptide
AANGTNG

SEQ ID NO: 12291 - protein, 7 aa, Artificial Sequence
  Description of Artificial Sequence: Synthetic peptide
GSDRTRL

SEQ ID NO: 12292 - protein, 7 aa, Artificial Sequence
  Description of Artificial Sequence: Synthetic peptide
KASGNSS

SEQ ID NO: 12293 - protein, 7 aa, Artificial Sequence
  Description of Artificial Sequence: Synthetic peptide
ERHKVTE

SEQ ID NO: 12294 - protein, 7 aa, Artificial Sequence
  Description of Artificial Sequence: Synthetic peptide
ESGPNGS

SEQ ID NO: 12295 - protein, 7 aa, Artificial Sequence
  Description of Artificial Sequence: Synthetic peptide
NTATQGT

SEQ ID NO: 12296 - protein, 7 aa, Artificial Sequence
  Description of Artificial Sequence: Synthetic peptide
SVNGSNA

SEQ ID NO: 12297 - protein, 7 aa, Artificial Sequence
  Description of Artificial Sequence: Synthetic peptide
AANEAVR

SEQ ID NO: 12298 - protein, 7 aa, Artificial Sequence
  Description of Artificial Sequence: Synthetic peptide
QSNHKNT

SEQ ID NO: 12299 - protein, 7 aa, Artificial Sequence
  Description of Artificial Sequence: Synthetic peptide
SAHTGSS

SEQ ID NO: 12300 - protein, 7 aa, Artificial Sequence
  Description of Artificial Sequence: Synthetic peptide
MGNSQGM

SEQ ID NO: 12301 - protein, 7 aa, Artificial Sequence
  Description of Artificial Sequence: Synthetic peptide
NKETKAT

SEQ ID NO: 12302 - protein, 7 aa, Artificial Sequence
  Description of Artificial Sequence: Synthetic peptide
SHGTSSE

SEQ ID NO: 12303 - protein, 7 aa, Artificial Sequence
  Description of Artificial Sequence: Synthetic peptide
SHGSTSA

SEQ ID NO: 12304 - protein, 7 aa, Artificial Sequence
  Description of Artificial Sequence: Synthetic peptide
SLGQPST

SEQ ID NO: 12305 - protein, 7 aa, Artificial Sequence
  Description of Artificial Sequence: Synthetic peptide
SEASANR

SEQ ID NO: 12306 - protein, 7 aa, Artificial Sequence
  Description of Artificial Sequence: Synthetic peptide
INSDRSA

SEQ ID NO: 12307 - protein, 7 aa, Artificial Sequence
  Description of Artificial Sequence: Synthetic peptide
HPKSQGE

SEQ ID NO: 12308 - protein, 7 aa, Artificial Sequence
  Description of Artificial Sequence: Synthetic peptide
DDHTPRK

SEQ ID NO: 12309 - protein, 7 aa, Artificial Sequence
  Description of Artificial Sequence: Synthetic peptide
DRVVKSD

SEQ ID NO: 12310 - protein, 7 aa, Artificial Sequence
  Description of Artificial Sequence: Synthetic peptide
GRESAVT

SEQ ID NO: 12311 - protein, 7 aa, Artificial Sequence
  Description of Artificial Sequence: Synthetic peptide
GPNSSPQ

SEQ ID NO: 12312 - protein, 7 aa, Artificial Sequence
  Description of Artificial Sequence: Synthetic peptide
NVTKSSG

SEQ ID NO: 12313 - protein, 7 aa, Artificial Sequence
  Description of Artificial Sequence: Synthetic peptide
VQSTNTK

SEQ ID NO: 12314 - protein, 7 aa, Artificial Sequence
  Description of Artificial Sequence: Synthetic peptide
SASGSTT

SEQ ID NO: 12315 - protein, 7 aa, Artificial Sequence
  Description of Artificial Sequence: Synthetic peptide
GVKASMG

SEQ ID NO: 12316 - protein, 7 aa, Artificial Sequence
  Description of Artificial Sequence: Synthetic peptide
STVQKSG

SEQ ID NO: 12317 - protein, 7 aa, Artificial Sequence
  Description of Artificial Sequence: Synthetic peptide
GNNPSSV

SEQ ID NO: 12318 - protein, 7 aa, Artificial Sequence
  Description of Artificial Sequence: Synthetic peptide
QRTSSPE

SEQ ID NO: 12319 - protein, 7 aa, Artificial Sequence
  Description of Artificial Sequence: Synthetic peptide
TSAKSDG

SEQ ID NO: 12320 - protein, 7 aa, Artificial Sequence
  Description of Artificial Sequence: Synthetic peptide
SSAPNGG

SEQ ID NO: 12321 - protein, 7 aa, Artificial Sequence
  Description of Artificial Sequence: Synthetic peptide
LEGSNAK

SEQ ID NO: 12322 - protein, 7 aa, Artificial Sequence
  Description of Artificial Sequence: Synthetic peptide
GFEKERG

SEQ ID NO: 12323 - protein, 7 aa, Artificial Sequence
  Description of Artificial Sequence: Synthetic peptide
STGSALK

SEQ ID NO: 12324 - protein, 7 aa, Artificial Sequence
  Description of Artificial Sequence: Synthetic peptide
KSSEGTN

SEQ ID NO: 12325 - protein, 7 aa, Artificial Sequence
  Description of Artificial Sequence: Synthetic peptide
TGGPTNR

SEQ ID NO: 12326 - protein, 7 aa, Artificial Sequence
  Description of Artificial Sequence: Synthetic peptide
QATTPSQ

SEQ ID NO: 12327 - protein, 7 aa, Artificial Sequence
  Description of Artificial Sequence: Synthetic peptide
LNGASSH

SEQ ID NO: 12328 - protein, 7 aa, Artificial Sequence
  Description of Artificial Sequence: Synthetic peptide
DLTEKRT

SEQ ID NO: 12329 - protein, 7 aa, Artificial Sequence
  Description of Artificial Sequence: Synthetic peptide
NNGSSVS

SEQ ID NO: 12330 - protein, 7 aa, Artificial Sequence
  Description of Artificial Sequence: Synthetic peptide
TSHAPNT

SEQ ID NO: 12331 - protein, 7 aa, Artificial Sequence
  Description of Artificial Sequence: Synthetic peptide
GSAKAVA

SEQ ID NO: 12332 - protein, 7 aa, Artificial Sequence
  Description of Artificial Sequence: Synthetic peptide
SGNKPYT

SEQ ID NO: 12333 - protein, 7 aa, Artificial Sequence
  Description of Artificial Sequence: Synthetic peptide
DKIDKQV

SEQ ID NO: 12334 - protein, 7 aa, Artificial Sequence
  Description of Artificial Sequence: Synthetic peptide
NERSPVH

SEQ ID NO: 12335 - protein, 7 aa, Artificial Sequence
  Description of Artificial Sequence: Synthetic peptide
SNSPQKM

SEQ ID NO: 12336 - protein, 7 aa, Artificial Sequence
  Description of Artificial Sequence: Synthetic peptide
SAMNGTA

SEQ ID NO: 12337 - protein, 7 aa, Artificial Sequence
  Description of Artificial Sequence: Synthetic peptide
LDGHKSS

SEQ ID NO: 12338 - protein, 7 aa, Artificial Sequence
  Description of Artificial Sequence: Synthetic peptide
LDGHGQA

SEQ ID NO: 12339 - protein, 7 aa, Artificial Sequence
  Description of Artificial Sequence: Synthetic peptide
ESLTKSN

SEQ ID NO: 12340 - protein, 7 aa, Artificial Sequence
  Description of Artificial Sequence: Synthetic peptide
AMSSGGG

SEQ ID NO: 12341 - protein, 7 aa, Artificial Sequence
  Description of Artificial Sequence: Synthetic peptide
GNDKQMG

SEQ ID NO: 12342 - protein, 7 aa, Artificial Sequence
  Description of Artificial Sequence: Synthetic peptide
GASNSTR

SEQ ID NO: 12343 - protein, 7 aa, Artificial Sequence
  Description of Artificial Sequence: Synthetic peptide
GQVAGQA

SEQ ID NO: 12344 - protein, 7 aa, Artificial Sequence
  Description of Artificial Sequence: Synthetic peptide
GGTQTPP

SEQ ID NO: 12345 - protein, 7 aa, Artificial Sequence
  Description of Artificial Sequence: Synthetic peptide
GETNSRN

SEQ ID NO: 12346 - protein, 7 aa, Artificial Sequence
  Description of Artificial Sequence: Synthetic peptide
VSTPSAA

SEQ ID NO: 12347 - protein, 7 aa, Artificial Sequence
  Description of Artificial Sequence: Synthetic peptide
VGGSSVA

SEQ ID NO: 12348 - protein, 7 aa, Artificial Sequence
  Description of Artificial Sequence: Synthetic peptide
YGNSTPS

SEQ ID NO: 12349 - protein, 7 aa, Artificial Sequence
  Description of Artificial Sequence: Synthetic peptide
SEAEKTK

SEQ ID NO: 12350 - protein, 7 aa, Artificial Sequence
  Description of Artificial Sequence: Synthetic peptide
CTGNSNN

SEQ ID NO: 12351 - protein, 7 aa, Artificial Sequence
  Description of Artificial Sequence: Synthetic peptide
DATTPRS

SEQ ID NO: 12352 - protein, 7 aa, Artificial Sequence
  Description of Artificial Sequence: Synthetic peptide
QVKDHTL

SEQ ID NO: 12353 - protein, 7 aa, Artificial Sequence
  Description of Artificial Sequence: Synthetic peptide
IGSPNAR

SEQ ID NO: 12354 - protein, 7 aa, Artificial Sequence
  Description of Artificial Sequence: Synthetic peptide
LQGSPHN

SEQ ID NO: 12355 - protein, 7 aa, Artificial Sequence
  Description of Artificial Sequence: Synthetic peptide
GVASSQT

SEQ ID NO: 12356 - protein, 7 aa, Artificial Sequence
  Description of Artificial Sequence: Synthetic peptide
TALSGPK

SEQ ID NO: 12357 - protein, 7 aa, Artificial Sequence
  Description of Artificial Sequence: Synthetic peptide
SGANTNS

SEQ ID NO: 12358 - protein, 7 aa, Artificial Sequence
  Description of Artificial Sequence: Synthetic peptide
DTKEGVG

SEQ ID NO: 12359 - protein, 7 aa, Artificial Sequence
  Description of Artificial Sequence: Synthetic peptide
DTKNHPA

SEQ ID NO: 12360 - protein, 7 aa, Artificial Sequence
  Description of Artificial Sequence: Synthetic peptide
IQNDRSQ

SEQ ID NO: 12361 - protein, 7 aa, Artificial Sequence
  Description of Artificial Sequence: Synthetic peptide
MASPGSK

SEQ ID NO: 12362 - protein, 7 aa, Artificial Sequence
  Description of Artificial Sequence: Synthetic peptide
QRGHDQS

SEQ ID NO: 12363 - protein, 7 aa, Artificial Sequence
  Description of Artificial Sequence: Synthetic peptide
DGGSHIR

SEQ ID NO: 12364 - protein, 7 aa, Artificial Sequence
  Description of Artificial Sequence: Synthetic peptide
EVTPRST

SEQ ID NO: 12365 - protein, 7 aa, Artificial Sequence
  Description of Artificial Sequence: Synthetic peptide
GNNPGST

SEQ ID NO: 12366 - protein, 7 aa, Artificial Sequence
  Description of Artificial Sequence: Synthetic peptide
FGNSAAK

SEQ ID NO: 12367 - protein, 7 aa, Artificial Sequence
  Description of Artificial Sequence: Synthetic peptide
SSVNGNK

SEQ ID NO: 12368 - protein, 7 aa, Artificial Sequence
  Description of Artificial Sequence: Synthetic peptide
QSSPSSR

SEQ ID NO: 12369 - protein, 7 aa, Artificial Sequence
  Description of Artificial Sequence: Synthetic peptide
TQPQKQS

SEQ ID NO: 12370 - protein, 7 aa, Artificial Sequence
  Description of Artificial Sequence: Synthetic peptide
RADKPSL

SEQ ID NO: 12371 - protein, 7 aa, Artificial Sequence
  Description of Artificial Sequence: Synthetic peptide
AQPSHSQ

SEQ ID NO: 12372 - protein, 7 aa, Artificial Sequence
  Description of Artificial Sequence: Synthetic peptide
LTGTHSA

SEQ ID NO: 12373 - protein, 7 aa, Artificial Sequence
  Description of Artificial Sequence: Synthetic peptide
AAVSTPA

SEQ ID NO: 12374 - protein, 7 aa, Artificial Sequence
  Description of Artificial Sequence: Synthetic peptide
TVGDNRS

SEQ ID NO: 12375 - protein, 7 aa, Artificial Sequence
  Description of Artificial Sequence: Synthetic peptide
SDSSKAA

SEQ ID NO: 12376 - protein, 7 aa, Artificial Sequence
  Description of Artificial Sequence: Synthetic peptide
ERGHENG

SEQ ID NO: 12377 - protein, 7 aa, Artificial Sequence
  Description of Artificial Sequence: Synthetic peptide
DNVGVSR

SEQ ID NO: 12378 - protein, 7 aa, Artificial Sequence
  Description of Artificial Sequence: Synthetic peptide
GEGRVTT

SEQ ID NO: 12379 - protein, 7 aa, Artificial Sequence
  Description of Artificial Sequence: Synthetic peptide
SKNTPTA

SEQ ID NO: 12380 - protein, 7 aa, Artificial Sequence
  Description of Artificial Sequence: Synthetic peptide
DSGASKM

SEQ ID NO: 12381 - protein, 7 aa, Artificial Sequence
  Description of Artificial Sequence: Synthetic peptide
GQAKTLT

SEQ ID NO: 12382 - protein, 7 aa, Artificial Sequence
  Description of Artificial Sequence: Synthetic peptide
DSGNTTR

SEQ ID NO: 12383 - protein, 7 aa, Artificial Sequence
  Description of Artificial Sequence: Synthetic peptide
NLSTNKD

SEQ ID NO: 12384 - protein, 7 aa, Artificial Sequence
  Description of Artificial Sequence: Synthetic peptide
NGSSQAN

SEQ ID NO: 12385 - protein, 7 aa, Artificial Sequence
  Description of Artificial Sequence: Synthetic peptide
TMSDRPT

SEQ ID NO: 12386 - protein, 7 aa, Artificial Sequence
  Description of Artificial Sequence: Synthetic peptide
GNNPSAR

SEQ ID NO: 12387 - protein, 7 aa, Artificial Sequence
  Description of Artificial Sequence: Synthetic peptide
VGNPGAG

SEQ ID NO: 12388 - protein, 7 aa, Artificial Sequence
  Description of Artificial Sequence: Synthetic peptide
YRESSSV

SEQ ID NO: 12389 - protein, 7 aa, Artificial Sequence
  Description of Artificial Sequence: Synthetic peptide
TSSGQNC

SEQ ID NO: 12390 - protein, 7 aa, Artificial Sequence
  Description of Artificial Sequence: Synthetic peptide
TPSPNTK

SEQ ID NO: 12391 - protein, 7 aa, Artificial Sequence
  Description of Artificial Sequence: Synthetic peptide
TQRKPTE

SEQ ID NO: 12392 - protein, 7 aa, Artificial Sequence
  Description of Artificial Sequence: Synthetic peptide
SSNSSPR

SEQ ID NO: 12393 - protein, 7 aa, Artificial Sequence
  Description of Artificial Sequence: Synthetic peptide
TSAATYN

SEQ ID NO: 12394 - protein, 7 aa, Artificial Sequence
  Description of Artificial Sequence: Synthetic peptide
LTESKPR

SEQ ID NO: 12395 - protein, 7 aa, Artificial Sequence
  Description of Artificial Sequence: Synthetic peptide
GSLPNGS

SEQ ID NO: 12396 - protein, 7 aa, Artificial Sequence
  Description of Artificial Sequence: Synthetic peptide
TTSDPAR

SEQ ID NO: 12397 - protein, 7 aa, Artificial Sequence
  Description of Artificial Sequence: Synthetic peptide
IPSNSPS

SEQ ID NO: 12398 - protein, 7 aa, Artificial Sequence
  Description of Artificial Sequence: Synthetic peptide
VSSGTTI

SEQ ID NO: 12399 - protein, 7 aa, Artificial Sequence
  Description of Artificial Sequence: Synthetic peptide
NNLGSQS

SEQ ID NO: 12400 - protein, 7 aa, Artificial Sequence
  Description of Artificial Sequence: Synthetic peptide
SDARNPT

SEQ ID NO: 12401 - protein, 7 aa, Artificial Sequence
  Description of Artificial Sequence: Synthetic peptide
LDDSKIR

SEQ ID NO: 12402 - protein, 7 aa, Artificial Sequence
  Description of Artificial Sequence: Synthetic peptide
ATSNQAS

SEQ ID NO: 12403 - protein, 7 aa, Artificial Sequence
  Description of Artificial Sequence: Synthetic peptide
APSQSVK

SEQ ID NO: 12404 - protein, 7 aa, Artificial Sequence
  Description of Artificial Sequence: Synthetic peptide
GRANDQS

SEQ ID NO: 12405 - protein, 7 aa, Artificial Sequence
  Description of Artificial Sequence: Synthetic peptide
GIDANQR

SEQ ID NO: 12406 - protein, 7 aa, Artificial Sequence
  Description of Artificial Sequence: Synthetic peptide
ANTSNAT

SEQ ID NO: 12407 - protein, 7 aa, Artificial Sequence
  Description of Artificial Sequence: Synthetic peptide
DTPPLKN

SEQ ID NO: 12408 - protein, 7 aa, Artificial Sequence
  Description of Artificial Sequence: Synthetic peptide
NPGPAMN

SEQ ID NO: 12409 - protein, 7 aa, Artificial Sequence
  Description of Artificial Sequence: Synthetic peptide
TGTNSLG

SEQ ID NO: 12410 - protein, 7 aa, Artificial Sequence
  Description of Artificial Sequence: Synthetic peptide
SVGTSPP

SEQ ID NO: 12411 - protein, 7 aa, Artificial Sequence
  Description of Artificial Sequence: Synthetic peptide
RHDASAG

SEQ ID NO: 12412 - protein, 7 aa, Artificial Sequence
  Description of Artificial Sequence: Synthetic peptide
TTQPTPS

SEQ ID NO: 12413 - protein, 7 aa, Artificial Sequence
  Description of Artificial Sequence: Synthetic peptide
SGMGSPK

SEQ ID NO: 12414 - protein, 7 aa, Artificial Sequence
  Description of Artificial Sequence: Synthetic peptide
HASEPRT

SEQ ID NO: 12415 - protein, 7 aa, Artificial Sequence
  Description of Artificial Sequence: Synthetic peptide
AGNDRRV

SEQ ID NO: 12416 - protein, 7 aa, Artificial Sequence
  Description of Artificial Sequence: Synthetic peptide
SDVKSEK

SEQ ID NO: 12417 - protein, 7 aa, Artificial Sequence
  Description of Artificial Sequence: Synthetic peptide
ESRVSQA

SEQ ID NO: 12418 - protein, 7 aa, Artificial Sequence
  Description of Artificial Sequence: Synthetic peptide
TTVNQSG

SEQ ID NO: 12419 - protein, 7 aa, Artificial Sequence
  Description of Artificial Sequence: Synthetic peptide
SHAERPS

SEQ ID NO: 12420 - protein, 7 aa, Artificial Sequence
  Description of Artificial Sequence: Synthetic peptide
SGAQGMH

SEQ ID NO: 12421 - protein, 7 aa, Artificial Sequence
  Description of Artificial Sequence: Synthetic peptide
SMSVKTE

SEQ ID NO: 12422 - protein, 7 aa, Artificial Sequence
  Description of Artificial Sequence: Synthetic peptide
QIEGRGA

SEQ ID NO: 12423 - protein, 7 aa, Artificial Sequence
  Description of Artificial Sequence: Synthetic peptide
DQQGHEK

SEQ ID NO: 12424 - protein, 7 aa, Artificial Sequence
  Description of Artificial Sequence: Synthetic peptide
GRANTPT

SEQ ID NO: 12425 - protein, 7 aa, Artificial Sequence
  Description of Artificial Sequence: Synthetic peptide
VNSQSAQ

SEQ ID NO: 12426 - protein, 7 aa, Artificial Sequence
  Description of Artificial Sequence: Synthetic peptide
CPPGEKS

SEQ ID NO: 12427 - protein, 7 aa, Artificial Sequence
  Description of Artificial Sequence: Synthetic peptide
NPSSHST

SEQ ID NO: 12428 - protein, 7 aa, Artificial Sequence
  Description of Artificial Sequence: Synthetic peptide
SNSAGSL

SEQ ID NO: 12429 - protein, 7 aa, Artificial Sequence
  Description of Artificial Sequence: Synthetic peptide
QGSRDPA

SEQ ID NO: 12430 - protein, 7 aa, Artificial Sequence
  Description of Artificial Sequence: Synthetic peptide
ERGDSAY

SEQ ID NO: 12431 - protein, 7 aa, Artificial Sequence
  Description of Artificial Sequence: Synthetic peptide
ANTMTTK

SEQ ID NO: 12432 - protein, 7 aa, Artificial Sequence
  Description of Artificial Sequence: Synthetic peptide
LGTNKDQ

SEQ ID NO: 12433 - protein, 7 aa, Artificial Sequence
  Description of Artificial Sequence: Synthetic peptide
SGQPTVL

SEQ ID NO: 12434 - protein, 7 aa, Artificial Sequence
  Description of Artificial Sequence: Synthetic peptide
TTASRGL

SEQ ID NO: 12435 - protein, 7 aa, Artificial Sequence
  Description of Artificial Sequence: Synthetic peptide
HNGSHTI

SEQ ID NO: 12436 - protein, 7 aa, Artificial Sequence
  Description of Artificial Sequence: Synthetic peptide
ANGATVA

SEQ ID NO: 12437 - protein, 7 aa, Artificial Sequence
  Description of Artificial Sequence: Synthetic peptide
GAKTGSV

SEQ ID NO: 12438 - protein, 7 aa, Artificial Sequence
  Description of Artificial Sequence: Synthetic peptide
SGSTSPR

SEQ ID NO: 12439 - protein, 7 aa, Artificial Sequence
  Description of Artificial Sequence: Synthetic peptide
ASQPNGI

SEQ ID NO: 12440 - protein, 7 aa, Artificial Sequence
  Description of Artificial Sequence: Synthetic peptide
GNTRTPP

SEQ ID NO: 12441 - protein, 7 aa, Artificial Sequence
  Description of Artificial Sequence: Synthetic peptide
GHNGSKV

SEQ ID NO: 12442 - protein, 7 aa, Artificial Sequence
  Description of Artificial Sequence: Synthetic peptide
YGDKSGA

SEQ ID NO: 12443 - protein, 7 aa, Artificial Sequence
  Description of Artificial Sequence: Synthetic peptide
NGQPSAL

SEQ ID NO: 12444 - protein, 7 aa, Artificial Sequence
  Description of Artificial Sequence: Synthetic peptide
NGRSTSS

SEQ ID NO: 12445 - protein, 7 aa, Artificial Sequence
  Description of Artificial Sequence: Synthetic peptide
NGSGGPS

SEQ ID NO: 12446 - protein, 7 aa, Artificial Sequence
  Description of Artificial Sequence: Synthetic peptide
NGHSSTQ

SEQ ID NO: 12447 - protein, 7 aa, Artificial Sequence
  Description of Artificial Sequence: Synthetic peptide
NNQASNK

SEQ ID NO: 12448 - protein, 7 aa, Artificial Sequence
  Description of Artificial Sequence: Synthetic peptide
NNDKNQQ

SEQ ID NO: 12449 - protein, 7 aa, Artificial Sequence
  Description of Artificial Sequence: Synthetic peptide
NTARSSA

SEQ ID NO: 12450 - protein, 7 aa, Artificial Sequence
  Description of Artificial Sequence: Synthetic peptide
TGASTGS

SEQ ID NO: 12451 - protein, 7 aa, Artificial Sequence
  Description of Artificial Sequence: Synthetic peptide
TVGATPI

SEQ ID NO: 12452 - protein, 7 aa, Artificial Sequence
  Description of Artificial Sequence: Synthetic peptide
TKAKGDH

SEQ ID NO: 12453 - protein, 7 aa, Artificial Sequence
  Description of Artificial Sequence: Synthetic peptide
TGTDKPG

SEQ ID NO: 12454 - protein, 7 aa, Artificial Sequence
  Description of Artificial Sequence: Synthetic peptide
STSPDSK

SEQ ID NO: 12455 - protein, 7 aa, Artificial Sequence
  Description of Artificial Sequence: Synthetic peptide
SQSSGHL

SEQ ID NO: 12456 - protein, 7 aa, Artificial Sequence
  Description of Artificial Sequence: Synthetic peptide
SPQSAIK

SEQ ID NO: 12457 - protein, 7 aa, Artificial Sequence
  Description of Artificial Sequence: Synthetic peptide
SDSPKLG

SEQ ID NO: 12458 - protein, 7 aa, Artificial Sequence
  Description of Artificial Sequence: Synthetic peptide
SGVANTA

SEQ ID NO: 12459 - protein, 7 aa, Artificial Sequence
  Description of Artificial Sequence: Synthetic peptide
SGVSAQN

SEQ ID NO: 12460 - protein, 7 aa, Artificial Sequence
  Description of Artificial Sequence: Synthetic peptide
IPNKSGG

SEQ ID NO: 12461 - protein, 7 aa, Artificial Sequence
  Description of Artificial Sequence: Synthetic peptide
IARDAQQ

SEQ ID NO: 12462 - protein, 7 aa, Artificial Sequence
  Description of Artificial Sequence: Synthetic peptide
QREDHSK

SEQ ID NO: 12463 - protein, 7 aa, Artificial Sequence
  Description of Artificial Sequence: Synthetic peptide
HTAQTPG

SEQ ID NO: 12464 - protein, 7 aa, Artificial Sequence
  Description of Artificial Sequence: Synthetic peptide
LGHNKSA

SEQ ID NO: 12465 - protein, 7 aa, Artificial Sequence
  Description of Artificial Sequence: Synthetic peptide
ESRSSVL

SEQ ID NO: 12466 - protein, 7 aa, Artificial Sequence
  Description of Artificial Sequence: Synthetic peptide
DNQPSSN

SEQ ID NO: 12467 - protein, 7 aa, Artificial Sequence
  Description of Artificial Sequence: Synthetic peptide
DHRETSK

SEQ ID NO: 12468 - protein, 7 aa, Artificial Sequence
  Description of Artificial Sequence: Synthetic peptide
EVPKTPS

SEQ ID NO: 12469 - protein, 7 aa, Artificial Sequence
  Description of Artificial Sequence: Synthetic peptide
DPKGSQG

SEQ ID NO: 12470 - protein, 7 aa, Artificial Sequence
  Description of Artificial Sequence: Synthetic peptide
DGRGSSL

SEQ ID NO: 12471 - protein, 7 aa, Artificial Sequence
  Description of Artificial Sequence: Synthetic peptide
AGPRDLQ

SEQ ID NO: 12472 - protein, 7 aa, Artificial Sequence
  Description of Artificial Sequence: Synthetic peptide
ASSSSPG

SEQ ID NO: 12473 - protein, 7 aa, Artificial Sequence
  Description of Artificial Sequence: Synthetic peptide
GNTGTPP

SEQ ID NO: 12474 - protein, 7 aa, Artificial Sequence
  Description of Artificial Sequence: Synthetic peptide
GSQKTVG

SEQ ID NO: 12475 - protein, 7 aa, Artificial Sequence
  Description of Artificial Sequence: Synthetic peptide
GVSSQPQ

SEQ ID NO: 12476 - protein, 7 aa, Artificial Sequence
  Description of Artificial Sequence: Synthetic peptide
GQGSSVV

SEQ ID NO: 12477 - protein, 7 aa, Artificial Sequence
  Description of Artificial Sequence: Synthetic peptide
VNSTPVK

SEQ ID NO: 12478 - protein, 7 aa, Artificial Sequence
  Description of Artificial Sequence: Synthetic peptide
VSNTQGQ

SEQ ID NO: 12479 - protein, 7 aa, Artificial Sequence
  Description of Artificial Sequence: Synthetic peptide
VGHPTAM

SEQ ID NO: 12480 - protein, 7 aa, Artificial Sequence
  Description of Artificial Sequence: Synthetic peptide
SMNQSSK

SEQ ID NO: 12481 - protein, 7 aa, Artificial Sequence
  Description of Artificial Sequence: Synthetic peptide
STLAGVN

SEQ ID NO: 12482 - protein, 7 aa, Artificial Sequence
  Description of Artificial Sequence: Synthetic peptide
SSQADIR

SEQ ID NO: 12483 - protein, 7 aa, Artificial Sequence
  Description of Artificial Sequence: Synthetic peptide
NSVGSMM

SEQ ID NO: 12484 - protein, 7 aa, Artificial Sequence
  Description of Artificial Sequence: Synthetic peptide
RTDRGSG

SEQ ID NO: 12485 - protein, 7 aa, Artificial Sequence
  Description of Artificial Sequence: Synthetic peptide
LGGQHPS

SEQ ID NO: 12486 - protein, 7 aa, Artificial Sequence
  Description of Artificial Sequence: Synthetic peptide
QGNGSVV

SEQ ID NO: 12487 - protein, 7 aa, Artificial Sequence
  Description of Artificial Sequence: Synthetic peptide
HKDTSTA

SEQ ID NO: 12488 - protein, 7 aa, Artificial Sequence
  Description of Artificial Sequence: Synthetic peptide
DTAKINV

SEQ ID NO: 12489 - protein, 7 aa, Artificial Sequence
  Description of Artificial Sequence: Synthetic peptide
VASQANA

SEQ ID NO: 12490 - protein, 7 aa, Artificial Sequence
  Description of Artificial Sequence: Synthetic peptide
VSSQTVR

SEQ ID NO: 12491 - protein, 7 aa, Artificial Sequence
  Description of Artificial Sequence: Synthetic peptide
NQTKLGQ

SEQ ID NO: 12492 - protein, 7 aa, Artificial Sequence
  Description of Artificial Sequence: Synthetic peptide
SDSVKDS

SEQ ID NO: 12493 - protein, 7 aa, Artificial Sequence
  Description of Artificial Sequence: Synthetic peptide
ASAGTHT

SEQ ID NO: 12494 - protein, 7 aa, Artificial Sequence
  Description of Artificial Sequence: Synthetic peptide
GEKTGVA

SEQ ID NO: 12495 - protein, 7 aa, Artificial Sequence
  Description of Artificial Sequence: Synthetic peptide
TQSKAMA

SEQ ID NO: 12496 - protein, 7 aa, Artificial Sequence
  Description of Artificial Sequence: Synthetic peptide
SNDTRRT

SEQ ID NO: 12497 - protein, 7 aa, Artificial Sequence
  Description of Artificial Sequence: Synthetic peptide
MGSREVM

SEQ ID NO: 12498 - protein, 7 aa, Artificial Sequence
  Description of Artificial Sequence: Synthetic peptide
HSSGTLS

SEQ ID NO: 12499 - protein, 7 aa, Artificial Sequence
  Description of Artificial Sequence: Synthetic peptide
LQGSNAS

SEQ ID NO: 12500 - protein, 7 aa, Artificial Sequence
  Description of Artificial Sequence: Synthetic peptide
DPGNSLR

SEQ ID NO: 12501 - protein, 7 aa, Artificial Sequence
  Description of Artificial Sequence: Synthetic peptide
DVQTPPR

SEQ ID NO: 12502 - protein, 7 aa, Artificial Sequence
  Description of Artificial Sequence: Synthetic peptide
ERMNTQG

SEQ ID NO: 12503 - protein, 7 aa, Artificial Sequence
  Description of Artificial Sequence: Synthetic peptide
DGGEAQR

SEQ ID NO: 12504 - protein, 7 aa, Artificial Sequence
  Description of Artificial Sequence: Synthetic peptide
GTNDSRV

SEQ ID NO: 12505 - protein, 7 aa, Artificial Sequence
  Description of Artificial Sequence: Synthetic peptide
ESLSTSR

SEQ ID NO: 12506 - protein, 7 aa, Artificial Sequence
  Description of Artificial Sequence: Synthetic peptide
TTRTPTA

SEQ ID NO: 12507 - protein, 7 aa, Artificial Sequence
  Description of Artificial Sequence: Synthetic peptide
GGDKPTS

SEQ ID NO: 12508 - protein, 7 aa, Artificial Sequence
  Description of Artificial Sequence: Synthetic peptide
KELSGTT

SEQ ID NO: 12509 - protein, 7 aa, Artificial Sequence
  Description of Artificial Sequence: Synthetic peptide
TNSGHPP

SEQ ID NO: 12510 - protein, 7 aa, Artificial Sequence
  Description of Artificial Sequence: Synthetic peptide
TEQSRSV

SEQ ID NO: 12511 - protein, 7 aa, Artificial Sequence
  Description of Artificial Sequence: Synthetic peptide
SSDGGNR

SEQ ID NO: 12512 - protein, 7 aa, Artificial Sequence
  Description of Artificial Sequence: Synthetic peptide
ELPKTGR

SEQ ID NO: 12513 - protein, 7 aa, Artificial Sequence
  Description of Artificial Sequence: Synthetic peptide
GDTTPRG

SEQ ID NO: 12514 - protein, 7 aa, Artificial Sequence
  Description of Artificial Sequence: Synthetic peptide
VTSDKAA

SEQ ID NO: 12515 - protein, 7 aa, Artificial Sequence
  Description of Artificial Sequence: Synthetic peptide
VGSTANE

SEQ ID NO: 12516 - protein, 7 aa, Artificial Sequence
  Description of Artificial Sequence: Synthetic peptide
SLNSTGG

SEQ ID NO: 12517 - protein, 7 aa, Artificial Sequence
  Description of Artificial Sequence: Synthetic peptide
SSGGSMR

SEQ ID NO: 12518 - protein, 7 aa, Artificial Sequence
  Description of Artificial Sequence: Synthetic peptide
FVEDRTK

SEQ ID NO: 12519 - protein, 7 aa, Artificial Sequence
  Description of Artificial Sequence: Synthetic peptide
NDARPGI

SEQ ID NO: 12520 - protein, 7 aa, Artificial Sequence
  Description of Artificial Sequence: Synthetic peptide
GAPTAAT

SEQ ID NO: 12521 - protein, 7 aa, Artificial Sequence
  Description of Artificial Sequence: Synthetic peptide
GIGERRG

SEQ ID NO: 12522 - protein, 7 aa, Artificial Sequence
  Description of Artificial Sequence: Synthetic peptide
NPSTNSP

SEQ ID NO: 12523 - protein, 7 aa, Artificial Sequence
  Description of Artificial Sequence: Synthetic peptide
THAGSRG

SEQ ID NO: 12524 - protein, 7 aa, Artificial Sequence
  Description of Artificial Sequence: Synthetic peptide
TLDNTNR

SEQ ID NO: 12525 - protein, 7 aa, Artificial Sequence
  Description of Artificial Sequence: Synthetic peptide
RSDTNQG

SEQ ID NO: 12526 - protein, 7 aa, Artificial Sequence
  Description of Artificial Sequence: Synthetic peptide
ALKSGNA

SEQ ID NO: 12527 - protein, 7 aa, Artificial Sequence
  Description of Artificial Sequence: Synthetic peptide
NAGQRSS

SEQ ID NO: 12528 - protein, 7 aa, Artificial Sequence
  Description of Artificial Sequence: Synthetic peptide
HPGPTQG

SEQ ID NO: 12529 - protein, 7 aa, Artificial Sequence
  Description of Artificial Sequence: Synthetic peptide
SRTASTE

SEQ ID NO: 12530 - protein, 7 aa, Artificial Sequence
  Description of Artificial Sequence: Synthetic peptide
TPGSTVL

SEQ ID NO: 12531 - protein, 7 aa, Artificial Sequence
  Description of Artificial Sequence: Synthetic peptide
NLGQSNK

SEQ ID NO: 12532 - protein, 7 aa, Artificial Sequence
  Description of Artificial Sequence: Synthetic peptide
TAGKNSG

SEQ ID NO: 12533 - protein, 7 aa, Artificial Sequence
  Description of Artificial Sequence: Synthetic peptide
SPGGSVS

SEQ ID NO: 12534 - protein, 7 aa, Artificial Sequence
  Description of Artificial Sequence: Synthetic peptide
SVSAATN

SEQ ID NO: 12535 - protein, 7 aa, Artificial Sequence
  Description of Artificial Sequence: Synthetic peptide
SVGGNAL

SEQ ID NO: 12536 - protein, 7 aa, Artificial Sequence
  Description of Artificial Sequence: Synthetic peptide
MANTAVA

SEQ ID NO: 12537 - protein, 7 aa, Artificial Sequence
  Description of Artificial Sequence: Synthetic peptide
QEAGSKA

SEQ ID NO: 12538 - protein, 7 aa, Artificial Sequence
  Description of Artificial Sequence: Synthetic peptide
LVQKDNS

SEQ ID NO: 12539 - protein, 7 aa, Artificial Sequence
  Description of Artificial Sequence: Synthetic peptide
DTTGNRN

SEQ ID NO: 12540 - protein, 7 aa, Artificial Sequence
  Description of Artificial Sequence: Synthetic peptide
GTEGTHR

SEQ ID NO: 12541 - protein, 7 aa, Artificial Sequence
  Description of Artificial Sequence: Synthetic peptide
GTVSSGG

SEQ ID NO: 12542 - protein, 7 aa, Artificial Sequence
  Description of Artificial Sequence: Synthetic peptide
VEGNKGY

SEQ ID NO: 12543 - protein, 7 aa, Artificial Sequence
  Description of Artificial Sequence: Synthetic peptide
LMTSSPA

SEQ ID NO: 12544 - protein, 7 aa, Artificial Sequence
  Description of Artificial Sequence: Synthetic peptide
EKSTPSS

SEQ ID NO: 12545 - protein, 7 aa, Artificial Sequence
  Description of Artificial Sequence: Synthetic peptide
ADASRAS

SEQ ID NO: 12546 - protein, 7 aa, Artificial Sequence
  Description of Artificial Sequence: Synthetic peptide
AGTSPSV

SEQ ID NO: 12547 - protein, 7 aa, Artificial Sequence
  Description of Artificial Sequence: Synthetic peptide
TKEGAGA

SEQ ID NO: 12548 - protein, 7 aa, Artificial Sequence
  Description of Artificial Sequence: Synthetic peptide
SSGQPSH

SEQ ID NO: 12549 - protein, 7 aa, Artificial Sequence
  Description of Artificial Sequence: Synthetic peptide
SGSPRDG

SEQ ID NO: 12550 - protein, 7 aa, Artificial Sequence
  Description of Artificial Sequence: Synthetic peptide
QQKATVE

SEQ ID NO: 12551 - protein, 7 aa, Artificial Sequence
  Description of Artificial Sequence: Synthetic peptide
DHPSRDK

SEQ ID NO: 12552 - protein, 7 aa, Artificial Sequence
  Description of Artificial Sequence: Synthetic peptide
DAPGKVT

SEQ ID NO: 12553 - protein, 7 aa, Artificial Sequence
  Description of Artificial Sequence: Synthetic peptide
DYGEPKS

SEQ ID NO: 12554 - protein, 7 aa, Artificial Sequence
  Description of Artificial Sequence: Synthetic peptide
DQSSKQH

SEQ ID NO: 12555 - protein, 7 aa, Artificial Sequence
  Description of Artificial Sequence: Synthetic peptide
VEGNPPK

SEQ ID NO: 12556 - protein, 7 aa, Artificial Sequence
  Description of Artificial Sequence: Synthetic peptide
FTGGTGS

SEQ ID NO: 12557 - protein, 7 aa, Artificial Sequence
  Description of Artificial Sequence: Synthetic peptide
LGHPKNS

SEQ ID NO: 12558 - protein, 7 aa, Artificial Sequence
  Description of Artificial Sequence: Synthetic peptide
KTGTSSN

SEQ ID NO: 12559 - protein, 7 aa, Artificial Sequence
  Description of Artificial Sequence: Synthetic peptide
SQSNAAT

SEQ ID NO: 12560 - protein, 7 aa, Artificial Sequence
  Description of Artificial Sequence: Synthetic peptide
TATKENI

SEQ ID NO: 12561 - protein, 7 aa, Artificial Sequence
  Description of Artificial Sequence: Synthetic peptide
SGLKPLN

SEQ ID NO: 12562 - protein, 7 aa, Artificial Sequence
  Description of Artificial Sequence: Synthetic peptide
EAVKPAT

SEQ ID NO: 12563 - protein, 7 aa, Artificial Sequence
  Description of Artificial Sequence: Synthetic peptide
DGLTNHI

SEQ ID NO: 12564 - protein, 7 aa, Artificial Sequence
  Description of Artificial Sequence: Synthetic peptide
ANETRPP

SEQ ID NO: 12565 - protein, 7 aa, Artificial Sequence
  Description of Artificial Sequence: Synthetic peptide
GGGQNSL

SEQ ID NO: 12566 - protein, 7 aa, Artificial Sequence
  Description of Artificial Sequence: Synthetic peptide
VQSEART

SEQ ID NO: 12567 - protein, 7 aa, Artificial Sequence
  Description of Artificial Sequence: Synthetic peptide
SHGSPSV

SEQ ID NO: 12568 - protein, 7 aa, Artificial Sequence
  Description of Artificial Sequence: Synthetic peptide
NTEAVLK

SEQ ID NO: 12569 - protein, 7 aa, Artificial Sequence
  Description of Artificial Sequence: Synthetic peptide
TSGGTVP

SEQ ID NO: 12570 - protein, 7 aa, Artificial Sequence
  Description of Artificial Sequence: Synthetic peptide
MATKTSV

SEQ ID NO: 12571 - protein, 7 aa, Artificial Sequence
  Description of Artificial Sequence: Synthetic peptide
ASGSSVL

SEQ ID NO: 12572 - protein, 7 aa, Artificial Sequence
  Description of Artificial Sequence: Synthetic peptide
ASNTITK

SEQ ID NO: 12573 - protein, 7 aa, Artificial Sequence
  Description of Artificial Sequence: Synthetic peptide
GSVDIQK

SEQ ID NO: 12574 - protein, 7 aa, Artificial Sequence
  Description of Artificial Sequence: Synthetic peptide
VSTNQVT

SEQ ID NO: 12575 - protein, 7 aa, Artificial Sequence
  Description of Artificial Sequence: Synthetic peptide
NAGASKN

SEQ ID NO: 12576 - protein, 7 aa, Artificial Sequence
  Description of Artificial Sequence: Synthetic peptide
TSHTKPP

SEQ ID NO: 12577 - protein, 7 aa, Artificial Sequence
  Description of Artificial Sequence: Synthetic peptide
SPGDGRR

SEQ ID NO: 12578 - protein, 7 aa, Artificial Sequence
  Description of Artificial Sequence: Synthetic peptide
ASEGKYL

SEQ ID NO: 12579 - protein, 7 aa, Artificial Sequence
  Description of Artificial Sequence: Synthetic peptide
GVSKDTN

SEQ ID NO: 12580 - protein, 7 aa, Artificial Sequence
  Description of Artificial Sequence: Synthetic peptide
SLGGGSG

SEQ ID NO: 12581 - protein, 7 aa, Artificial Sequence
  Description of Artificial Sequence: Synthetic peptide
SLSGQRE

SEQ ID NO: 12582 - protein, 7 aa, Artificial Sequence
  Description of Artificial Sequence: Synthetic peptide
SGTSRTV

SEQ ID NO: 12583 - protein, 7 aa, Artificial Sequence
  Description of Artificial Sequence: Synthetic peptide
GSATASS

SEQ ID NO: 12584 - protein, 7 aa, Artificial Sequence
  Description of Artificial Sequence: Synthetic peptide
DTGTHSN

SEQ ID NO: 12585 - protein, 7 aa, Artificial Sequence
  Description of Artificial Sequence: Synthetic peptide
NNGGVNA

SEQ ID NO: 12586 - protein, 7 aa, Artificial Sequence
  Description of Artificial Sequence: Synthetic peptide
NTPTTQG

SEQ ID NO: 12587 - protein, 7 aa, Artificial Sequence
  Description of Artificial Sequence: Synthetic peptide
LNETRPS

SEQ ID NO: 12588 - protein, 7 aa, Artificial Sequence
  Description of Artificial Sequence: Synthetic peptide
DAPKQVA

SEQ ID NO: 12589 - protein, 7 aa, Artificial Sequence
  Description of Artificial Sequence: Synthetic peptide
EGRNASG

SEQ ID NO: 12590 - protein, 7 aa, Artificial Sequence
  Description of Artificial Sequence: Synthetic peptide
AGTQNKA

SEQ ID NO: 12591 - protein, 7 aa, Artificial Sequence
  Description of Artificial Sequence: Synthetic peptide
GLGAPGT

SEQ ID NO: 12592 - protein, 7 aa, Artificial Sequence
  Description of Artificial Sequence: Synthetic peptide
GSASKDV

SEQ ID NO: 12593 - protein, 7 aa, Artificial Sequence
  Description of Artificial Sequence: Synthetic peptide
SNSKTLQ

SEQ ID NO: 12594 - protein, 7 aa, Artificial Sequence
  Description of Artificial Sequence: Synthetic peptide
TQGNGIQ

SEQ ID NO: 12595 - protein, 7 aa, Artificial Sequence
  Description of Artificial Sequence: Synthetic peptide
NRVNGNT

SEQ ID NO: 12596 - protein, 7 aa, Artificial Sequence
  Description of Artificial Sequence: Synthetic peptide
TGMQGSH

SEQ ID NO: 12597 - protein, 7 aa, Artificial Sequence
  Description of Artificial Sequence: Synthetic peptide
TMDSKGQ

SEQ ID NO: 12598 - protein, 7 aa, Artificial Sequence
  Description of Artificial Sequence: Synthetic peptide
SSSGGIT

SEQ ID NO: 12599 - protein, 7 aa, Artificial Sequence
  Description of Artificial Sequence: Synthetic peptide
SDQPSRG

SEQ ID NO: 12600 - protein, 7 aa, Artificial Sequence
  Description of Artificial Sequence: Synthetic peptide
SGSPGIQ

SEQ ID NO: 12601 - protein, 7 aa, Artificial Sequence
  Description of Artificial Sequence: Synthetic peptide
MGDKSLY

SEQ ID NO: 12602 - protein, 7 aa, Artificial Sequence
  Description of Artificial Sequence: Synthetic peptide
HHSEKRD

SEQ ID NO: 12603 - protein, 7 aa, Artificial Sequence
  Description of Artificial Sequence: Synthetic peptide
LQGSSQP

SEQ ID NO: 12604 - protein, 7 aa, Artificial Sequence
  Description of Artificial Sequence: Synthetic peptide
ENTSIPK

SEQ ID NO: 12605 - protein, 7 aa, Artificial Sequence
  Description of Artificial Sequence: Synthetic peptide
EGVSKAD

SEQ ID NO: 12606 - protein, 7 aa, Artificial Sequence
  Description of Artificial Sequence: Synthetic peptide
DKSSSRE

SEQ ID NO: 12607 - protein, 7 aa, Artificial Sequence
  Description of Artificial Sequence: Synthetic peptide
GTSAGGS

SEQ ID NO: 12608 - protein, 7 aa, Artificial Sequence
  Description of Artificial Sequence: Synthetic peptide
VTSKGTN

SEQ ID NO: 12609 - protein, 7 aa, Artificial Sequence
  Description of Artificial Sequence: Synthetic peptide
CTDGKSA

SEQ ID NO: 12610 - protein, 7 aa, Artificial Sequence
  Description of Artificial Sequence: Synthetic peptide
EVTNKTL

SEQ ID NO: 12611 - protein, 7 aa, Artificial Sequence
  Description of Artificial Sequence: Synthetic peptide
NSHTAST

SEQ ID NO: 12612 - protein, 7 aa, Artificial Sequence
  Description of Artificial Sequence: Synthetic peptide
LTTSTGG

SEQ ID NO: 12613 - protein, 7 aa, Artificial Sequence
  Description of Artificial Sequence: Synthetic peptide
VASATST

SEQ ID NO: 12614 - protein, 7 aa, Artificial Sequence
  Description of Artificial Sequence: Synthetic peptide
TSTATSI

SEQ ID NO: 12615 - protein, 7 aa, Artificial Sequence
  Description of Artificial Sequence: Synthetic peptide
ISTNTSH

SEQ ID NO: 12616 - protein, 7 aa, Artificial Sequence
  Description of Artificial Sequence: Synthetic peptide
GESNHHT

SEQ ID NO: 12617 - protein, 7 aa, Artificial Sequence
  Description of Artificial Sequence: Synthetic peptide
VQTQTAA

SEQ ID NO: 12618 - protein, 7 aa, Artificial Sequence
  Description of Artificial Sequence: Synthetic peptide
SNAVKSS

SEQ ID NO: 12619 - protein, 7 aa, Artificial Sequence
  Description of Artificial Sequence: Synthetic peptide
SVTTPRN

SEQ ID NO: 12620 - protein, 7 aa, Artificial Sequence
  Description of Artificial Sequence: Synthetic peptide
NGGSTLS

SEQ ID NO: 12621 - protein, 7 aa, Artificial Sequence
  Description of Artificial Sequence: Synthetic peptide
TAEGART

SEQ ID NO: 12622 - protein, 7 aa, Artificial Sequence
  Description of Artificial Sequence: Synthetic peptide
IQASANK

SEQ ID NO: 12623 - protein, 7 aa, Artificial Sequence
  Description of Artificial Sequence: Synthetic peptide
GATHGSS

SEQ ID NO: 12624 - protein, 7 aa, Artificial Sequence
  Description of Artificial Sequence: Synthetic peptide
VSSGTLG

SEQ ID NO: 12625 - protein, 7 aa, Artificial Sequence
  Description of Artificial Sequence: Synthetic peptide
SIGAANA

SEQ ID NO: 12626 - protein, 7 aa, Artificial Sequence
  Description of Artificial Sequence: Synthetic peptide
SMAARPS

SEQ ID NO: 12627 - protein, 7 aa, Artificial Sequence
  Description of Artificial Sequence: Synthetic peptide
SANSTPG

SEQ ID NO: 12628 - protein, 7 aa, Artificial Sequence
  Description of Artificial Sequence: Synthetic peptide
SVSSSNM

SEQ ID NO: 12629 - protein, 7 aa, Artificial Sequence
  Description of Artificial Sequence: Synthetic peptide
VPSSSPT

SEQ ID NO: 12630 - protein, 7 aa, Artificial Sequence
  Description of Artificial Sequence: Synthetic peptide
TTSPPSS

SEQ ID NO: 12631 - protein, 7 aa, Artificial Sequence
  Description of Artificial Sequence: Synthetic peptide
TLSPDAK

SEQ ID NO: 12632 - protein, 7 aa, Artificial Sequence
  Description of Artificial Sequence: Synthetic peptide
GLPASNS

SEQ ID NO: 12633 - protein, 7 aa, Artificial Sequence
  Description of Artificial Sequence: Synthetic peptide
VSVKPES

SEQ ID NO: 12634 - protein, 7 aa, Artificial Sequence
  Description of Artificial Sequence: Synthetic peptide
VKSESQA

SEQ ID NO: 12635 - protein, 7 aa, Artificial Sequence
  Description of Artificial Sequence: Synthetic peptide
LNSTSLS

SEQ ID NO: 12636 - protein, 7 aa, Artificial Sequence
  Description of Artificial Sequence: Synthetic peptide
KQTQSPT

SEQ ID NO: 12637 - protein, 7 aa, Artificial Sequence
  Description of Artificial Sequence: Synthetic peptide
HAQRTNE

SEQ ID NO: 12638 - protein, 7 aa, Artificial Sequence
  Description of Artificial Sequence: Synthetic peptide
GTGRERS

SEQ ID NO: 12639 - protein, 7 aa, Artificial Sequence
  Description of Artificial Sequence: Synthetic peptide
ASTSTTS

SEQ ID NO: 12640 - protein, 7 aa, Artificial Sequence
  Description of Artificial Sequence: Synthetic peptide
TGQRDVT

SEQ ID NO: 12641 - protein, 7 aa, Artificial Sequence
  Description of Artificial Sequence: Synthetic peptide
SGVGTVV

SEQ ID NO: 12642 - protein, 7 aa, Artificial Sequence
  Description of Artificial Sequence: Synthetic peptide
HAASPSI

SEQ ID NO: 12643 - protein, 7 aa, Artificial Sequence
  Description of Artificial Sequence: Synthetic peptide
GTGTDSH

SEQ ID NO: 12644 - protein, 7 aa, Artificial Sequence
  Description of Artificial Sequence: Synthetic peptide
GSASSNG

SEQ ID NO: 12645 - protein, 7 aa, Artificial Sequence
  Description of Artificial Sequence: Synthetic peptide
SQSSQSA

SEQ ID NO: 12646 - protein, 7 aa, Artificial Sequence
  Description of Artificial Sequence: Synthetic peptide
SESVKGS

SEQ ID NO: 12647 - protein, 7 aa, Artificial Sequence
  Description of Artificial Sequence: Synthetic peptide
LNSSPTH

SEQ ID NO: 12648 - protein, 7 aa, Artificial Sequence
  Description of Artificial Sequence: Synthetic peptide
DGKDRSP

SEQ ID NO: 12649 - protein, 7 aa, Artificial Sequence
  Description of Artificial Sequence: Synthetic peptide
AGVTERS

SEQ ID NO: 12650 - protein, 7 aa, Artificial Sequence
  Description of Artificial Sequence: Synthetic peptide
GNATTQA

SEQ ID NO: 12651 - protein, 7 aa, Artificial Sequence
  Description of Artificial Sequence: Synthetic peptide
GTARSTL

SEQ ID NO: 12652 - protein, 7 aa, Artificial Sequence
  Description of Artificial Sequence: Synthetic peptide
GSDKPQN

SEQ ID NO: 12653 - protein, 7 aa, Artificial Sequence
  Description of Artificial Sequence: Synthetic peptide
VKNGSSN

SEQ ID NO: 12654 - protein, 7 aa, Artificial Sequence
  Description of Artificial Sequence: Synthetic peptide
VTDRPSV

SEQ ID NO: 12655 - protein, 7 aa, Artificial Sequence
  Description of Artificial Sequence: Synthetic peptide
STGSKQD

SEQ ID NO: 12656 - protein, 7 aa, Artificial Sequence
  Description of Artificial Sequence: Synthetic peptide
SQSSGVR

SEQ ID NO: 12657 - protein, 7 aa, Artificial Sequence
  Description of Artificial Sequence: Synthetic peptide
GPGEKVQ

SEQ ID NO: 12658 - protein, 7 aa, Artificial Sequence
  Description of Artificial Sequence: Synthetic peptide
SQDRGSQ

SEQ ID NO: 12659 - protein, 7 aa, Artificial Sequence
  Description of Artificial Sequence: Synthetic peptide
QSSGTGT

SEQ ID NO: 12660 - protein, 7 aa, Artificial Sequence
  Description of Artificial Sequence: Synthetic peptide
GSVDRSS

SEQ ID NO: 12661 - protein, 7 aa, Artificial Sequence
  Description of Artificial Sequence: Synthetic peptide
TTDPASR

SEQ ID NO: 12662 - protein, 7 aa, Artificial Sequence
  Description of Artificial Sequence: Synthetic peptide
LASTSPS

SEQ ID NO: 12663 - protein, 7 aa, Artificial Sequence
  Description of Artificial Sequence: Synthetic peptide
RDGSSSR

SEQ ID NO: 12664 - protein, 7 aa, Artificial Sequence
  Description of Artificial Sequence: Synthetic peptide
GTTLSEG

SEQ ID NO: 12665 - protein, 7 aa, Artificial Sequence
  Description of Artificial Sequence: Synthetic peptide
SGLKGTN

SEQ ID NO: 12666 - protein, 7 aa, Artificial Sequence
  Description of Artificial Sequence: Synthetic peptide
KGVKPEC

SEQ ID NO: 12667 - protein, 7 aa, Artificial Sequence
  Description of Artificial Sequence: Synthetic peptide
NGLDKSL

SEQ ID NO: 12668 - protein, 7 aa, Artificial Sequence
  Description of Artificial Sequence: Synthetic peptide
TGTHSSV

SEQ ID NO: 12669 - protein, 7 aa, Artificial Sequence
  Description of Artificial Sequence: Synthetic peptide
RHEEKMS

SEQ ID NO: 12670 - protein, 7 aa, Artificial Sequence
  Description of Artificial Sequence: Synthetic peptide
SRESKGD

SEQ ID NO: 12671 - protein, 7 aa, Artificial Sequence
  Description of Artificial Sequence: Synthetic peptide
MNSKEPS

SEQ ID NO: 12672 - protein, 7 aa, Artificial Sequence
  Description of Artificial Sequence: Synthetic peptide
QGGSNLK

SEQ ID NO: 12673 - protein, 7 aa, Artificial Sequence
  Description of Artificial Sequence: Synthetic peptide
HTTPATV

SEQ ID NO: 12674 - protein, 7 aa, Artificial Sequence
  Description of Artificial Sequence: Synthetic peptide
HVSTPTR

SEQ ID NO: 12675 - protein, 7 aa, Artificial Sequence
  Description of Artificial Sequence: Synthetic peptide
RSDNPST

SEQ ID NO: 12676 - protein, 7 aa, Artificial Sequence
  Description of Artificial Sequence: Synthetic peptide
DMQQKPC

SEQ ID NO: 12677 - protein, 7 aa, Artificial Sequence
  Description of Artificial Sequence: Synthetic peptide
GDSPGST

SEQ ID NO: 12678 - protein, 7 aa, Artificial Sequence
  Description of Artificial Sequence: Synthetic peptide
GLAEGQS

SEQ ID NO: 12679 - protein, 7 aa, Artificial Sequence
  Description of Artificial Sequence: Synthetic peptide
VKTASTA

SEQ ID NO: 12680 - protein, 7 aa, Artificial Sequence
  Description of Artificial Sequence: Synthetic peptide
VNGKSPA

SEQ ID NO: 12681 - protein, 7 aa, Artificial Sequence
  Description of Artificial Sequence: Synthetic peptide
SNATVSK

SEQ ID NO: 12682 - protein, 7 aa, Artificial Sequence
  Description of Artificial Sequence: Synthetic peptide
SNKSTTS

SEQ ID NO: 12683 - protein, 7 aa, Artificial Sequence
  Description of Artificial Sequence: Synthetic peptide
STSVGPV

SEQ ID NO: 12684 - protein, 7 aa, Artificial Sequence
  Description of Artificial Sequence: Synthetic peptide
CGSVSCQ

SEQ ID NO: 12685 - protein, 7 aa, Artificial Sequence
  Description of Artificial Sequence: Synthetic peptide
LGTQSMK

SEQ ID NO: 12686 - protein, 7 aa, Artificial Sequence
  Description of Artificial Sequence: Synthetic peptide
FRGDKSA

SEQ ID NO: 12687 - protein, 7 aa, Artificial Sequence
  Description of Artificial Sequence: Synthetic peptide
FSKEKSQ

SEQ ID NO: 12688 - protein, 7 aa, Artificial Sequence
  Description of Artificial Sequence: Synthetic peptide
SPQQSHN

SEQ ID NO: 12689 - protein, 7 aa, Artificial Sequence
  Description of Artificial Sequence: Synthetic peptide
HQNSASV

SEQ ID NO: 12690 - protein, 7 aa, Artificial Sequence
  Description of Artificial Sequence: Synthetic peptide
NENSPRG

SEQ ID NO: 12691 - protein, 7 aa, Artificial Sequence
  Description of Artificial Sequence: Synthetic peptide
SVNPKEG

SEQ ID NO: 12692 - protein, 7 aa, Artificial Sequence
  Description of Artificial Sequence: Synthetic peptide
LGSSSGG

SEQ ID NO: 12693 - protein, 7 aa, Artificial Sequence
  Description of Artificial Sequence: Synthetic peptide
TRANPGN

SEQ ID NO: 12694 - protein, 7 aa, Artificial Sequence
  Description of Artificial Sequence: Synthetic peptide
LKNNGTG

SEQ ID NO: 12695 - protein, 7 aa, Artificial Sequence
  Description of Artificial Sequence: Synthetic peptide
LDGKQRA

SEQ ID NO: 12696 - protein, 7 aa, Artificial Sequence
  Description of Artificial Sequence: Synthetic peptide
LTNGSVP

SEQ ID NO: 12697 - protein, 7 aa, Artificial Sequence
  Description of Artificial Sequence: Synthetic peptide
STVNHSV

SEQ ID NO: 12698 - protein, 7 aa, Artificial Sequence
  Description of Artificial Sequence: Synthetic peptide
MSASTNV

SEQ ID NO: 12699 - protein, 7 aa, Artificial Sequence
  Description of Artificial Sequence: Synthetic peptide
NQATGTS

SEQ ID NO: 12700 - protein, 7 aa, Artificial Sequence
  Description of Artificial Sequence: Synthetic peptide
LNTNSVI

SEQ ID NO: 12701 - protein, 7 aa, Artificial Sequence
  Description of Artificial Sequence: Synthetic peptide
GNGNVLR

SEQ ID NO: 12702 - protein, 7 aa, Artificial Sequence
  Description of Artificial Sequence: Synthetic peptide
SDKSSAH

SEQ ID NO: 12703 - protein, 7 aa, Artificial Sequence
  Description of Artificial Sequence: Synthetic peptide
LGTSPGH

SEQ ID NO: 12704 - protein, 7 aa, Artificial Sequence
  Description of Artificial Sequence: Synthetic peptide
LPSPQSG

SEQ ID NO: 12705 - protein, 7 aa, Artificial Sequence
  Description of Artificial Sequence: Synthetic peptide
DGMTNHK

SEQ ID NO: 12706 - protein, 7 aa, Artificial Sequence
  Description of Artificial Sequence: Synthetic peptide
ESDHKSG

SEQ ID NO: 12707 - protein, 7 aa, Artificial Sequence
  Description of Artificial Sequence: Synthetic peptide
AAEKSNT

SEQ ID NO: 12708 - protein, 7 aa, Artificial Sequence
  Description of Artificial Sequence: Synthetic peptide
GTKTASA

SEQ ID NO: 12709 - protein, 7 aa, Artificial Sequence
  Description of Artificial Sequence: Synthetic peptide
GSDGTKL

SEQ ID NO: 12710 - protein, 7 aa, Artificial Sequence
  Description of Artificial Sequence: Synthetic peptide
GTRTDPN

SEQ ID NO: 12711 - protein, 7 aa, Artificial Sequence
  Description of Artificial Sequence: Synthetic peptide
SGPGTAQ

SEQ ID NO: 12712 - protein, 7 aa, Artificial Sequence
  Description of Artificial Sequence: Synthetic peptide
SVESNPA

SEQ ID NO: 12713 - protein, 7 aa, Artificial Sequence
  Description of Artificial Sequence: Synthetic peptide
HGGSAVS

SEQ ID NO: 12714 - protein, 7 aa, Artificial Sequence
  Description of Artificial Sequence: Synthetic peptide
LDNKSTS

SEQ ID NO: 12715 - protein, 7 aa, Artificial Sequence
  Description of Artificial Sequence: Synthetic peptide
LGQSTLS

SEQ ID NO: 12716 - protein, 7 aa, Artificial Sequence
  Description of Artificial Sequence: Synthetic peptide
ATPAKDG

SEQ ID NO: 12717 - protein, 7 aa, Artificial Sequence
  Description of Artificial Sequence: Synthetic peptide
AQGDSVT

SEQ ID NO: 12718 - protein, 7 aa, Artificial Sequence
  Description of Artificial Sequence: Synthetic peptide
VQQGSAG

SEQ ID NO: 12719 - protein, 7 aa, Artificial Sequence
  Description of Artificial Sequence: Synthetic peptide
SGNSGLA

SEQ ID NO: 12720 - protein, 7 aa, Artificial Sequence
  Description of Artificial Sequence: Synthetic peptide
ANAPPRN

SEQ ID NO: 12721 - protein, 7 aa, Artificial Sequence
  Description of Artificial Sequence: Synthetic peptide
NPSTKSD

SEQ ID NO: 12722 - protein, 7 aa, Artificial Sequence
  Description of Artificial Sequence: Synthetic peptide
TNSKDQT

SEQ ID NO: 12723 - protein, 7 aa, Artificial Sequence
  Description of Artificial Sequence: Synthetic peptide
TAEGTRI

SEQ ID NO: 12724 - protein, 7 aa, Artificial Sequence
  Description of Artificial Sequence: Synthetic peptide
TPREAGG

SEQ ID NO: 12725 - protein, 7 aa, Artificial Sequence
  Description of Artificial Sequence: Synthetic peptide
TQDPQFK

SEQ ID NO: 12726 - protein, 7 aa, Artificial Sequence
  Description of Artificial Sequence: Synthetic peptide
TLGSSTN

SEQ ID NO: 12727 - protein, 7 aa, Artificial Sequence
  Description of Artificial Sequence: Synthetic peptide
IGSGSSP

SEQ ID NO: 12728 - protein, 7 aa, Artificial Sequence
  Description of Artificial Sequence: Synthetic peptide
ISGSDTK

SEQ ID NO: 12729 - protein, 7 aa, Artificial Sequence
  Description of Artificial Sequence: Synthetic peptide
QSGNNAA

SEQ ID NO: 12730 - protein, 7 aa, Artificial Sequence
  Description of Artificial Sequence: Synthetic peptide
QGRSPAT

SEQ ID NO: 12731 - protein, 7 aa, Artificial Sequence
  Description of Artificial Sequence: Synthetic peptide
DTGDKQS

SEQ ID NO: 12732 - protein, 7 aa, Artificial Sequence
  Description of Artificial Sequence: Synthetic peptide
VGQASTQ

SEQ ID NO: 12733 - protein, 7 aa, Artificial Sequence
  Description of Artificial Sequence: Synthetic peptide
SSSSSSS

SEQ ID NO: 12734 - protein, 7 aa, Artificial Sequence
  Description of Artificial Sequence: Synthetic peptide
TSTGVNA

SEQ ID NO: 12735 - protein, 7 aa, Artificial Sequence
  Description of Artificial Sequence: Synthetic peptide
TMGTTHT

SEQ ID NO: 12736 - protein, 7 aa, Artificial Sequence
  Description of Artificial Sequence: Synthetic peptide
TGATTVS

SEQ ID NO: 12737 - protein, 7 aa, Artificial Sequence
  Description of Artificial Sequence: Synthetic peptide
TKTTSNS

SEQ ID NO: 12738 - protein, 7 aa, Artificial Sequence
  Description of Artificial Sequence: Synthetic peptide
SSDRGRS

SEQ ID NO: 12739 - protein, 7 aa, Artificial Sequence
  Description of Artificial Sequence: Synthetic peptide
SEASPSH

SEQ ID NO: 12740 - DNA, 21 bp, Artificial Sequence
  Description of Artificial Sequence: Synthetic oligonucleotide
agcggcctcaaaggcaccggc

SEQ ID NO: 12741 - DNA, 21 bp, Artificial Sequence
  Description of Artificial Sequence: Synthetic oligonucleotide
gtgggtgggactcagggtaag

SEQ ID NO: 12742 - DNA, 21 bp, Artificial Sequence
  Description of Artificial Sequence: Synthetic oligonucleotide
agcatggacagcagacccggc

SEQ ID NO: 12743 - DNA, 21 bp, Artificial Sequence
  Description of Artificial Sequence: Synthetic oligonucleotide
ggtagtagtcctagtaaggct

SEQ ID NO: 12744 - DNA, 21 bp, Artificial Sequence
  Description of Artificial Sequence: Synthetic oligonucleotide
actggtacggcgaatccgttg

SEQ ID NO: 12745 - DNA, 21 bp, Artificial Sequence
  Description of Artificial Sequence: Synthetic oligonucleotide
agccaaggcgccaaacccgtc

SEQ ID NO: 12746 - DNA, 21 bp, Artificial Sequence
  Description of Artificial Sequence: Synthetic oligonucleotide
cagggggagaagaatactatg

SEQ ID NO: 12747 - DNA, 21 bp, Artificial Sequence
  Description of Artificial Sequence: Synthetic oligonucleotide
accagcggcaacagcagcaaa

SEQ ID NO: 12748 - DNA, 21 bp, Artificial Sequence
  Description of Artificial Sequence: Synthetic oligonucleotide
acgacgtctaagcctggtact

SEQ ID NO: 12749 - DNA, 21 bp, Artificial Sequence
  Description of Artificial Sequence: Synthetic oligonucleotide
agccaaggcaaaggcggcagc

SEQ ID NO: 12750 - DNA, 21 bp, Artificial Sequence
  Description of Artificial Sequence: Synthetic oligonucleotide
gggtcgattaagggggaggct

SEQ ID NO: 12751 - DNA, 21 bp, Artificial Sequence
  Description of Artificial Sequence: Synthetic oligonucleotide
aacagcggcaccaccggcaac

SEQ ID NO: 12752 - DNA, 21 bp, Artificial Sequence
  Description of Artificial Sequence: Synthetic oligonucleotide
gaaagaaccaaagaaaccctc

SEQ ID NO: 12753 - DNA, 21 bp, Artificial Sequence
  Description of Artificial Sequence: Synthetic oligonucleotide
gatcatggtaaggggaatcag

SEQ ID NO: 12754 - DNA, 21 bp, Artificial Sequence
  Description of Artificial Sequence: Synthetic oligonucleotide
gatgggcagcagcggagtagt

SEQ ID NO: 12755 - DNA, 21 bp, Artificial Sequence
  Description of Artificial Sequence: Synthetic oligonucleotide
tcgggtaatagtactaataag

SEQ ID NO: 12756 - DNA, 21 bp, Artificial Sequence
  Description of Artificial Sequence: Synthetic oligonucleotide
ggtgttgagcagcgttcgggg

SEQ ID NO: 12757 - DNA, 21 bp, Artificial Sequence
  Description of Artificial Sequence: Synthetic oligonucleotide
aatggtggtaagtcgagttcg

SEQ ID NO: 12758 - DNA, 21 bp, Artificial Sequence
  Description of Artificial Sequence: Synthetic oligonucleotide
tcgactaataagagtaatctg

SEQ ID NO: 12759 - DNA, 21 bp, Artificial Sequence
  Description of Artificial Sequence: Synthetic oligonucleotide
gacggccaaggcaacggcaaa

SEQ ID NO: 12760 - DNA, 21 bp, Artificial Sequence
  Description of Artificial Sequence: Synthetic oligonucleotide
ggggaggggaagggtcagagt

SEQ ID NO: 12761 - DNA, 21 bp, Artificial Sequence
  Description of Artificial Sequence: Synthetic oligonucleotide
ggcgtcaacagcagcggcaga

SEQ ID NO: 12762 - DNA, 21 bp, Artificial Sequence
  Description of Artificial Sequence: Synthetic oligonucleotide
gacaccggcacccccatcaaa

SEQ ID NO: 12763 - DNA, 21 bp, Artificial Sequence
  Description of Artificial Sequence: Synthetic oligonucleotide
gggagttcggggtcgatgaag

SEQ ID NO: 12764 - DNA, 21 bp, Artificial Sequence
  Description of Artificial Sequence: Synthetic oligonucleotide
ggtaattcttctaagcagttt

SEQ ID NO: 12765 - DNA, 21 bp, Artificial Sequence
  Description of Artificial Sequence: Synthetic oligonucleotide
gaaaccggcaacaaaggcggc

SEQ ID NO: 12766 - DNA, 21 bp, Artificial Sequence
  Description of Artificial Sequence: Synthetic oligonucleotide
tcgggtgtggagaagcaggcg

SEQ ID NO: 12767 - DNA, 21 bp, Artificial Sequence
  Description of Artificial Sequence: Synthetic oligonucleotide
gacaacctcggccaaagcaaa

SEQ ID NO: 12768 - DNA, 21 bp, Artificial Sequence
  Description of Artificial Sequence: Synthetic oligonucleotide
ctcggcacccaaagcgccaaa

SEQ ID NO: 12769 - DNA, 21 bp, Artificial Sequence
  Description of Artificial Sequence: Synthetic oligonucleotide
aacggcgacaacagcaccaga

SEQ ID NO: 12770 - DNA, 21 bp, Artificial Sequence
  Description of Artificial Sequence: Synthetic oligonucleotide
accaccggcagccccagccaa

SEQ ID NO: 12771 - DNA, 21 bp, Artificial Sequence
  Description of Artificial Sequence: Synthetic oligonucleotide
aacagcagcggcacccccagc

SEQ ID NO: 12772 - DNA, 21 bp, Artificial Sequence
  Description of Artificial Sequence: Synthetic oligonucleotide
agtgctagttcgactccgcat

SEQ ID NO: 12773 - DNA, 21 bp, Artificial Sequence
  Description of Artificial Sequence: Synthetic oligonucleotide
ggtcagggtaatgggttgtct

SEQ ID NO: 12774 - DNA, 21 bp, Artificial Sequence
  Description of Artificial Sequence: Synthetic oligonucleotide
ggtactggtaagagtcaggct

SEQ ID NO: 12775 - DNA, 21 bp, Artificial Sequence
  Description of Artificial Sequence: Synthetic oligonucleotide
agcgacaacaaaagccaacac

SEQ ID NO: 12776 - DNA, 21 bp, Artificial Sequence
  Description of Artificial Sequence: Synthetic oligonucleotide
ggtgtggtgcagggggctcgg

SEQ ID NO: 12777 - DNA, 21 bp, Artificial Sequence
  Description of Artificial Sequence: Synthetic oligonucleotide
gacggcggccaagccagaagc

SEQ ID NO: 12778 - DNA, 21 bp, Artificial Sequence
  Description of Artificial Sequence: Synthetic oligonucleotide
aatggtgctcagaaggtgaat

SEQ ID NO: 12779 - DNA, 21 bp, Artificial Sequence
  Description of Artificial Sequence: Synthetic oligonucleotide
acttcggattctaagacgact

SEQ ID NO: 12780 - DNA, 21 bp, Artificial Sequence
  Description of Artificial Sequence: Synthetic oligonucleotide
ggttataataaggattctggt

SEQ ID NO: 12781 - DNA, 21 bp, Artificial Sequence
  Description of Artificial Sequence: Synthetic oligonucleotide
ggcggcgtcggcgccgccggc

SEQ ID NO: 12782 - DNA, 21 bp, Artificial Sequence
  Description of Artificial Sequence: Synthetic oligonucleotide
aatgttagtcataatgggggg

SEQ ID NO: 12783 - DNA, 21 bp, Artificial Sequence
  Description of Artificial Sequence: Synthetic oligonucleotide
tctagtacggggacgaatcat

SEQ ID NO: 12784 - DNA, 21 bp, Artificial Sequence
  Description of Artificial Sequence: Synthetic oligonucleotide
ggtacggggaaggatcgggtg

SEQ ID NO: 12785 - DNA, 21 bp, Artificial Sequence
  Description of Artificial Sequence: Synthetic oligonucleotide
gacggcaacatggccaacaaa

SEQ ID NO: 12786 - DNA, 21 bp, Artificial Sequence
  Description of Artificial Sequence: Synthetic oligonucleotide
acgctgaataataaggggctt

SEQ ID NO: 12787 - DNA, 21 bp, Artificial Sequence
  Description of Artificial Sequence: Synthetic oligonucleotide
accgacgccagcaaagtcagc

SEQ ID NO: 12788 - DNA, 21 bp, Artificial Sequence
  Description of Artificial Sequence: Synthetic oligonucleotide
aatacggggaagaatggtctt

SEQ ID NO: 12789 - DNA, 21 bp, Artificial Sequence
  Description of Artificial Sequence: Synthetic oligonucleotide
agcggcaccagcaaaaacgtc

SEQ ID NO: 12790 - DNA, 21 bp, Artificial Sequence
  Description of Artificial Sequence: Synthetic oligonucleotide
gatcatgcgagtacgaacaag

SEQ ID NO: 12791 - DNA, 21 bp, Artificial Sequence
  Description of Artificial Sequence: Synthetic oligonucleotide
ggcaacagcagcacccccaaa

SEQ ID NO: 12792 - DNA, 21 bp, Artificial Sequence
  Description of Artificial Sequence: Synthetic oligonucleotide
acggagagtcagaagattgtt

SEQ ID NO: 12793 - DNA, 21 bp, Artificial Sequence
  Description of Artificial Sequence: Synthetic oligonucleotide
gagggtgggaaggggcctgct

SEQ ID NO: 12794 - DNA, 21 bp, Artificial Sequence
  Description of Artificial Sequence: Synthetic oligonucleotide
ggcaacggcagcaaagccgtc

SEQ ID NO: 12795 - DNA, 21 bp, Artificial Sequence
  Description of Artificial Sequence: Synthetic oligonucleotide
accggccaaagcagcaccagc

SEQ ID NO: 12796 - DNA, 21 bp, Artificial Sequence
  Description of Artificial Sequence: Synthetic oligonucleotide
gcgggttcgaagactagtgcg

SEQ ID NO: 12797 - DNA, 21 bp, Artificial Sequence
  Description of Artificial Sequence: Synthetic oligonucleotide
tctaatcgggataaggcgtcg

SEQ ID NO: 12798 - DNA, 21 bp, Artificial Sequence
  Description of Artificial Sequence: Synthetic oligonucleotide
ggcagcggcaaccaaaccggc

SEQ ID NO: 12799 - DNA, 21 bp, Artificial Sequence
  Description of Artificial Sequence: Synthetic oligonucleotide
gggactgggtctaagccgtat

SEQ ID NO: 12800 - DNA, 21 bp, Artificial Sequence
  Description of Artificial Sequence: Synthetic oligonucleotide
agtgctagtgggaagaatacg

SEQ ID NO: 12801 - DNA, 21 bp, Artificial Sequence
  Description of Artificial Sequence: Synthetic oligonucleotide
ttgggtgatgggaagccggtt

SEQ ID NO: 12802 - DNA, 21 bp, Artificial Sequence
  Description of Artificial Sequence: Synthetic oligonucleotide
agtggtgtgactggggttgcg

SEQ ID NO: 12803 - DNA, 21 bp, Artificial Sequence
  Description of Artificial Sequence: Synthetic oligonucleotide
gaaagaagcagccccaccagc

SEQ ID NO: 12804 - DNA, 21 bp, Artificial Sequence
  Description of Artificial Sequence: Synthetic oligonucleotide
gatggtacgactcgttctact

SEQ ID NO: 12805 - DNA, 21 bp, Artificial Sequence
  Description of Artificial Sequence: Synthetic oligonucleotide
actacgaataagggggctagt

SEQ ID NO: 12806 - DNA, 21 bp, Artificial Sequence
  Description of Artificial Sequence: Synthetic oligonucleotide
gccggcagcggcaacaccagc

SEQ ID NO: 12807 - DNA, 21 bp, Artificial Sequence
  Description of Artificial Sequence: Synthetic oligonucleotide
caagccggcaacggcagcaaa

SEQ ID NO: 12808 - DNA, 21 bp, Artificial Sequence
  Description of Artificial Sequence: Synthetic oligonucleotide
cagcagggtaagcagtcggtt

SEQ ID NO: 12809 - DNA, 21 bp, Artificial Sequence
  Description of Artificial Sequence: Synthetic oligonucleotide
accaacggcagcaaacccctc

SEQ ID NO: 12810 - DNA, 21 bp, Artificial Sequence
  Description of Artificial Sequence: Synthetic oligonucleotide
accgacagaagcaaaagcccc

SEQ ID NO: 12811 - DNA, 21 bp, Artificial Sequence
  Description of Artificial Sequence: Synthetic oligonucleotide
gataggactgagaagtctaat

SEQ ID NO: 12812 - DNA, 21 bp, Artificial Sequence
  Description of Artificial Sequence: Synthetic oligonucleotide
ggtggtggtcagaagtcttct

SEQ ID NO: 12813 - DNA, 21 bp, Artificial Sequence
  Description of Artificial Sequence: Synthetic oligonucleotide
tcgacgaatagtaagtcggcg

SEQ ID NO: 12814 - DNA, 21 bp, Artificial Sequence
  Description of Artificial Sequence: Synthetic oligonucleotide
agcaacaccaaaagcgccggc

SEQ ID NO: 12815 - DNA, 21 bp, Artificial Sequence
  Description of Artificial Sequence: Synthetic oligonucleotide
caggggactaatgcgacggtt

SEQ ID NO: 12816 - DNA, 21 bp, Artificial Sequence
  Description of Artificial Sequence: Synthetic oligonucleotide
aatacgactagggagagtggt

SEQ ID NO: 12817 - DNA, 21 bp, Artificial Sequence
  Description of Artificial Sequence: Synthetic oligonucleotide
gggtcgggtaagactgctgcg

SEQ ID NO: 12818 - DNA, 21 bp, Artificial Sequence
  Description of Artificial Sequence: Synthetic oligonucleotide
ggcagccaaagccccagcagc

SEQ ID NO: 12819 - DNA, 21 bp, Artificial Sequence
  Description of Artificial Sequence: Synthetic oligonucleotide
gaccaacacagcgccagaaac

SEQ ID NO: 12820 - DNA, 21 bp, Artificial Sequence
  Description of Artificial Sequence: Synthetic oligonucleotide
caggcgactacgaagccgtcg

SEQ ID NO: 12821 - DNA, 21 bp, Artificial Sequence
  Description of Artificial Sequence: Synthetic oligonucleotide
acgactggttctgcggcggtt

SEQ ID NO: 12822 - DNA, 21 bp, Artificial Sequence
  Description of Artificial Sequence: Synthetic oligonucleotide
actacgactaaggctaatgcg

SEQ ID NO: 12823 - DNA, 21 bp, Artificial Sequence
  Description of Artificial Sequence: Synthetic oligonucleotide
agccaaagccaaaccaacagc

SEQ ID NO: 12824 - DNA, 21 bp, Artificial Sequence
  Description of Artificial Sequence: Synthetic oligonucleotide
caaaccagcgaagccggcaga

SEQ ID NO: 12825 - DNA, 21 bp, Artificial Sequence
  Description of Artificial Sequence: Synthetic oligonucleotide
agcagccaacaaagcgccaaa

SEQ ID NO: 12826 - DNA, 21 bp, Artificial Sequence
  Description of Artificial Sequence: Synthetic oligonucleotide
ggtaatggtaagacgcttcag

SEQ ID NO: 12827 - DNA, 21 bp, Artificial Sequence
  Description of Artificial Sequence: Synthetic oligonucleotide
ggtattcctaagggttctcag

SEQ ID NO: 12828 - DNA, 21 bp, Artificial Sequence
  Description of Artificial Sequence: Synthetic oligonucleotide
ggcaccggcggcagcgcccaa

SEQ ID NO: 12829 - DNA, 21 bp, Artificial Sequence
  Description of Artificial Sequence: Synthetic oligonucleotide
agtgcttctcagaaggttcag

SEQ ID NO: 12830 - DNA, 21 bp, Artificial Sequence
  Description of Artificial Sequence: Synthetic oligonucleotide
ggtagtggtcatgatcggact

SEQ ID NO: 12831 - DNA, 21 bp, Artificial Sequence
  Description of Artificial Sequence: Synthetic oligonucleotide
gccaccgacaaaagcagcaaa

SEQ ID NO: 12832 - DNA, 21 bp, Artificial Sequence
  Description of Artificial Sequence: Synthetic oligonucleotide
gaaagaggcgaaagccaaaaa

SEQ ID NO: 12833 - DNA, 21 bp, Artificial Sequence
  Description of Artificial Sequence: Synthetic oligonucleotide
gacaacaccgccagccccaga

SEQ ID NO: 12834 - DNA, 21 bp, Artificial Sequence
  Description of Artificial Sequence: Synthetic oligonucleotide
gcggctggggcgcctggtaag

SEQ ID NO: 12835 - DNA, 21 bp, Artificial Sequence
  Description of Artificial Sequence: Synthetic oligonucleotide
atgactagtagtagtgctaag

SEQ ID NO: 12836 - DNA, 21 bp, Artificial Sequence
  Description of Artificial Sequence: Synthetic oligonucleotide
acgcagtcgtcgcctcctaag

SEQ ID NO: 12837 - DNA, 21 bp, Artificial Sequence
  Description of Artificial Sequence: Synthetic oligonucleotide
gatgggtctacggcgaatcgt

SEQ ID NO: 12838 - DNA, 21 bp, Artificial Sequence
  Description of Artificial Sequence: Synthetic oligonucleotide
caggggagtgctacgactttg

SEQ ID NO: 12839 - DNA, 21 bp, Artificial Sequence
  Description of Artificial Sequence: Synthetic oligonucleotide
caaaacggcagcgacagaacc

SEQ ID NO: 12840 - DNA, 21 bp, Artificial Sequence
  Description of Artificial Sequence: Synthetic oligonucleotide
aacagcgccagcaacgccaaa

SEQ ID NO: 12841 - DNA, 21 bp, Artificial Sequence
  Description of Artificial Sequence: Synthetic oligonucleotide
caaaccagcaaaaccgccagc

SEQ ID NO: 12842 - DNA, 21 bp, Artificial Sequence
  Description of Artificial Sequence: Synthetic oligonucleotide
caaaacggcaacggccacaga

SEQ ID NO: 12843 - DNA, 21 bp, Artificial Sequence
  Description of Artificial Sequence: Synthetic oligonucleotide
ggcagcggcaccagcgccgtc

SEQ ID NO: 12844 - DNA, 21 bp, Artificial Sequence
  Description of Artificial Sequence: Synthetic oligonucleotide
ggcaacacccccagcagcgtc

SEQ ID NO: 12845 - DNA, 21 bp, Artificial Sequence
  Description of Artificial Sequence: Synthetic oligonucleotide
ggcacccaaaaagaaaacacc

SEQ ID NO: 12846 - DNA, 21 bp, Artificial Sequence
  Description of Artificial Sequence: Synthetic oligonucleotide
gcgcgtgattcttcggttctg

SEQ ID NO: 12847 - DNA, 21 bp, Artificial Sequence
  Description of Artificial Sequence: Synthetic oligonucleotide
gaaggcaacagcaaccacacc

SEQ ID NO: 12848 - DNA, 21 bp, Artificial Sequence
  Description of Artificial Sequence: Synthetic oligonucleotide
ggtactggttcgaagccgtcg

SEQ ID NO: 12849 - DNA, 21 bp, Artificial Sequence
  Description of Artificial Sequence: Synthetic oligonucleotide
gccaccggcagcaccaacaac

SEQ ID NO: 12850 - DNA, 21 bp, Artificial Sequence
  Description of Artificial Sequence: Synthetic oligonucleotide
ggtgggtctcgtccgtctgag

SEQ ID NO: 12851 - DNA, 21 bp, Artificial Sequence
  Description of Artificial Sequence: Synthetic oligonucleotide
cttggttctaagactagtgcg

SEQ ID NO: 12852 - DNA, 21 bp, Artificial Sequence
  Description of Artificial Sequence: Synthetic oligonucleotide
ggccaaaacagcaaacccgcc

SEQ ID NO: 12853 - DNA, 21 bp, Artificial Sequence
  Description of Artificial Sequence: Synthetic oligonucleotide
tcgactaatacgaagagtact

SEQ ID NO: 12854 - DNA, 21 bp, Artificial Sequence
  Description of Artificial Sequence: Synthetic oligonucleotide
caaggcaccagcaacggcagc

SEQ ID NO: 12855 - DNA, 21 bp, Artificial Sequence
  Description of Artificial Sequence: Synthetic oligonucleotide
caagccaacgacaaaatgggc

SEQ ID NO: 12856 - DNA, 21 bp, Artificial Sequence
  Description of Artificial Sequence: Synthetic oligonucleotide
agaaacggcaacgaagtcaaa

SEQ ID NO: 12857 - DNA, 21 bp, Artificial Sequence
  Description of Artificial Sequence: Synthetic oligonucleotide
agcgcccccggcagcagcaaa

SEQ ID NO: 12858 - DNA, 21 bp, Artificial Sequence
  Description of Artificial Sequence: Synthetic oligonucleotide
accgccagcagcaaacacgaa

SEQ ID NO: 12859 - DNA, 21 bp, Artificial Sequence
  Description of Artificial Sequence: Synthetic oligonucleotide
gggggtggtgataagagtaag

SEQ ID NO: 12860 - DNA, 21 bp, Artificial Sequence
  Description of Artificial Sequence: Synthetic oligonucleotide
agtgggggtgcgcatccgtct

SEQ ID NO: 12861 - DNA, 21 bp, Artificial Sequence
  Description of Artificial Sequence: Synthetic oligonucleotide
acttcgggtacgaataatgtt

SEQ ID NO: 12862 - DNA, 21 bp, Artificial Sequence
  Description of Artificial Sequence: Synthetic oligonucleotide
tcgacggcttcgactccgtcg

SEQ ID NO: 12863 - DNA, 21 bp, Artificial Sequence
  Description of Artificial Sequence: Synthetic oligonucleotide
cagggtacgggttcgactact

SEQ ID NO: 12864 - DNA, 21 bp, Artificial Sequence
  Description of Artificial Sequence: Synthetic oligonucleotide
cagggtgggggttctcctacg

SEQ ID NO: 12865 - DNA, 21 bp, Artificial Sequence
  Description of Artificial Sequence: Synthetic oligonucleotide
gaagccggcagcaaaagccaa

SEQ ID NO: 12866 - DNA, 21 bp, Artificial Sequence
  Description of Artificial Sequence: Synthetic oligonucleotide
gggggtaatggtaaggatcgg

SEQ ID NO: 12867 - DNA, 21 bp, Artificial Sequence
  Description of Artificial Sequence: Synthetic oligonucleotide
gtcagcggcaacggcaacagc

SEQ ID NO: 12868 - DNA, 21 bp, Artificial Sequence
  Description of Artificial Sequence: Synthetic oligonucleotide
ggccaaggcaaagacaaaagc

SEQ ID NO: 12869 - DNA, 21 bp, Artificial Sequence
  Description of Artificial Sequence: Synthetic oligonucleotide
acgtcgtcttcgcctcatact

SEQ ID NO: 12870 - DNA, 21 bp, Artificial Sequence
  Description of Artificial Sequence: Synthetic oligonucleotide
gacagcagcagcagcaacaga

SEQ ID NO: 12871 - DNA, 21 bp, Artificial Sequence
  Description of Artificial Sequence: Synthetic oligonucleotide
gacggccaaaaaggcgccagc

SEQ ID NO: 12872 - DNA, 21 bp, Artificial Sequence
  Description of Artificial Sequence: Synthetic oligonucleotide
agtcagactaagagttctaat

SEQ ID NO: 12873 - DNA, 21 bp, Artificial Sequence
  Description of Artificial Sequence: Synthetic oligonucleotide
agtagtacggggaagtctgtg

SEQ ID NO: 12874 - DNA, 21 bp, Artificial Sequence
  Description of Artificial Sequence: Synthetic oligonucleotide
accaccaaaagccaagcccaa

SEQ ID NO: 12875 - DNA, 21 bp, Artificial Sequence
  Description of Artificial Sequence: Synthetic oligonucleotide
agcggcaacaaaagcagccaa

SEQ ID NO: 12876 - DNA, 21 bp, Artificial Sequence
  Description of Artificial Sequence: Synthetic oligonucleotide
agcggcagaaccggcgccggc

SEQ ID NO: 12877 - DNA, 21 bp, Artificial Sequence
  Description of Artificial Sequence: Synthetic oligonucleotide
gatagttctacgaagcctatg

SEQ ID NO: 12878 - DNA, 21 bp, Artificial Sequence
  Description of Artificial Sequence: Synthetic oligonucleotide
acgtcttcgcctcagtctaag

SEQ ID NO: 12879 - DNA, 21 bp, Artificial Sequence
  Description of Artificial Sequence: Synthetic oligonucleotide
actactagtactactcctaag

SEQ ID NO: 12880 - DNA, 21 bp, Artificial Sequence
  Description of Artificial Sequence: Synthetic oligonucleotide
aatagttctgataaggggaag

SEQ ID NO: 12881 - DNA, 21 bp, Artificial Sequence
  Description of Artificial Sequence: Synthetic oligonucleotide
ggtactcaggggactggtacg

SEQ ID NO: 12882 - DNA, 21 bp, Artificial Sequence
  Description of Artificial Sequence: Synthetic oligonucleotide
gagcatgagggtaagcctatt

SEQ ID NO: 12883 - DNA, 21 bp, Artificial Sequence
  Description of Artificial Sequence: Synthetic oligonucleotide
agcgccgtcagcagcaacaaa

SEQ ID NO: 12884 - DNA, 21 bp, Artificial Sequence
  Description of Artificial Sequence: Synthetic oligonucleotide
gccgacgccaacaaacaaagc

SEQ ID NO: 12885 - DNA, 21 bp, Artificial Sequence
  Description of Artificial Sequence: Synthetic oligonucleotide
gaccaagtcaacaaacccgtc

SEQ ID NO: 12886 - DNA, 21 bp, Artificial Sequence
  Description of Artificial Sequence: Synthetic oligonucleotide
gaggggactacgccttcgagg

SEQ ID NO: 12887 - DNA, 21 bp, Artificial Sequence
  Description of Artificial Sequence: Synthetic oligonucleotide
ggcggcgccaaaagcagcgaa

SEQ ID NO: 12888 - DNA, 21 bp, Artificial Sequence
  Description of Artificial Sequence: Synthetic oligonucleotide
agcggcgccggcaccgccacc

SEQ ID NO: 12889 - DNA, 21 bp, Artificial Sequence
  Description of Artificial Sequence: Synthetic oligonucleotide
gaggggcataagggtgctggt

SEQ ID NO: 12890 - DNA, 21 bp, Artificial Sequence
  Description of Artificial Sequence: Synthetic oligonucleotide
agcagcaacaccagcaccgcc

SEQ ID NO: 12891 - DNA, 21 bp, Artificial Sequence
  Description of Artificial Sequence: Synthetic oligonucleotide
agcaccagcagcaaaagccaa

SEQ ID NO: 12892 - DNA, 21 bp, Artificial Sequence
  Description of Artificial Sequence: Synthetic oligonucleotide
gccagcagcaaacccggcgtc

SEQ ID NO: 12893 - DNA, 21 bp, Artificial Sequence
  Description of Artificial Sequence: Synthetic oligonucleotide
gaggggtcgaagactagttcg

SEQ ID NO: 12894 - DNA, 21 bp, Artificial Sequence
  Description of Artificial Sequence: Synthetic oligonucleotide
gatggggtgtctaagacgagg

SEQ ID NO: 12895 - DNA, 21 bp, Artificial Sequence
  Description of Artificial Sequence: Synthetic oligonucleotide
ggtgcgggttcgagtagtaag

SEQ ID NO: 12896 - DNA, 21 bp, Artificial Sequence
  Description of Artificial Sequence: Synthetic oligonucleotide
ggggggacgtcgaagagtagt

SEQ ID NO: 12897 - DNA, 21 bp, Artificial Sequence
  Description of Artificial Sequence: Synthetic oligonucleotide
ctcggcagcagcaaaaacgtc

SEQ ID NO: 12898 - DNA, 21 bp, Artificial Sequence
  Description of Artificial Sequence: Synthetic oligonucleotide
aattcgtcggggaagtcgtct

SEQ ID NO: 12899 - DNA, 21 bp, Artificial Sequence
  Description of Artificial Sequence: Synthetic oligonucleotide
actgggatgaaggatgcgaag

SEQ ID NO: 12900 - DNA, 21 bp, Artificial Sequence
  Description of Artificial Sequence: Synthetic oligonucleotide
gccgaccacggcaaagtcacc

SEQ ID NO: 12901 - DNA, 21 bp, Artificial Sequence
  Description of Artificial Sequence: Synthetic oligonucleotide
ggtgctgaggggtctgtgaag

SEQ ID NO: 12902 - DNA, 21 bp, Artificial Sequence
  Description of Artificial Sequence: Synthetic oligonucleotide
cagggttcttcgcaggtgact

SEQ ID NO: 12903 - DNA, 21 bp, Artificial Sequence
  Description of Artificial Sequence: Synthetic oligonucleotide
aattctaagacgggtagtgcg

SEQ ID NO: 12904 - DNA, 21 bp, Artificial Sequence
  Description of Artificial Sequence: Synthetic oligonucleotide
accagcgacagagtcagcacc

SEQ ID NO: 12905 - DNA, 21 bp, Artificial Sequence
  Description of Artificial Sequence: Synthetic oligonucleotide
accggcgaaagaaaactcgaa

SEQ ID NO: 12906 - DNA, 21 bp, Artificial Sequence
  Description of Artificial Sequence: Synthetic oligonucleotide
acgcctacgcagacgccggtg

SEQ ID NO: 12907 - DNA, 21 bp, Artificial Sequence
  Description of Artificial Sequence: Synthetic oligonucleotide
agtgggaatacgagtaatcat

SEQ ID NO: 12908 - DNA, 21 bp, Artificial Sequence
  Description of Artificial Sequence: Synthetic oligonucleotide
gggggtgcgaatgagcggagt

SEQ ID NO: 12909 - DNA, 21 bp, Artificial Sequence
  Description of Artificial Sequence: Synthetic oligonucleotide
accggcagccaaagcatgcaa

SEQ ID NO: 12910 - DNA, 21 bp, Artificial Sequence
  Description of Artificial Sequence: Synthetic oligonucleotide
cacggcaccgaaagagccagc

SEQ ID NO: 12911 - DNA, 21 bp, Artificial Sequence
  Description of Artificial Sequence: Synthetic oligonucleotide
caaagcgacaccggcaacaaa

SEQ ID NO: 12912 - DNA, 21 bp, Artificial Sequence
  Description of Artificial Sequence: Synthetic oligonucleotide
ggcgccggcgaaagaagcaaa

SEQ ID NO: 12913 - DNA, 21 bp, Artificial Sequence
  Description of Artificial Sequence: Synthetic oligonucleotide
actggtgggcagacttctacg

SEQ ID NO: 12914 - DNA, 21 bp, Artificial Sequence
  Description of Artificial Sequence: Synthetic oligonucleotide
ggcgaaaccagaacccaaagc

SEQ ID NO: 12915 - DNA, 21 bp, Artificial Sequence
  Description of Artificial Sequence: Synthetic oligonucleotide
agtggtgcgaatcatcctagt

SEQ ID NO: 12916 - DNA, 21 bp, Artificial Sequence
  Description of Artificial Sequence: Synthetic oligonucleotide
ggtgcttctaagggttcggat

SEQ ID NO: 12917 - DNA, 21 bp, Artificial Sequence
  Description of Artificial Sequence: Synthetic oligonucleotide
gcccaaaccagcaaaaccgaa

SEQ ID NO: 12918 - DNA, 21 bp, Artificial Sequence
  Description of Artificial Sequence: Synthetic oligonucleotide
ggttctgggtcgcctactcgg

SEQ ID NO: 12919 - DNA, 21 bp, Artificial Sequence
  Description of Artificial Sequence: Synthetic oligonucleotide
ggcctcagcaaacccagcagc

SEQ ID NO: 12920 - DNA, 21 bp, Artificial Sequence
  Description of Artificial Sequence: Synthetic oligonucleotide
ggtacgacgacgcgtgatggg

SEQ ID NO: 12921 - DNA, 21 bp, Artificial Sequence
  Description of Artificial Sequence: Synthetic oligonucleotide
caaggccaaaccaaacccagc

SEQ ID NO: 12922 - DNA, 21 bp, Artificial Sequence
  Description of Artificial Sequence: Synthetic oligonucleotide
ggcgccgacaaaaacgtcaga

SEQ ID NO: 12923 - DNA, 21 bp, Artificial Sequence
  Description of Artificial Sequence: Synthetic oligonucleotide
agttctagtcctcagagggtg

SEQ ID NO: 12924 - DNA, 21 bp, Artificial Sequence
  Description of Artificial Sequence: Synthetic oligonucleotide
ggtaatgctggttcggttaag

SEQ ID NO: 12925 - DNA, 21 bp, Artificial Sequence
  Description of Artificial Sequence: Synthetic oligonucleotide
aatacggggcagcatgctact

SEQ ID NO: 12926 - DNA, 21 bp, Artificial Sequence
  Description of Artificial Sequence: Synthetic oligonucleotide
ggccaaggcagccccaaagcc

SEQ ID NO: 12927 - DNA, 21 bp, Artificial Sequence
  Description of Artificial Sequence: Synthetic oligonucleotide
caaggcgacaaacacagcacc

SEQ ID NO: 12928 - DNA, 21 bp, Artificial Sequence
  Description of Artificial Sequence: Synthetic oligonucleotide
ggcaccggcaccaaacaagtc

SEQ ID NO: 12929 - DNA, 21 bp, Artificial Sequence
  Description of Artificial Sequence: Synthetic oligonucleotide
aactgttctggacagaatcaa

SEQ ID NO: 12930 - DNA, 21 bp, Artificial Sequence
  Description of Artificial Sequence: Synthetic oligonucleotide
ctgactgcgaaggggactaat

SEQ ID NO: 12931 - DNA, 21 bp, Artificial Sequence
  Description of Artificial Sequence: Synthetic oligonucleotide
cgttcgtctaaggaggctggg

SEQ ID NO: 12932 - DNA, 21 bp, Artificial Sequence
  Description of Artificial Sequence: Synthetic oligonucleotide
tctggggcttcgcctagttct

SEQ ID NO: 12933 - DNA, 21 bp, Artificial Sequence
  Description of Artificial Sequence: Synthetic oligonucleotide
gggaaggattcgaagcctttt

SEQ ID NO: 12934 - DNA, 21 bp, Artificial Sequence
  Description of Artificial Sequence: Synthetic oligonucleotide
gggaatgctaagagtgcgctt

SEQ ID NO: 12935 - DNA, 21 bp, Artificial Sequence
  Description of Artificial Sequence: Synthetic oligonucleotide
gacggcagccaaaaattcagc

SEQ ID NO: 12936 - DNA, 21 bp, Artificial Sequence
  Description of Artificial Sequence: Synthetic oligonucleotide
gaccccagcacccaacccaaa

SEQ ID NO: 12937 - DNA, 21 bp, Artificial Sequence
  Description of Artificial Sequence: Synthetic oligonucleotide
ggtggtactccgtctttgggt

SEQ ID NO: 12938 - DNA, 21 bp, Artificial Sequence
  Description of Artificial Sequence: Synthetic oligonucleotide
atgagcagaagccccaccgaa

SEQ ID NO: 12939 - DNA, 21 bp, Artificial Sequence
  Description of Artificial Sequence: Synthetic oligonucleotide
tctaatggtaattcgcctcgt

SEQ ID NO: 12940 - DNA, 21 bp, Artificial Sequence
  Description of Artificial Sequence: Synthetic oligonucleotide
agcaccaccgcccccccccaa

SEQ ID NO: 12941 - DNA, 21 bp, Artificial Sequence
  Description of Artificial Sequence: Synthetic oligonucleotide
accgtcagcgccaaccaaaaa

SEQ ID NO: 12942 - DNA, 21 bp, Artificial Sequence
  Description of Artificial Sequence: Synthetic oligonucleotide
agtcaggggaagggttctttg

SEQ ID NO: 12943 - DNA, 21 bp, Artificial Sequence
  Description of Artificial Sequence: Synthetic oligonucleotide
gtcggcaccggcaaagacggc

SEQ ID NO: 12944 - DNA, 21 bp, Artificial Sequence
  Description of Artificial Sequence: Synthetic oligonucleotide
ggcagcggcaacaaaaccacc

SEQ ID NO: 12945 - DNA, 21 bp, Artificial Sequence
  Description of Artificial Sequence: Synthetic oligonucleotide
aattcgggtggtggtgctaag

SEQ ID NO: 12946 - DNA, 21 bp, Artificial Sequence
  Description of Artificial Sequence: Synthetic oligonucleotide
agcggcagcaaaagcctcggc

SEQ ID NO: 12947 - DNA, 21 bp, Artificial Sequence
  Description of Artificial Sequence: Synthetic oligonucleotide
tctgggggttcgaaggggtct

SEQ ID NO: 12948 - DNA, 21 bp, Artificial Sequence
  Description of Artificial Sequence: Synthetic oligonucleotide
gtcggcgaacaaagaggcacc

SEQ ID NO: 12949 - DNA, 21 bp, Artificial Sequence
  Description of Artificial Sequence: Synthetic oligonucleotide
cggagtgatggtaagatggct

SEQ ID NO: 12950 - DNA, 21 bp, Artificial Sequence
  Description of Artificial Sequence: Synthetic oligonucleotide
agtaaggggtctagtaatgag

SEQ ID NO: 12951 - DNA, 21 bp, Artificial Sequence
  Description of Artificial Sequence: Synthetic oligonucleotide
gggagggatgggaagcctacg

SEQ ID NO: 12952 - DNA, 21 bp, Artificial Sequence
  Description of Artificial Sequence: Synthetic oligonucleotide
agcggcggcacccccagcaac

SEQ ID NO: 12953 - DNA, 21 bp, Artificial Sequence
  Description of Artificial Sequence: Synthetic oligonucleotide
tcgagttctacgaaggctgtt

SEQ ID NO: 12954 - DNA, 21 bp, Artificial Sequence
  Description of Artificial Sequence: Synthetic oligonucleotide
aggtcgcagaagccgagtgag

SEQ ID NO: 12955 - DNA, 21 bp, Artificial Sequence
  Description of Artificial Sequence: Synthetic oligonucleotide
agtcagcctgatcctaggact

SEQ ID NO: 12956 - DNA, 21 bp, Artificial Sequence
  Description of Artificial Sequence: Synthetic oligonucleotide
gatcgtagggaggcgagtacg

SEQ ID NO: 12957 - DNA, 21 bp, Artificial Sequence
  Description of Artificial Sequence: Synthetic oligonucleotide
gaccaaagcggcaccaccaga

SEQ ID NO: 12958 - DNA, 21 bp, Artificial Sequence
  Description of Artificial Sequence: Synthetic oligonucleotide
agtagtgataagggtaggaat

SEQ ID NO: 12959 - DNA, 21 bp, Artificial Sequence
  Description of Artificial Sequence: Synthetic oligonucleotide
aaaggcgccagccacaacgaa

SEQ ID NO: 12960 - DNA, 21 bp, Artificial Sequence
  Description of Artificial Sequence: Synthetic oligonucleotide
agttcttcgaagcaggctcag

SEQ ID NO: 12961 - DNA, 21 bp, Artificial Sequence
  Description of Artificial Sequence: Synthetic oligonucleotide
cagatggagaagtctaatagt

SEQ ID NO: 12962 - DNA, 21 bp, Artificial Sequence
  Description of Artificial Sequence: Synthetic oligonucleotide
gctgcggcgtcgcagagtagt

SEQ ID NO: 12963 - DNA, 21 bp, Artificial Sequence
  Description of Artificial Sequence: Synthetic oligonucleotide
accagaaaccaaaccagcagc

SEQ ID NO: 12964 - DNA, 21 bp, Artificial Sequence
  Description of Artificial Sequence: Synthetic oligonucleotide
gacaccagccacaaagccagc

SEQ ID NO: 12965 - DNA, 21 bp, Artificial Sequence
  Description of Artificial Sequence: Synthetic oligonucleotide
gattctaatactaagatggtt

SEQ ID NO: 12966 - DNA, 21 bp, Artificial Sequence
  Description of Artificial Sequence: Synthetic oligonucleotide
tctgtgtctacgggtaataag

SEQ ID NO: 12967 - DNA, 21 bp, Artificial Sequence
  Description of Artificial Sequence: Synthetic oligonucleotide
cacgccggcaacaacaacgcc

SEQ ID NO: 12968 - DNA, 21 bp, Artificial Sequence
  Description of Artificial Sequence: Synthetic oligonucleotide
tctacgggtagtccgggtaat

SEQ ID NO: 12969 - DNA, 21 bp, Artificial Sequence
  Description of Artificial Sequence: Synthetic oligonucleotide
gatcatccttctgggaagcat

SEQ ID NO: 12970 - DNA, 21 bp, Artificial Sequence
  Description of Artificial Sequence: Synthetic oligonucleotide
gataatactaaggctgggatg

SEQ ID NO: 12971 - DNA, 21 bp, Artificial Sequence
  Description of Artificial Sequence: Synthetic oligonucleotide
caggggagtagtaagatgact

SEQ ID NO: 12972 - DNA, 21 bp, Artificial Sequence
  Description of Artificial Sequence: Synthetic oligonucleotide
gaaaacagaagcaccagcgtc

SEQ ID NO: 12973 - DNA, 21 bp, Artificial Sequence
  Description of Artificial Sequence: Synthetic oligonucleotide
agtggggataggggggtgcag

SEQ ID NO: 12974 - DNA, 21 bp, Artificial Sequence
  Description of Artificial Sequence: Synthetic oligonucleotide
aacagcgaagccacccccaga

SEQ ID NO: 12975 - DNA, 21 bp, Artificial Sequence
  Description of Artificial Sequence: Synthetic oligonucleotide
atgggtacggagcgtaatgtt

SEQ ID NO: 12976 - DNA, 21 bp, Artificial Sequence
  Description of Artificial Sequence: Synthetic oligonucleotide
ggcggcaccagcagccccacc

SEQ ID NO: 12977 - DNA, 21 bp, Artificial Sequence
  Description of Artificial Sequence: Synthetic oligonucleotide
gctgtgggttctaagtcgaat

SEQ ID NO: 12978 - DNA, 21 bp, Artificial Sequence
  Description of Artificial Sequence: Synthetic oligonucleotide
gcgggtacgaataaggcttct

SEQ ID NO: 12979 - DNA, 21 bp, Artificial Sequence
  Description of Artificial Sequence: Synthetic oligonucleotide
agtactgggaagactaatact

SEQ ID NO: 12980 - DNA, 21 bp, Artificial Sequence
  Description of Artificial Sequence: Synthetic oligonucleotide
gaccccagcaaaaccgccctc

SEQ ID NO: 12981 - DNA, 21 bp, Artificial Sequence
  Description of Artificial Sequence: Synthetic oligonucleotide
ggcaccagcggcaaaagcatc

SEQ ID NO: 12982 - DNA, 21 bp, Artificial Sequence
  Description of Artificial Sequence: Synthetic oligonucleotide
ggtagtgggtctcctattaag

SEQ ID NO: 12983 - DNA, 21 bp, Artificial Sequence
  Description of Artificial Sequence: Synthetic oligonucleotide
ggtgggtctcagacgaagatt

SEQ ID NO: 12984 - DNA, 21 bp, Artificial Sequence
  Description of Artificial Sequence: Synthetic oligonucleotide
aacaccggcaccagcgccaga

SEQ ID NO: 12985 - DNA, 21 bp, Artificial Sequence
  Description of Artificial Sequence: Synthetic oligonucleotide
accggcaacaccagccaaagc

SEQ ID NO: 12986 - DNA, 21 bp, Artificial Sequence
  Description of Artificial Sequence: Synthetic oligonucleotide
ggcagaggcagcggcagcagc

SEQ ID NO: 12987 - DNA, 21 bp, Artificial Sequence
  Description of Artificial Sequence: Synthetic oligonucleotide
tcgggggagcgtaatccggtt

SEQ ID NO: 12988 - DNA, 21 bp, Artificial Sequence
  Description of Artificial Sequence: Synthetic oligonucleotide
gaaagcaaacccagcagcgtc

SEQ ID NO: 12989 - DNA, 21 bp, Artificial Sequence
  Description of Artificial Sequence: Synthetic oligonucleotide
accaccagcggcaaacccccc

SEQ ID NO: 12990 - DNA, 21 bp, Artificial Sequence
  Description of Artificial Sequence: Synthetic oligonucleotide
gggaatgggcatgctccgact

SEQ ID NO: 12991 - DNA, 21 bp, Artificial Sequence
  Description of Artificial Sequence: Synthetic oligonucleotide
agccaagccagcaaacccatc

SEQ ID NO: 12992 - DNA, 21 bp, Artificial Sequence
  Description of Artificial Sequence: Synthetic oligonucleotide
caaggcgacagcaacgccaga

SEQ ID NO: 12993 - DNA, 21 bp, Artificial Sequence
  Description of Artificial Sequence: Synthetic oligonucleotide
ttccccgccaccaaacaaggc

SEQ ID NO: 12994 - DNA, 21 bp, Artificial Sequence
  Description of Artificial Sequence: Synthetic oligonucleotide
gggtctgctgcgagtgttaag

SEQ ID NO: 12995 - DNA, 21 bp, Artificial Sequence
  Description of Artificial Sequence: Synthetic oligonucleotide
actggtgcgggtgggactgct

SEQ ID NO: 12996 - DNA, 21 bp, Artificial Sequence
  Description of Artificial Sequence: Synthetic oligonucleotide
caacaaaccggccccacccac

SEQ ID NO: 12997 - DNA, 21 bp, Artificial Sequence
  Description of Artificial Sequence: Synthetic oligonucleotide
accagagaaggcaaaggcatc

SEQ ID NO: 12998 - DNA, 21 bp, Artificial Sequence
  Description of Artificial Sequence: Synthetic oligonucleotide
agcagcaccaccaccggcggc

SEQ ID NO: 12999 - DNA, 21 bp, Artificial Sequence
  Description of Artificial Sequence: Synthetic oligonucleotide
ggtcagggtaatagtacgaag

SEQ ID NO: 13000 - DNA, 21 bp, Artificial Sequence
  Description of Artificial Sequence: Synthetic oligonucleotide
gggagtatgtctcctagtcgt

SEQ ID NO: 13001 - DNA, 21 bp, Artificial Sequence
  Description of Artificial Sequence: Synthetic oligonucleotide
agcagccaaaccaccgccaaa

SEQ ID NO: 13002 - DNA, 21 bp, Artificial Sequence
  Description of Artificial Sequence: Synthetic oligonucleotide
ggcaacggcggcagcaacaga

SEQ ID NO: 13003 - DNA, 21 bp, Artificial Sequence
  Description of Artificial Sequence: Synthetic oligonucleotide
aacagcggcaaaagccccgtc

SEQ ID NO: 13004 - DNA, 21 bp, Artificial Sequence
  Description of Artificial Sequence: Synthetic oligonucleotide
ggtgataataagtcgtcttat

SEQ ID NO: 13005 - DNA, 21 bp, Artificial Sequence
  Description of Artificial Sequence: Synthetic oligonucleotide
gagggtaagtctgatcatgcg

SEQ ID NO: 13006 - DNA, 21 bp, Artificial Sequence
  Description of Artificial Sequence: Synthetic oligonucleotide
aataatggtgcgaaggctggg

SEQ ID NO: 13007 - DNA, 21 bp, Artificial Sequence
  Description of Artificial Sequence: Synthetic oligonucleotide
ggcagcaaacccggcaccagc

SEQ ID NO: 13008 - DNA, 21 bp, Artificial Sequence
  Description of Artificial Sequence: Synthetic oligonucleotide
gctcagactaagtcttcggtt

SEQ ID NO: 13009 - DNA, 21 bp, Artificial Sequence
  Description of Artificial Sequence: Synthetic oligonucleotide
tcgacggggtcgcatccggcg

SEQ ID NO: 13010 - DNA, 21 bp, Artificial Sequence
  Description of Artificial Sequence: Synthetic oligonucleotide
agcatgagcagcaaaagcgcc

SEQ ID NO: 13011 - DNA, 21 bp, Artificial Sequence
  Description of Artificial Sequence: Synthetic oligonucleotide
gttagtacttcgaaggcgggt

SEQ ID NO: 13012 - DNA, 21 bp, Artificial Sequence
  Description of Artificial Sequence: Synthetic oligonucleotide
accagcggcaccgccaacagc

SEQ ID NO: 13013 - DNA, 21 bp, Artificial Sequence
  Description of Artificial Sequence: Synthetic oligonucleotide
attggtggttctgggtctgcg

SEQ ID NO: 13014 - DNA, 21 bp, Artificial Sequence
  Description of Artificial Sequence: Synthetic oligonucleotide
ggtcagaataagggggcgagt

SEQ ID NO: 13015 - DNA, 21 bp, Artificial Sequence
  Description of Artificial Sequence: Synthetic oligonucleotide
gacagagccggcagcagcgtc

SEQ ID NO: 13016 - DNA, 21 bp, Artificial Sequence
  Description of Artificial Sequence: Synthetic oligonucleotide
gaaggcagaggcaccagcagc

SEQ ID NO: 13017 - DNA, 21 bp, Artificial Sequence
  Description of Artificial Sequence: Synthetic oligonucleotide
cacagcagcagcaaaagcagc

SEQ ID NO: 13018 - DNA, 21 bp, Artificial Sequence
  Description of Artificial Sequence: Synthetic oligonucleotide
actaattctcagacgcatggg

SEQ ID NO: 13019 - DNA, 21 bp, Artificial Sequence
  Description of Artificial Sequence: Synthetic oligonucleotide
aatggtggtaagccgaatgct

SEQ ID NO: 13020 - DNA, 21 bp, Artificial Sequence
  Description of Artificial Sequence: Synthetic oligonucleotide
aacggcgccagcaaaagcagc

SEQ ID NO: 13021 - DNA, 21 bp, Artificial Sequence
  Description of Artificial Sequence: Synthetic oligonucleotide
caaaccggcgaaaaagccaga

SEQ ID NO: 13022 - DNA, 21 bp, Artificial Sequence
  Description of Artificial Sequence: Synthetic oligonucleotide
gatgatacgaagagtaatagt

SEQ ID NO: 13023 - DNA, 21 bp, Artificial Sequence
  Description of Artificial Sequence: Synthetic oligonucleotide
gtccaaggcaaccccatcagc

SEQ ID NO: 13024 - DNA, 21 bp, Artificial Sequence
  Description of Artificial Sequence: Synthetic oligonucleotide
agcaaaagcaccacccccacc

SEQ ID NO: 13025 - DNA, 21 bp, Artificial Sequence
  Description of Artificial Sequence: Synthetic oligonucleotide
agttcgaatggggttatgaag

SEQ ID NO: 13026 - DNA, 21 bp, Artificial Sequence
  Description of Artificial Sequence: Synthetic oligonucleotide
gcggggtcgaagggtaaggat

SEQ ID NO: 13027 - DNA, 21 bp, Artificial Sequence
  Description of Artificial Sequence: Synthetic oligonucleotide
gatcctgataagtctaggtcg

SEQ ID NO: 13028 - DNA, 21 bp, Artificial Sequence
  Description of Artificial Sequence: Synthetic oligonucleotide
agccccagcggcgaccacaga

SEQ ID NO: 13029 - DNA, 21 bp, Artificial Sequence
  Description of Artificial Sequence: Synthetic oligonucleotide
ttgccgacggctaattctagt

SEQ ID NO: 13030 - DNA, 21 bp, Artificial Sequence
  Description of Artificial Sequence: Synthetic oligonucleotide
agcagcgaccaagccagagcc

SEQ ID NO: 13031 - DNA, 21 bp, Artificial Sequence
  Description of Artificial Sequence: Synthetic oligonucleotide
agtggtgttaatactccgacg

SEQ ID NO: 13032 - DNA, 21 bp, Artificial Sequence
  Description of Artificial Sequence: Synthetic oligonucleotide
agttcgggtcgtgaggcttct

SEQ ID NO: 13033 - DNA, 21 bp, Artificial Sequence
  Description of Artificial Sequence: Synthetic oligonucleotide
gggagttctaagggtccgagt

SEQ ID NO: 13034 - DNA, 21 bp, Artificial Sequence
  Description of Artificial Sequence: Synthetic oligonucleotide
ggtgggtcggggagtgttaag

SEQ ID NO: 13035 - DNA, 21 bp, Artificial Sequence
  Description of Artificial Sequence: Synthetic oligonucleotide
ggcgaacacaaacccagcaac

SEQ ID NO: 13036 - DNA, 21 bp, Artificial Sequence
  Description of Artificial Sequence: Synthetic oligonucleotide
ctcagcgccaaagaaggcagc

SEQ ID NO: 13037 - DNA, 21 bp, Artificial Sequence
  Description of Artificial Sequence: Synthetic oligonucleotide
atgagcagcggcagccaaggc

SEQ ID NO: 13038 - DNA, 21 bp, Artificial Sequence
  Description of Artificial Sequence: Synthetic oligonucleotide
cacaacaacagcaaagtcgaa

SEQ ID NO: 13039 - DNA, 21 bp, Artificial Sequence
  Description of Artificial Sequence: Synthetic oligonucleotide
acgagtggtccggcgttgaag

SEQ ID NO: 13040 - DNA, 21 bp, Artificial Sequence
  Description of Artificial Sequence: Synthetic oligonucleotide
cttgatagtaagcctgttcat

SEQ ID NO: 13041 - DNA, 21 bp, Artificial Sequence
  Description of Artificial Sequence: Synthetic oligonucleotide
tccggtcttaaggatcaggct

SEQ ID NO: 13042 - DNA, 21 bp, Artificial Sequence
  Description of Artificial Sequence: Synthetic oligonucleotide
gtcaacaacaccaaaaacgtc

SEQ ID NO: 13043 - DNA, 21 bp, Artificial Sequence
  Description of Artificial Sequence: Synthetic oligonucleotide
ggcggcgccaccgccaccaga

SEQ ID NO: 13044 - DNA, 21 bp, Artificial Sequence
  Description of Artificial Sequence: Synthetic oligonucleotide
ggcagcagcggcagccccagc

SEQ ID NO: 13045 - DNA, 21 bp, Artificial Sequence
  Description of Artificial Sequence: Synthetic oligonucleotide
actcggggtggtagttctact

SEQ ID NO: 13046 - DNA, 21 bp, Artificial Sequence
  Description of Artificial Sequence: Synthetic oligonucleotide
gtcggcaccacccacctcagc

SEQ ID NO: 13047 - DNA, 21 bp, Artificial Sequence
  Description of Artificial Sequence: Synthetic oligonucleotide
gatgggggtgctagtaataag

SEQ ID NO: 13048 - DNA, 21 bp, Artificial Sequence
  Description of Artificial Sequence: Synthetic oligonucleotide
aaaagcgccacccccagcaac

SEQ ID NO: 13049 - DNA, 21 bp, Artificial Sequence
  Description of Artificial Sequence: Synthetic oligonucleotide
gggacgattgataaggggcat

SEQ ID NO: 13050 - DNA, 21 bp, Artificial Sequence
  Description of Artificial Sequence: Synthetic oligonucleotide
aaagaccaaagccccacccac

SEQ ID NO: 13051 - DNA, 21 bp, Artificial Sequence
  Description of Artificial Sequence: Synthetic oligonucleotide
accagaagccaaaccagcgtc

SEQ ID NO: 13052 - DNA, 21 bp, Artificial Sequence
  Description of Artificial Sequence: Synthetic oligonucleotide
accagagaaaacaaaagcctc

SEQ ID NO: 13053 - DNA, 21 bp, Artificial Sequence
  Description of Artificial Sequence: Synthetic oligonucleotide
gagcctggttcgcataagaat

SEQ ID NO: 13054 - DNA, 21 bp, Artificial Sequence
  Description of Artificial Sequence: Synthetic oligonucleotide
gttgggcagtcgtcttcgaat

SEQ ID NO: 13055 - DNA, 21 bp, Artificial Sequence
  Description of Artificial Sequence: Synthetic oligonucleotide
gacaacaaagacaaagtcctc

SEQ ID NO: 13056 - DNA, 21 bp, Artificial Sequence
  Description of Artificial Sequence: Synthetic oligonucleotide
accaacagcaaaagcgccgtc

SEQ ID NO: 13057 - DNA, 21 bp, Artificial Sequence
  Description of Artificial Sequence: Synthetic oligonucleotide
tcgacggcgaagggttctaat

SEQ ID NO: 13058 - DNA, 21 bp, Artificial Sequence
  Description of Artificial Sequence: Synthetic oligonucleotide
gctgggtctaaggtgacgact

SEQ ID NO: 13059 - DNA, 21 bp, Artificial Sequence
  Description of Artificial Sequence: Synthetic oligonucleotide
aatcgtgagtcgagtacggtg

SEQ ID NO: 13060 - DNA, 21 bp, Artificial Sequence
  Description of Artificial Sequence: Synthetic oligonucleotide
gagttgcctgctggtaagtcg

SEQ ID NO: 13061 - DNA, 21 bp, Artificial Sequence
  Description of Artificial Sequence: Synthetic oligonucleotide
accaccggccaaagcgtcggc

SEQ ID NO: 13062 - DNA, 21 bp, Artificial Sequence
  Description of Artificial Sequence: Synthetic oligonucleotide
gctagtggtagtcataattct

SEQ ID NO: 13063 - DNA, 21 bp, Artificial Sequence
  Description of Artificial Sequence: Synthetic oligonucleotide
aatgcttcgacgaagtcgggt

SEQ ID NO: 13064 - DNA, 21 bp, Artificial Sequence
  Description of Artificial Sequence: Synthetic oligonucleotide
ggggggagtcctacggctcag

SEQ ID NO: 13065 - DNA, 21 bp, Artificial Sequence
  Description of Artificial Sequence: Synthetic oligonucleotide
aatactccgtctaaggcgtct

SEQ ID NO: 13066 - DNA, 21 bp, Artificial Sequence
  Description of Artificial Sequence: Synthetic oligonucleotide
aatggtagtgcgtcgaatcgg

SEQ ID NO: 13067 - DNA, 21 bp, Artificial Sequence
  Description of Artificial Sequence: Synthetic oligonucleotide
tcggtgtcgggtggtcagggt

SEQ ID NO: 13068 - DNA, 21 bp, Artificial Sequence
  Description of Artificial Sequence: Synthetic oligonucleotide
atgagtaagcctacgaatgtg

SEQ ID NO: 13069 - DNA, 21 bp, Artificial Sequence
  Description of Artificial Sequence: Synthetic oligonucleotide
cagccggcggctactcctaat

SEQ ID NO: 13070 - DNA, 21 bp, Artificial Sequence
  Description of Artificial Sequence: Synthetic oligonucleotide
gaacccgtcaaaagcaccatc

SEQ ID NO: 13071 - DNA, 21 bp, Artificial Sequence
  Description of Artificial Sequence: Synthetic oligonucleotide
gagcagagtaagcagagtaag

SEQ ID NO: 13072 - DNA, 21 bp, Artificial Sequence
  Description of Artificial Sequence: Synthetic oligonucleotide
ggcaccagccaaagcagcaac

SEQ ID NO: 13073 - DNA, 21 bp, Artificial Sequence
  Description of Artificial Sequence: Synthetic oligonucleotide
ggcaacagcggcagcggcgtc

SEQ ID NO: 13074 - DNA, 21 bp, Artificial Sequence
  Description of Artificial Sequence: Synthetic oligonucleotide
ctggggtctgggcaggttcag

SEQ ID NO: 13075 - DNA, 21 bp, Artificial Sequence
  Description of Artificial Sequence: Synthetic oligonucleotide
gatgctggtcataagtctacg

SEQ ID NO: 13076 - DNA, 21 bp, Artificial Sequence
  Description of Artificial Sequence: Synthetic oligonucleotide
ggtgatggtggggctcagaag

SEQ ID NO: 13077 - DNA, 21 bp, Artificial Sequence
  Description of Artificial Sequence: Synthetic oligonucleotide
agcggcaacaaacccatcagc

SEQ ID NO: 13078 - DNA, 21 bp, Artificial Sequence
  Description of Artificial Sequence: Synthetic oligonucleotide
gtcagcggcgccaaacccctc

SEQ ID NO: 13079 - DNA, 21 bp, Artificial Sequence
  Description of Artificial Sequence: Synthetic oligonucleotide
aacgccagcaaaagcagcgcc

SEQ ID NO: 13080 - DNA, 21 bp, Artificial Sequence
  Description of Artificial Sequence: Synthetic oligonucleotide
ggcatcggcggccacaacagc

SEQ ID NO: 13081 - DNA, 21 bp, Artificial Sequence
  Description of Artificial Sequence: Synthetic oligonucleotide
ggtgggcagagtaagccgacg

SEQ ID NO: 13082 - DNA, 21 bp, Artificial Sequence
  Description of Artificial Sequence: Synthetic oligonucleotide
cagggggataagtcttcgtat

SEQ ID NO: 13083 - DNA, 21 bp, Artificial Sequence
  Description of Artificial Sequence: Synthetic oligonucleotide
cagggtcctaagtcggataat

SEQ ID NO: 13084 - DNA, 21 bp, Artificial Sequence
  Description of Artificial Sequence: Synthetic oligonucleotide
gaagccagcagcggcggcaga

SEQ ID NO: 13085 - DNA, 21 bp, Artificial Sequence
  Description of Artificial Sequence: Synthetic oligonucleotide
gccaacaccggcaccacccaa

SEQ ID NO: 13086 - DNA, 21 bp, Artificial Sequence
  Description of Artificial Sequence: Synthetic oligonucleotide
gacagcaacagcaccaccaga

SEQ ID NO: 13087 - DNA, 21 bp, Artificial Sequence
  Description of Artificial Sequence: Synthetic oligonucleotide
ggggaggctcgtccgactaat

SEQ ID NO: 13088 - DNA, 21 bp, Artificial Sequence
  Description of Artificial Sequence: Synthetic oligonucleotide
agcctcaacaaaaacaacatg

SEQ ID NO: 13089 - DNA, 21 bp, Artificial Sequence
  Description of Artificial Sequence: Synthetic oligonucleotide
gggcgtgctaatggttctacg

SEQ ID NO: 13090 - DNA, 21 bp, Artificial Sequence
  Description of Artificial Sequence: Synthetic oligonucleotide
caaagcaacaccgcccacgcc

SEQ ID NO: 13091 - DNA, 21 bp, Artificial Sequence
  Description of Artificial Sequence: Synthetic oligonucleotide
cagggtacttctaagagttcg

SEQ ID NO: 13092 - DNA, 21 bp, Artificial Sequence
  Description of Artificial Sequence: Synthetic oligonucleotide
actggtgggtctaagagtagt

SEQ ID NO: 13093 - DNA, 21 bp, Artificial Sequence
  Description of Artificial Sequence: Synthetic oligonucleotide
caggttgctaagcctgcttcg

SEQ ID NO: 13094 - DNA, 21 bp, Artificial Sequence
  Description of Artificial Sequence: Synthetic oligonucleotide
gtcgccaacccccccagccaa

SEQ ID NO: 13095 - DNA, 21 bp, Artificial Sequence
  Description of Artificial Sequence: Synthetic oligonucleotide
gccaccaccaaagccaccgaa

SEQ ID NO: 13096 - DNA, 21 bp, Artificial Sequence
  Description of Artificial Sequence: Synthetic oligonucleotide
cagacggcctctacgaataag

SEQ ID NO: 13097 - DNA, 21 bp, Artificial Sequence
  Description of Artificial Sequence: Synthetic oligonucleotide
tctggttctgttccgagtact

SEQ ID NO: 13098 - DNA, 21 bp, Artificial Sequence
  Description of Artificial Sequence: Synthetic oligonucleotide
agccaacccaaagccggcagc

SEQ ID NO: 13099 - DNA, 21 bp, Artificial Sequence
  Description of Artificial Sequence: Synthetic oligonucleotide
accgtcagcaccgccaccaaa

SEQ ID NO: 13100 - DNA, 21 bp, Artificial Sequence
  Description of Artificial Sequence: Synthetic oligonucleotide
agagacaacaccaaaaccggc

SEQ ID NO: 13101 - DNA, 21 bp, Artificial Sequence
  Description of Artificial Sequence: Synthetic oligonucleotide
atgaacaacaccaacagcaaa

SEQ ID NO: 13102 - DNA, 21 bp, Artificial Sequence
  Description of Artificial Sequence: Synthetic oligonucleotide
gccggcaccagccacgcccaa

SEQ ID NO: 13103 - DNA, 21 bp, Artificial Sequence
  Description of Artificial Sequence: Synthetic oligonucleotide
tcgggtaagaatgctgttgcg

SEQ ID NO: 13104 - DNA, 21 bp, Artificial Sequence
  Description of Artificial Sequence: Synthetic oligonucleotide
actggttcgcagcataattct

SEQ ID NO: 13105 - DNA, 21 bp, Artificial Sequence
  Description of Artificial Sequence: Synthetic oligonucleotide
gtgggtaatggtcaggggcgt

SEQ ID NO: 13106 - DNA, 21 bp, Artificial Sequence
  Description of Artificial Sequence: Synthetic oligonucleotide
gaggtgggtgggcattctaag

SEQ ID NO: 13107 - DNA, 21 bp, Artificial Sequence
  Description of Artificial Sequence: Synthetic oligonucleotide
agccccgacaaagccaacgtc

SEQ ID NO: 13108 - DNA, 21 bp, Artificial Sequence
  Description of Artificial Sequence: Synthetic oligonucleotide
ggtgttaagaatacgactggg

SEQ ID NO: 13109 - DNA, 21 bp, Artificial Sequence
  Description of Artificial Sequence: Synthetic oligonucleotide
accaccggcagcaaacccagc

SEQ ID NO: 13110 - DNA, 21 bp, Artificial Sequence
  Description of Artificial Sequence: Synthetic oligonucleotide
gggtcgaatacgtctagtggg

SEQ ID NO: 13111 - DNA, 21 bp, Artificial Sequence
  Description of Artificial Sequence: Synthetic oligonucleotide
aaaggcagcagcaccgtcggc

SEQ ID NO: 13112 - DNA, 21 bp, Artificial Sequence
  Description of Artificial Sequence: Synthetic oligonucleotide
gctgctgggactccgtctaat

SEQ ID NO: 13113 - DNA, 21 bp, Artificial Sequence
  Description of Artificial Sequence: Synthetic oligonucleotide
agccaagtcaaaggcggcagc

SEQ ID NO: 13114 - DNA, 21 bp, Artificial Sequence
  Description of Artificial Sequence: Synthetic oligonucleotide
ggcaacagccacgaaagcaaa

SEQ ID NO: 13115 - DNA, 21 bp, Artificial Sequence
  Description of Artificial Sequence: Synthetic oligonucleotide
ggtaatggggcgactactttg

SEQ ID NO: 13116 - DNA, 21 bp, Artificial Sequence
  Description of Artificial Sequence: Synthetic oligonucleotide
aagaatcatccgaagaatgag

SEQ ID NO: 13117 - DNA, 21 bp, Artificial Sequence
  Description of Artificial Sequence: Synthetic oligonucleotide
caggggtctaagggggcgaat

SEQ ID NO: 13118 - DNA, 21 bp, Artificial Sequence
  Description of Artificial Sequence: Synthetic oligonucleotide
caggggaattctaatcagagt

SEQ ID NO: 13119 - DNA, 21 bp, Artificial Sequence
  Description of Artificial Sequence: Synthetic oligonucleotide
tcttctggttctcatccgtcg

SEQ ID NO: 13120 - DNA, 21 bp, Artificial Sequence
  Description of Artificial Sequence: Synthetic oligonucleotide
tcgtcttcgaagccgggtact

SEQ ID NO: 13121 - DNA, 21 bp, Artificial Sequence
  Description of Artificial Sequence: Synthetic oligonucleotide
ggcaaccaaaccaaacccctc

SEQ ID NO: 13122 - DNA, 21 bp, Artificial Sequence
  Description of Artificial Sequence: Synthetic oligonucleotide
tcgggtacgaatactactagt

SEQ ID NO: 13123 - DNA, 21 bp, Artificial Sequence
  Description of Artificial Sequence: Synthetic oligonucleotide
ggggctcatgagaattctaag

SEQ ID NO: 13124 - DNA, 21 bp, Artificial Sequence
  Description of Artificial Sequence: Synthetic oligonucleotide
gagggtgagtcccggaagggg

SEQ ID NO: 13125 - DNA, 21 bp, Artificial Sequence
  Description of Artificial Sequence: Synthetic oligonucleotide
ggcagcgaagacaaaagaatc

SEQ ID NO: 13126 - DNA, 21 bp, Artificial Sequence
  Description of Artificial Sequence: Synthetic oligonucleotide
gacagcagcagcagaagcacc

SEQ ID NO: 13127 - DNA, 21 bp, Artificial Sequence
  Description of Artificial Sequence: Synthetic oligonucleotide
accggcagccaaccccaacac

SEQ ID NO: 13128 - DNA, 21 bp, Artificial Sequence
  Description of Artificial Sequence: Synthetic oligonucleotide
atgactgatactaagccggct

SEQ ID NO: 13129 - DNA, 21 bp, Artificial Sequence
  Description of Artificial Sequence: Synthetic oligonucleotide
caggtgtctaaggcttctttg

SEQ ID NO: 13130 - DNA, 21 bp, Artificial Sequence
  Description of Artificial Sequence: Synthetic oligonucleotide
agcaccggcggcaccggcaaa

SEQ ID NO: 13131 - DNA, 21 bp, Artificial Sequence
  Description of Artificial Sequence: Synthetic oligonucleotide
cagtctgataagccgatttcg

SEQ ID NO: 13132 - DNA, 21 bp, Artificial Sequence
  Description of Artificial Sequence: Synthetic oligonucleotide
gccggcggcgccagccaagtc

SEQ ID NO: 13133 - DNA, 21 bp, Artificial Sequence
  Description of Artificial Sequence: Synthetic oligonucleotide
tctaggggtggttcgcaggct

SEQ ID NO: 13134 - DNA, 21 bp, Artificial Sequence
  Description of Artificial Sequence: Synthetic oligonucleotide
acgatgaatgggaagcctact

SEQ ID NO: 13135 - DNA, 21 bp, Artificial Sequence
  Description of Artificial Sequence: Synthetic oligonucleotide
ggtccgactcagggtacgggt

SEQ ID NO: 13136 - DNA, 21 bp, Artificial Sequence
  Description of Artificial Sequence: Synthetic oligonucleotide
tcgggggtgacgaagggtagt

SEQ ID NO: 13137 - DNA, 21 bp, Artificial Sequence
  Description of Artificial Sequence: Synthetic oligonucleotide
gaaaccggcagacccgccacc

SEQ ID NO: 13138 - DNA, 21 bp, Artificial Sequence
  Description of Artificial Sequence: Synthetic oligonucleotide
ttggggagtaaggaatctagt

SEQ ID NO: 13139 - DNA, 21 bp, Artificial Sequence
  Description of Artificial Sequence: Synthetic oligonucleotide
aatactggtgagaagcagagt

SEQ ID NO: 13140 - DNA, 21 bp, Artificial Sequence
  Description of Artificial Sequence: Synthetic oligonucleotide
gcgtcggctgggagtcagtcg

SEQ ID NO: 13141 - DNA, 21 bp, Artificial Sequence
  Description of Artificial Sequence: Synthetic oligonucleotide
gttacgagtgagaagaatgcg

SEQ ID NO: 13142 - DNA, 21 bp, Artificial Sequence
  Description of Artificial Sequence: Synthetic oligonucleotide
accggcagcaacagcgtcagc

SEQ ID NO: 13143 - DNA, 21 bp, Artificial Sequence
  Description of Artificial Sequence: Synthetic oligonucleotide
gagcggactagttctgttgtt

SEQ ID NO: 13144 - DNA, 21 bp, Artificial Sequence
  Description of Artificial Sequence: Synthetic oligonucleotide
ggccccagcaaccccagcagc

SEQ ID NO: 13145 - DNA, 21 bp, Artificial Sequence
  Description of Artificial Sequence: Synthetic oligonucleotide
tcttctagttctaagcctgct

SEQ ID NO: 13146 - DNA, 21 bp, Artificial Sequence
  Description of Artificial Sequence: Synthetic oligonucleotide
caggataggacgccgagtgtg

SEQ ID NO: 13147 - DNA, 21 bp, Artificial Sequence
  Description of Artificial Sequence: Synthetic oligonucleotide
tctacgactagggaggcggtg

SEQ ID NO: 13148 - DNA, 21 bp, Artificial Sequence
  Description of Artificial Sequence: Synthetic oligonucleotide
actactaataagagttctgtt

SEQ ID NO: 13149 - DNA, 21 bp, Artificial Sequence
  Description of Artificial Sequence: Synthetic oligonucleotide
accatcagccaaaaccccgcc

SEQ ID NO: 13150 - DNA, 21 bp, Artificial Sequence
  Description of Artificial Sequence: Synthetic oligonucleotide
agcaccgaaagaaacaaccac

SEQ ID NO: 13151 - DNA, 21 bp, Artificial Sequence
  Description of Artificial Sequence: Synthetic oligonucleotide
accagaacccccgccagcacc

SEQ ID NO: 13152 - DNA, 21 bp, Artificial Sequence
  Description of Artificial Sequence: Synthetic oligonucleotide
gcgggtgtggataggtcgcat

SEQ ID NO: 13153 - DNA, 21 bp, Artificial Sequence
  Description of Artificial Sequence: Synthetic oligonucleotide
aacaccagcggcaccggcagc

SEQ ID NO: 13154 - DNA, 21 bp, Artificial Sequence
  Description of Artificial Sequence: Synthetic oligonucleotide
gggaggggtaaggatagtgtt

SEQ ID NO: 13155 - DNA, 21 bp, Artificial Sequence
  Description of Artificial Sequence: Synthetic oligonucleotide
cttacgtcgactgcgcctaag

SEQ ID NO: 13156 - DNA, 21 bp, Artificial Sequence
  Description of Artificial Sequence: Synthetic oligonucleotide
caaagcgtcaacacccccaaa

SEQ ID NO: 13157 - DNA, 21 bp, Artificial Sequence
  Description of Artificial Sequence: Synthetic oligonucleotide
accaaaagccaaacccccgtc

SEQ ID NO: 13158 - DNA, 21 bp, Artificial Sequence
  Description of Artificial Sequence: Synthetic oligonucleotide
agcagccaaagcgccaccaaa

SEQ ID NO: 13159 - DNA, 21 bp, Artificial Sequence
  Description of Artificial Sequence: Synthetic oligonucleotide
aaggggggtggttctacgaat

SEQ ID NO: 13160 - DNA, 21 bp, Artificial Sequence
  Description of Artificial Sequence: Synthetic oligonucleotide
acgaattctggtgctggtatt

SEQ ID NO: 13161 - DNA, 21 bp, Artificial Sequence
  Description of Artificial Sequence: Synthetic oligonucleotide
gataatagtgtgaagtctgtg

SEQ ID NO: 13162 - DNA, 21 bp, Artificial Sequence
  Description of Artificial Sequence: Synthetic oligonucleotide
agcatcaacagcggcagcaaa

SEQ ID NO: 13163 - DNA, 21 bp, Artificial Sequence
  Description of Artificial Sequence: Synthetic oligonucleotide
tctactacgggtgcttcgaag

SEQ ID NO: 13164 - DNA, 21 bp, Artificial Sequence
  Description of Artificial Sequence: Synthetic oligonucleotide
ggcggcggcggcagcagcgtc

SEQ ID NO: 13165 - DNA, 21 bp, Artificial Sequence
  Description of Artificial Sequence: Synthetic oligonucleotide
ggtatgagtaatccttctaat

SEQ ID NO: 13166 - DNA, 21 bp, Artificial Sequence
  Description of Artificial Sequence: Synthetic oligonucleotide
cagagtaatagtagtctttcg

SEQ ID NO: 13167 - DNA, 21 bp, Artificial Sequence
  Description of Artificial Sequence: Synthetic oligonucleotide
caaagcggcaaaagcgccgac

SEQ ID NO: 13168 - DNA, 21 bp, Artificial Sequence
  Description of Artificial Sequence: Synthetic oligonucleotide
cagacgggggagaggcatgtt

SEQ ID NO: 13169 - DNA, 21 bp, Artificial Sequence
  Description of Artificial Sequence: Synthetic oligonucleotide
aattctgcgacgaggcctgtt

SEQ ID NO: 13170 - DNA, 21 bp, Artificial Sequence
  Description of Artificial Sequence: Synthetic oligonucleotide
gtttctacgaataagaatgtt

SEQ ID NO: 13171 - DNA, 21 bp, Artificial Sequence
  Description of Artificial Sequence: Synthetic oligonucleotide
tctaatgggactaagcagact

SEQ ID NO: 13172 - DNA, 21 bp, Artificial Sequence
  Description of Artificial Sequence: Synthetic oligonucleotide
aatgatagtcctacggcgagg

SEQ ID NO: 13173 - DNA, 21 bp, Artificial Sequence
  Description of Artificial Sequence: Synthetic oligonucleotide
ctcagacaacaagtcagcgaa

SEQ ID NO: 13174 - DNA, 21 bp, Artificial Sequence
  Description of Artificial Sequence: Synthetic oligonucleotide
aatactggtgagggtgcgaag

SEQ ID NO: 13175 - DNA, 21 bp, Artificial Sequence
  Description of Artificial Sequence: Synthetic oligonucleotide
accggcaccgcccaccccagc

SEQ ID NO: 13176 - DNA, 21 bp, Artificial Sequence
  Description of Artificial Sequence: Synthetic oligonucleotide
actggttcgccttctagtgct

SEQ ID NO: 13177 - DNA, 21 bp, Artificial Sequence
  Description of Artificial Sequence: Synthetic oligonucleotide
ggcaaagacaacagcaaaaac

SEQ ID NO: 13178 - DNA, 21 bp, Artificial Sequence
  Description of Artificial Sequence: Synthetic oligonucleotide
aattctggtcagcagaatggt

SEQ ID NO: 13179 - DNA, 21 bp, Artificial Sequence
  Description of Artificial Sequence: Synthetic oligonucleotide
agcagcagcaacgccagccac

SEQ ID NO: 13180 - DNA, 21 bp, Artificial Sequence
  Description of Artificial Sequence: Synthetic oligonucleotide
aacaacgccgccacccaaagc

SEQ ID NO: 13181 - DNA, 21 bp, Artificial Sequence
  Description of Artificial Sequence: Synthetic oligonucleotide
acccccgaaagagccggcagc

SEQ ID NO: 13182 - DNA, 21 bp, Artificial Sequence
  Description of Artificial Sequence: Synthetic oligonucleotide
caaagcggcaaaagcaccacc

SEQ ID NO: 13183 - DNA, 21 bp, Artificial Sequence
  Description of Artificial Sequence: Synthetic oligonucleotide
acgattggtaagccgggggct

SEQ ID NO: 13184 - DNA, 21 bp, Artificial Sequence
  Description of Artificial Sequence: Synthetic oligonucleotide
atcagcggcaaagccagcacc

SEQ ID NO: 13185 - DNA, 21 bp, Artificial Sequence
  Description of Artificial Sequence: Synthetic oligonucleotide
gaaaacagcaacaaattcacc

SEQ ID NO: 13186 - DNA, 21 bp, Artificial Sequence
  Description of Artificial Sequence: Synthetic oligonucleotide
ggccacaccaacaaccccctc

SEQ ID NO: 13187 - DNA, 21 bp, Artificial Sequence
  Description of Artificial Sequence: Synthetic oligonucleotide
agttcggatgggaggggtact

SEQ ID NO: 13188 - DNA, 21 bp, Artificial Sequence
  Description of Artificial Sequence: Synthetic oligonucleotide
gctcctgttcagcagggtggg

SEQ ID NO: 13189 - DNA, 21 bp, Artificial Sequence
  Description of Artificial Sequence: Synthetic oligonucleotide
actattggtggtaagcctgat

SEQ ID NO: 13190 - DNA, 21 bp, Artificial Sequence
  Description of Artificial Sequence: Synthetic oligonucleotide
gggacggctagttcgcagtct

SEQ ID NO: 13191 - DNA, 21 bp, Artificial Sequence
  Description of Artificial Sequence: Synthetic oligonucleotide
gacatggccaaagaaagaagc

SEQ ID NO: 13192 - DNA, 21 bp, Artificial Sequence
  Description of Artificial Sequence: Synthetic oligonucleotide
gatgctaattcgaaggggaag

SEQ ID NO: 13193 - DNA, 21 bp, Artificial Sequence
  Description of Artificial Sequence: Synthetic oligonucleotide
tctggtgagaggagtactact

SEQ ID NO: 13194 - DNA, 21 bp, Artificial Sequence
  Description of Artificial Sequence: Synthetic oligonucleotide
gaacacagcagcagcgtcaaa

SEQ ID NO: 13195 - DNA, 21 bp, Artificial Sequence
  Description of Artificial Sequence: Synthetic oligonucleotide
agcagcggcagccccggcaaa

SEQ ID NO: 13196 - DNA, 21 bp, Artificial Sequence
  Description of Artificial Sequence: Synthetic oligonucleotide
ggcaaaagcaccagcggcggc

SEQ ID NO: 13197 - DNA, 21 bp, Artificial Sequence
  Description of Artificial Sequence: Synthetic oligonucleotide
acgggggtgaatagtccgcat

SEQ ID NO: 13198 - DNA, 21 bp, Artificial Sequence
  Description of Artificial Sequence: Synthetic oligonucleotide
ggcagcagcgcccaccccaaa

SEQ ID NO: 13199 - DNA, 21 bp, Artificial Sequence
  Description of Artificial Sequence: Synthetic oligonucleotide
tctgggactgagaaggcgcgg

SEQ ID NO: 13200 - DNA, 21 bp, Artificial Sequence
  Description of Artificial Sequence: Synthetic oligonucleotide
tcgccttcttcgaatcctcag

SEQ ID NO: 13201 - DNA, 21 bp, Artificial Sequence
  Description of Artificial Sequence: Synthetic oligonucleotide
actgcgaataagactactttg

SEQ ID NO: 13202 - DNA, 21 bp, Artificial Sequence
  Description of Artificial Sequence: Synthetic oligonucleotide
actggtactaagcctctgggg

SEQ ID NO: 13203 - DNA, 21 bp, Artificial Sequence
  Description of Artificial Sequence: Synthetic oligonucleotide
agtaatcagaagactagtatt

SEQ ID NO: 13204 - DNA, 21 bp, Artificial Sequence
  Description of Artificial Sequence: Synthetic oligonucleotide
agcctcaacgaccacagcaaa

SEQ ID NO: 13205 - DNA, 21 bp, Artificial Sequence
  Description of Artificial Sequence: Synthetic oligonucleotide
cattcgtcggagcagggtaag

SEQ ID NO: 13206 - DNA, 21 bp, Artificial Sequence
  Description of Artificial Sequence: Synthetic oligonucleotide
aatcagggtaagactgcggag

SEQ ID NO: 13207 - DNA, 21 bp, Artificial Sequence
  Description of Artificial Sequence: Synthetic oligonucleotide
agagccgaaggcaaaaacgtc

SEQ ID NO: 13208 - DNA, 21 bp, Artificial Sequence
  Description of Artificial Sequence: Synthetic oligonucleotide
actggtgcttcttctggttcg

SEQ ID NO: 13209 - DNA, 21 bp, Artificial Sequence
  Description of Artificial Sequence: Synthetic oligonucleotide
agagaaaacaaacccgacagc

SEQ ID NO: 13210 - DNA, 21 bp, Artificial Sequence
  Description of Artificial Sequence: Synthetic oligonucleotide
gagtcgcggtctccgtctcat

SEQ ID NO: 13211 - DNA, 21 bp, Artificial Sequence
  Description of Artificial Sequence: Synthetic oligonucleotide
gttagtggtaagcagattagt

SEQ ID NO: 13212 - DNA, 21 bp, Artificial Sequence
  Description of Artificial Sequence: Synthetic oligonucleotide
ctgtctggtaaggctcctaat

SEQ ID NO: 13213 - DNA, 21 bp, Artificial Sequence
  Description of Artificial Sequence: Synthetic oligonucleotide
gggactactggtgagagggcg

SEQ ID NO: 13214 - DNA, 21 bp, Artificial Sequence
  Description of Artificial Sequence: Synthetic oligonucleotide
gtcgccagcagcaaaaccacc

SEQ ID NO: 13215 - DNA, 21 bp, Artificial Sequence
  Description of Artificial Sequence: Synthetic oligonucleotide
accgacagaacccccagcatg

SEQ ID NO: 13216 - DNA, 21 bp, Artificial Sequence
  Description of Artificial Sequence: Synthetic oligonucleotide
agcgccgaaagcgtcaacaaa

SEQ ID NO: 13217 - DNA, 21 bp, Artificial Sequence
  Description of Artificial Sequence: Synthetic oligonucleotide
gtcagaggccaaaccaccagc

SEQ ID NO: 13218 - DNA, 21 bp, Artificial Sequence
  Description of Artificial Sequence: Synthetic oligonucleotide
ggccaaggcaccaaagtcacc

SEQ ID NO: 13219 - DNA, 21 bp, Artificial Sequence
  Description of Artificial Sequence: Synthetic oligonucleotide
acgaggtctcagcctactact

SEQ ID NO: 13220 - DNA, 21 bp, Artificial Sequence
  Description of Artificial Sequence: Synthetic oligonucleotide
cagagggtgacggagtctcat

SEQ ID NO: 13221 - DNA, 21 bp, Artificial Sequence
  Description of Artificial Sequence: Synthetic oligonucleotide
caaggcgacaaacccagactc

SEQ ID NO: 13222 - DNA, 21 bp, Artificial Sequence
  Description of Artificial Sequence: Synthetic oligonucleotide
gcttcgaagcctagtaatatt

SEQ ID NO: 13223 - DNA, 21 bp, Artificial Sequence
  Description of Artificial Sequence: Synthetic oligonucleotide
gaaaccgccagacccaaccaa

SEQ ID NO: 13224 - DNA, 21 bp, Artificial Sequence
  Description of Artificial Sequence: Synthetic oligonucleotide
cagtcgacgtctaagacttcg

SEQ ID NO: 13225 - DNA, 21 bp, Artificial Sequence
  Description of Artificial Sequence: Synthetic oligonucleotide
agcagcgacaccaaaatcagc

SEQ ID NO: 13226 - DNA, 21 bp, Artificial Sequence
  Description of Artificial Sequence: Synthetic oligonucleotide
aacggcaccgacagaaccacc

SEQ ID NO: 13227 - DNA, 21 bp, Artificial Sequence
  Description of Artificial Sequence: Synthetic oligonucleotide
acgcagaagcctacgaatggg

SEQ ID NO: 13228 - DNA, 21 bp, Artificial Sequence
  Description of Artificial Sequence: Synthetic oligonucleotide
caacaaggcgaagccttcaaa

SEQ ID NO: 13229 - DNA, 21 bp, Artificial Sequence
  Description of Artificial Sequence: Synthetic oligonucleotide
gatggtcagccgcctactaag

SEQ ID NO: 13230 - DNA, 21 bp, Artificial Sequence
  Description of Artificial Sequence: Synthetic oligonucleotide
tcgaatggtcagaagcaggat

SEQ ID NO: 13231 - DNA, 21 bp, Artificial Sequence
  Description of Artificial Sequence: Synthetic oligonucleotide
tctacgagtactaagtcgggt

SEQ ID NO: 13232 - DNA, 21 bp, Artificial Sequence
  Description of Artificial Sequence: Synthetic oligonucleotide
tctggtggtggttctcctgtg

SEQ ID NO: 13233 - DNA, 21 bp, Artificial Sequence
  Description of Artificial Sequence: Synthetic oligonucleotide
tctgtgtcgaagagtagtatt

SEQ ID NO: 13234 - DNA, 21 bp, Artificial Sequence
  Description of Artificial Sequence: Synthetic oligonucleotide
caagtcggcagcgaccacaga

SEQ ID NO: 13235 - DNA, 21 bp, Artificial Sequence
  Description of Artificial Sequence: Synthetic oligonucleotide
ggttctaatgggagtaggggg

SEQ ID NO: 13236 - DNA, 21 bp, Artificial Sequence
  Description of Artificial Sequence: Synthetic oligonucleotide
gccagcagccaaaaagtcgtc

SEQ ID NO: 13237 - DNA, 21 bp, Artificial Sequence
  Description of Artificial Sequence: Synthetic oligonucleotide
agcccccaccaagccggcacc

SEQ ID NO: 13238 - DNA, 21 bp, Artificial Sequence
  Description of Artificial Sequence: Synthetic oligonucleotide
ggtgggagtgagcgtgctaag

SEQ ID NO: 13239 - DNA, 21 bp, Artificial Sequence
  Description of Artificial Sequence: Synthetic oligonucleotide
gctggtgggggtaaggctact

SEQ ID NO: 13240 - DNA, 21 bp, Artificial Sequence
  Description of Artificial Sequence: Synthetic oligonucleotide
ggtatgtcggctgggactggg

SEQ ID NO: 13241 - DNA, 21 bp, Artificial Sequence
  Description of Artificial Sequence: Synthetic oligonucleotide
agccaaagcaaaagcgccctc

SEQ ID NO: 13242 - DNA, 21 bp, Artificial Sequence
  Description of Artificial Sequence: Synthetic oligonucleotide
agccaccaaaccggcagcggc

SEQ ID NO: 13243 - DNA, 21 bp, Artificial Sequence
  Description of Artificial Sequence: Synthetic oligonucleotide
ggggggaagtctccggctcat

SEQ ID NO: 13244 - DNA, 21 bp, Artificial Sequence
  Description of Artificial Sequence: Synthetic oligonucleotide
agaatgaacaaaaccagcgaa

SEQ ID NO: 13245 - DNA, 21 bp, Artificial Sequence
  Description of Artificial Sequence: Synthetic oligonucleotide
gccagagacaccaaagccagc

SEQ ID NO: 13246 - DNA, 21 bp, Artificial Sequence
  Description of Artificial Sequence: Synthetic oligonucleotide
aacggcaacaaacacgccagc

SEQ ID NO: 13247 - DNA, 21 bp, Artificial Sequence
  Description of Artificial Sequence: Synthetic oligonucleotide
cttactcagaagtctccgagt

SEQ ID NO: 13248 - DNA, 21 bp, Artificial Sequence
  Description of Artificial Sequence: Synthetic oligonucleotide
gatgcgacttctaagtttgct

SEQ ID NO: 13249 - DNA, 21 bp, Artificial Sequence
  Description of Artificial Sequence: Synthetic oligonucleotide
agcctcggcaaaaccgccagc

SEQ ID NO: 13250 - DNA, 21 bp, Artificial Sequence
  Description of Artificial Sequence: Synthetic oligonucleotide
tcttcggctagttctaatcag

SEQ ID NO: 13251 - DNA, 21 bp, Artificial Sequence
  Description of Artificial Sequence: Synthetic oligonucleotide
ggtaatcatagtcctcctaag

SEQ ID NO: 13252 - DNA, 21 bp, Artificial Sequence
  Description of Artificial Sequence: Synthetic oligonucleotide
caaaccgccaaacccggcgtc

SEQ ID NO: 13253 - DNA, 21 bp, Artificial Sequence
  Description of Artificial Sequence: Synthetic oligonucleotide
aacagcaccaccaaagtcagc

SEQ ID NO: 13254 - DNA, 21 bp, Artificial Sequence
  Description of Artificial Sequence: Synthetic oligonucleotide
ggtactggggggacgcttagt

SEQ ID NO: 13255 - DNA, 21 bp, Artificial Sequence
  Description of Artificial Sequence: Synthetic oligonucleotide
cattctgcgagtccgactgtt

SEQ ID NO: 13256 - DNA, 21 bp, Artificial Sequence
  Description of Artificial Sequence: Synthetic oligonucleotide
actccgcagaaggatgctaag

SEQ ID NO: 13257 - DNA, 21 bp, Artificial Sequence
  Description of Artificial Sequence: Synthetic oligonucleotide
caaaccgccaccgtccccaaa

SEQ ID NO: 13258 - DNA, 21 bp, Artificial Sequence
  Description of Artificial Sequence: Synthetic oligonucleotide
gatggtggtacttctcgggtt

SEQ ID NO: 13259 - DNA, 21 bp, Artificial Sequence
  Description of Artificial Sequence: Synthetic oligonucleotide
tctgagtctaaggctaatgcg

SEQ ID NO: 13260 - DNA, 21 bp, Artificial Sequence
  Description of Artificial Sequence: Synthetic oligonucleotide
gctactcatcagccggctacg

SEQ ID NO: 13261 - DNA, 21 bp, Artificial Sequence
  Description of Artificial Sequence: Synthetic oligonucleotide
ttgcaggcgaaggcttctggt

SEQ ID NO: 13262 - DNA, 21 bp, Artificial Sequence
  Description of Artificial Sequence: Synthetic oligonucleotide
aagggtaattcttctactact

SEQ ID NO: 13263 - DNA, 21 bp, Artificial Sequence
  Description of Artificial Sequence: Synthetic oligonucleotide
gcggcggatcgttcttcgact

SEQ ID NO: 13264 - DNA, 21 bp, Artificial Sequence
  Description of Artificial Sequence: Synthetic oligonucleotide
agccccagccccacccccaaa

SEQ ID NO: 13265 - DNA, 21 bp, Artificial Sequence
  Description of Artificial Sequence: Synthetic oligonucleotide
agcggcaacggcaaagtcacc

SEQ ID NO: 13266 - DNA, 21 bp, Artificial Sequence
  Description of Artificial Sequence: Synthetic oligonucleotide
gagcagggtaataataagcat

SEQ ID NO: 13267 - DNA, 21 bp, Artificial Sequence
  Description of Artificial Sequence: Synthetic oligonucleotide
ggtggttctaagcaggcttct

SEQ ID NO: 13268 - DNA, 21 bp, Artificial Sequence
  Description of Artificial Sequence: Synthetic oligonucleotide
caaagaggcgccaccaacggc

SEQ ID NO: 13269 - DNA, 21 bp, Artificial Sequence
  Description of Artificial Sequence: Synthetic oligonucleotide
ggtaagactaatcagcagtct

SEQ ID NO: 13270 - DNA, 21 bp, Artificial Sequence
  Description of Artificial Sequence: Synthetic oligonucleotide
actaatggtaagtctagttct

SEQ ID NO: 13271 - DNA, 21 bp, Artificial Sequence
  Description of Artificial Sequence: Synthetic oligonucleotide
caagacggcaaaggccaacaa

SEQ ID NO: 13272 - DNA, 21 bp, Artificial Sequence
  Description of Artificial Sequence: Synthetic oligonucleotide
tcgcgtcagaatgctaattct

SEQ ID NO: 13273 - DNA, 21 bp, Artificial Sequence
  Description of Artificial Sequence: Synthetic oligonucleotide
catggtagttcgtctaagact

SEQ ID NO: 13274 - DNA, 21 bp, Artificial Sequence
  Description of Artificial Sequence: Synthetic oligonucleotide
aacggttctggacagaatcaa

SEQ ID NO: 13275 - DNA, 21 bp, Artificial Sequence
  Description of Artificial Sequence: Synthetic oligonucleotide
ggtaatgttaatggtacgggt

SEQ ID NO: 13276 - DNA, 21 bp, Artificial Sequence
  Description of Artificial Sequence: Synthetic oligonucleotide
gccaccggcaaaagcagcctc

SEQ ID NO: 13277 - DNA, 21 bp, Artificial Sequence
  Description of Artificial Sequence: Synthetic oligonucleotide
aaccaaggcaccaaagtccaa

SEQ ID NO: 13278 - DNA, 21 bp, Artificial Sequence
  Description of Artificial Sequence: Synthetic oligonucleotide
actgctactgataagacttat

SEQ ID NO: 13279 - DNA, 21 bp, Artificial Sequence
  Description of Artificial Sequence: Synthetic oligonucleotide
gtgactggtaagagtcagatg

SEQ ID NO: 13280 - DNA, 21 bp, Artificial Sequence
  Description of Artificial Sequence: Synthetic oligonucleotide
agccaagtccaaaaagtcggc

SEQ ID NO: 13281 - DNA, 21 bp, Artificial Sequence
  Description of Artificial Sequence: Synthetic oligonucleotide
gatccgattagtgctaagaat

SEQ ID NO: 13282 - DNA, 21 bp, Artificial Sequence
  Description of Artificial Sequence: Synthetic oligonucleotide
agcagaaacaacaccaccacc

SEQ ID NO: 13283 - DNA, 21 bp, Artificial Sequence
  Description of Artificial Sequence: Synthetic oligonucleotide
gaaggcagcaacaaaaccctc

SEQ ID NO: 13284 - DNA, 21 bp, Artificial Sequence
  Description of Artificial Sequence: Synthetic oligonucleotide
gtcgccaaaagcaccaccctc

SEQ ID NO: 13285 - DNA, 21 bp, Artificial Sequence
  Description of Artificial Sequence: Synthetic oligonucleotide
agtaatggtgctccgactcgg

SEQ ID NO: 13286 - DNA, 21 bp, Artificial Sequence
  Description of Artificial Sequence: Synthetic oligonucleotide
caaggcaccaacagccaagtc

SEQ ID NO: 13287 - DNA, 21 bp, Artificial Sequence
  Description of Artificial Sequence: Synthetic oligonucleotide
tacccccccagcaaaggcagc

SEQ ID NO: 13288 - DNA, 21 bp, Artificial Sequence
  Description of Artificial Sequence: Synthetic oligonucleotide
tcggggagtggtggttctcag

SEQ ID NO: 13289 - DNA, 21 bp, Artificial Sequence
  Description of Artificial Sequence: Synthetic oligonucleotide
tcgactacgcaggggccgacg

SEQ ID NO: 13290 - DNA, 21 bp, Artificial Sequence
  Description of Artificial Sequence: Synthetic oligonucleotide
gccgtcgccaacgtcaacacc

SEQ ID NO: 13291 - DNA, 21 bp, Artificial Sequence
  Description of Artificial Sequence: Synthetic oligonucleotide
ctcggcagccaacaaagcaaa

SEQ ID NO: 13292 - DNA, 21 bp, Artificial Sequence
  Description of Artificial Sequence: Synthetic oligonucleotide
acgagtgatacgcggggtatg

SEQ ID NO: 13293 - DNA, 21 bp, Artificial Sequence
  Description of Artificial Sequence: Synthetic oligonucleotide
agcaacgccagccccggcagc

SEQ ID NO: 13294 - DNA, 21 bp, Artificial Sequence
  Description of Artificial Sequence: Synthetic oligonucleotide
gggagtactgggcagtctaag

SEQ ID NO: 13295 - DNA, 21 bp, Artificial Sequence
  Description of Artificial Sequence: Synthetic oligonucleotide
aaggctcagagttctgctggt

SEQ ID NO: 13296 - DNA, 21 bp, Artificial Sequence
  Description of Artificial Sequence: Synthetic oligonucleotide
ggcgtcggcagcaaaggcgtc

SEQ ID NO: 13297 - DNA, 21 bp, Artificial Sequence
  Description of Artificial Sequence: Synthetic oligonucleotide
tctagtggtactgctaatttg

SEQ ID NO: 13298 - DNA, 21 bp, Artificial Sequence
  Description of Artificial Sequence: Synthetic oligonucleotide
gtcatcaacggcaaaagcgac

SEQ ID NO: 13299 - DNA, 21 bp, Artificial Sequence
  Description of Artificial Sequence: Synthetic oligonucleotide
cagggtagggatcctcagtct

SEQ ID NO: 13300 - DNA, 21 bp, Artificial Sequence
  Description of Artificial Sequence: Synthetic oligonucleotide
gccctcgaaaaccccagcaaa

SEQ ID NO: 13301 - DNA, 21 bp, Artificial Sequence
  Description of Artificial Sequence: Synthetic oligonucleotide
gccggcagcggcccccaactc

SEQ ID NO: 13302 - DNA, 21 bp, Artificial Sequence
  Description of Artificial Sequence: Synthetic oligonucleotide
gaaggcaccagcagccacacc

SEQ ID NO: 13303 - DNA, 21 bp, Artificial Sequence
  Description of Artificial Sequence: Synthetic oligonucleotide
gacacccccagccccatcaaa

SEQ ID NO: 13304 - DNA, 21 bp, Artificial Sequence
  Description of Artificial Sequence: Synthetic oligonucleotide
ctcagcaccaacaaaagcgtc

SEQ ID NO: 13305 - DNA, 21 bp, Artificial Sequence
  Description of Artificial Sequence: Synthetic oligonucleotide
tcgattgggtcgccgtctcgt

SEQ ID NO: 13306 - DNA, 21 bp, Artificial Sequence
  Description of Artificial Sequence: Synthetic oligonucleotide
accggcaacaaaaccgccagc

SEQ ID NO: 13307 - DNA, 21 bp, Artificial Sequence
  Description of Artificial Sequence: Synthetic oligonucleotide
agccacaacagcagcaccagc

SEQ ID NO: 13308 - DNA, 21 bp, Artificial Sequence
  Description of Artificial Sequence: Synthetic oligonucleotide
agcaacagcacccaccccgcc

SEQ ID NO: 13309 - DNA, 21 bp, Artificial Sequence
  Description of Artificial Sequence: Synthetic oligonucleotide
agccaagccgtccccagcaaa

SEQ ID NO: 13310 - DNA, 21 bp, Artificial Sequence
  Description of Artificial Sequence: Synthetic oligonucleotide
caaatcaacaacaaaaccgcc

SEQ ID NO: 13311 - DNA, 21 bp, Artificial Sequence
  Description of Artificial Sequence: Synthetic oligonucleotide
acttctgggagtggtatgaag

SEQ ID NO: 13312 - DNA, 21 bp, Artificial Sequence
  Description of Artificial Sequence: Synthetic oligonucleotide
acggggacgaagcagttgtct

SEQ ID NO: 13313 - DNA, 21 bp, Artificial Sequence
  Description of Artificial Sequence: Synthetic oligonucleotide
acccaaggcagcaaccccccc

SEQ ID NO: 13314 - DNA, 21 bp, Artificial Sequence
  Description of Artificial Sequence: Synthetic oligonucleotide
acgcagcctagtactcatgtg

SEQ ID NO: 13315 - DNA, 21 bp, Artificial Sequence
  Description of Artificial Sequence: Synthetic oligonucleotide
gctgattcgaagccgacttct

SEQ ID NO: 13316 - DNA, 21 bp, Artificial Sequence
  Description of Artificial Sequence: Synthetic oligonucleotide
ggcaacggcagagaagccagc

SEQ ID NO: 13317 - DNA, 21 bp, Artificial Sequence
  Description of Artificial Sequence: Synthetic oligonucleotide
agcaccagccaaaaaagcgtc

SEQ ID NO: 13318 - DNA, 21 bp, Artificial Sequence
  Description of Artificial Sequence: Synthetic oligonucleotide
gggactagtcctcaggttaag

SEQ ID NO: 13319 - DNA, 21 bp, Artificial Sequence
  Description of Artificial Sequence: Synthetic oligonucleotide
accaccggcagccacagcgcc

SEQ ID NO: 13320 - DNA, 21 bp, Artificial Sequence
  Description of Artificial Sequence: Synthetic oligonucleotide
ggtactgctagtgggacgagg

SEQ ID NO: 13321 - DNA, 21 bp, Artificial Sequence
  Description of Artificial Sequence: Synthetic oligonucleotide
cacaacaccagcaaacaaggc

SEQ ID NO: 13322 - DNA, 21 bp, Artificial Sequence
  Description of Artificial Sequence: Synthetic oligonucleotide
gacatcacccaaaaaagcaaa

SEQ ID NO: 13323 - DNA, 21 bp, Artificial Sequence
  Description of Artificial Sequence: Synthetic oligonucleotide
gttacgcggtctaatagtgtg

SEQ ID NO: 13324 - DNA, 21 bp, Artificial Sequence
  Description of Artificial Sequence: Synthetic oligonucleotide
gagggtgcgaagcctgctttt

SEQ ID NO: 13325 - DNA, 21 bp, Artificial Sequence
  Description of Artificial Sequence: Synthetic oligonucleotide
gctatgagtagtgggaataag

SEQ ID NO: 13326 - DNA, 21 bp, Artificial Sequence
  Description of Artificial Sequence: Synthetic oligonucleotide
gttgctaataatggtaatgct

SEQ ID NO: 13327 - DNA, 21 bp, Artificial Sequence
  Description of Artificial Sequence: Synthetic oligonucleotide
aacagcaccagcggcaccaaa

SEQ ID NO: 13328 - DNA, 21 bp, Artificial Sequence
  Description of Artificial Sequence: Synthetic oligonucleotide
gggtctgggggtggtcagtcg

SEQ ID NO: 13329 - DNA, 21 bp, Artificial Sequence
  Description of Artificial Sequence: Synthetic oligonucleotide
gctacgagtggtacgtcgcat

SEQ ID NO: 13330 - DNA, 21 bp, Artificial Sequence
  Description of Artificial Sequence: Synthetic oligonucleotide
gggccgagtccgcaggggaag

SEQ ID NO: 13331 - DNA, 21 bp, Artificial Sequence
  Description of Artificial Sequence: Synthetic oligonucleotide
gcgggtgatagtagtgggcgt

SEQ ID NO: 13332 - DNA, 21 bp, Artificial Sequence
  Description of Artificial Sequence: Synthetic oligonucleotide
actgtgagtgatactaataag

SEQ ID NO: 13333 - DNA, 21 bp, Artificial Sequence
  Description of Artificial Sequence: Synthetic oligonucleotide
gataatgggaaggcgcagaat

SEQ ID NO: 13334 - DNA, 21 bp, Artificial Sequence
  Description of Artificial Sequence: Synthetic oligonucleotide
cagggggagcgttctttggcg

SEQ ID NO: 13335 - DNA, 21 bp, Artificial Sequence
  Description of Artificial Sequence: Synthetic oligonucleotide
agcggcgaaaacaacagagtc

SEQ ID NO: 13336 - DNA, 21 bp, Artificial Sequence
  Description of Artificial Sequence: Synthetic oligonucleotide
ctccaaaaccaaaaagacggc

SEQ ID NO: 13337 - DNA, 21 bp, Artificial Sequence
  Description of Artificial Sequence: Synthetic oligonucleotide
gcgtctactggggcttcgaag

SEQ ID NO: 13338 - DNA, 21 bp, Artificial Sequence
  Description of Artificial Sequence: Synthetic oligonucleotide
ggcagcggcaaagacagaaac

SEQ ID NO: 13339 - DNA, 21 bp, Artificial Sequence
  Description of Artificial Sequence: Synthetic oligonucleotide
ggtacgggggtgtctaataag

SEQ ID NO: 13340 - DNA, 21 bp, Artificial Sequence
  Description of Artificial Sequence: Synthetic oligonucleotide
ggcaacgccgccaaaccccaa

SEQ ID NO: 13341 - DNA, 21 bp, Artificial Sequence
  Description of Artificial Sequence: Synthetic oligonucleotide
agcggcgacagcaaaagacac

SEQ ID NO: 13342 - DNA, 21 bp, Artificial Sequence
  Description of Artificial Sequence: Synthetic oligonucleotide
accagcaccagcaaaaacacc

SEQ ID NO: 13343 - DNA, 21 bp, Artificial Sequence
  Description of Artificial Sequence: Synthetic oligonucleotide
gggtctacggggaataattct

SEQ ID NO: 13344 - DNA, 21 bp, Artificial Sequence
  Description of Artificial Sequence: Synthetic oligonucleotide
tctggtagttctgggggtcgg

SEQ ID NO: 13345 - DNA, 21 bp, Artificial Sequence
  Description of Artificial Sequence: Synthetic oligonucleotide
ttcggcaccaaaggcggcgaa

SEQ ID NO: 13346 - DNA, 21 bp, Artificial Sequence
  Description of Artificial Sequence: Synthetic oligonucleotide
tctacgggtgttaagcctatg

SEQ ID NO: 13347 - DNA, 21 bp, Artificial Sequence
  Description of Artificial Sequence: Synthetic oligonucleotide
aacagcgtcggcaaaagcggc

SEQ ID NO: 13348 - DNA, 21 bp, Artificial Sequence
  Description of Artificial Sequence: Synthetic oligonucleotide
ggcatcgccggccccaaaagc

SEQ ID NO: 13349 - DNA, 21 bp, Artificial Sequence
  Description of Artificial Sequence: Synthetic oligonucleotide
tctaagcctactagtgggggg

SEQ ID NO: 13350 - DNA, 21 bp, Artificial Sequence
  Description of Artificial Sequence: Synthetic oligonucleotide
tcggctagtacgaagtcggtt

SEQ ID NO: 13351 - DNA, 21 bp, Artificial Sequence
  Description of Artificial Sequence: Synthetic oligonucleotide
ggcaccagccaaaaaccccac

SEQ ID NO: 13352 - DNA, 21 bp, Artificial Sequence
  Description of Artificial Sequence: Synthetic oligonucleotide
ggcaacggcagccccaccagc

SEQ ID NO: 13353 - DNA, 21 bp, Artificial Sequence
  Description of Artificial Sequence: Synthetic oligonucleotide
aacagcggcgccaccaaaaac

SEQ ID NO: 13354 - DNA, 21 bp, Artificial Sequence
  Description of Artificial Sequence: Synthetic oligonucleotide
gacaccgcccaacacaacaga

SEQ ID NO: 13355 - DNA, 21 bp, Artificial Sequence
  Description of Artificial Sequence: Synthetic oligonucleotide
caaagaaccggcagcaacagc

SEQ ID NO: 13356 - DNA, 21 bp, Artificial Sequence
  Description of Artificial Sequence: Synthetic oligonucleotide
ctgaaggacagtaagccgttg

SEQ ID NO: 13357 - DNA, 21 bp, Artificial Sequence
  Description of Artificial Sequence: Synthetic oligonucleotide
agccccaccaacagcccccac

SEQ ID NO: 13358 - DNA, 21 bp, Artificial Sequence
  Description of Artificial Sequence: Synthetic oligonucleotide
aacggcacccaaaaaagccac

SEQ ID NO: 13359 - DNA, 21 bp, Artificial Sequence
  Description of Artificial Sequence: Synthetic oligonucleotide
acggttgggaagccgagttcg

SEQ ID NO: 13360 - DNA, 21 bp, Artificial Sequence
  Description of Artificial Sequence: Synthetic oligonucleotide
gggcggggggagagtagtaag

SEQ ID NO: 13361 - DNA, 21 bp, Artificial Sequence
  Description of Artificial Sequence: Synthetic oligonucleotide
gtgactcagagtgctagtaag

SEQ ID NO: 13362 - DNA, 21 bp, Artificial Sequence
  Description of Artificial Sequence: Synthetic oligonucleotide
ggcaacggcaccaaaaccatc

SEQ ID NO: 13363 - DNA, 21 bp, Artificial Sequence
  Description of Artificial Sequence: Synthetic oligonucleotide
gtgcagcaggatccggttagg

SEQ ID NO: 13364 - DNA, 21 bp, Artificial Sequence
  Description of Artificial Sequence: Synthetic oligonucleotide
agaagagaaaccaccaacacc

SEQ ID NO: 13365 - DNA, 21 bp, Artificial Sequence
  Description of Artificial Sequence: Synthetic oligonucleotide
gccggcaacaacacccacacc

SEQ ID NO: 13366 - DNA, 21 bp, Artificial Sequence
  Description of Artificial Sequence: Synthetic oligonucleotide
tctcagaatgctccgcataat

SEQ ID NO: 13367 - DNA, 21 bp, Artificial Sequence
  Description of Artificial Sequence: Synthetic oligonucleotide
tctctgcagccgccgtcgaag

SEQ ID NO: 13368 - DNA, 21 bp, Artificial Sequence
  Description of Artificial Sequence: Synthetic oligonucleotide
agaggcgacagcagaagagaa

SEQ ID NO: 13369 - DNA, 21 bp, Artificial Sequence
  Description of Artificial Sequence: Synthetic oligonucleotide
tttgggaaggggtctaatacg

SEQ ID NO: 13370 - DNA, 21 bp, Artificial Sequence
  Description of Artificial Sequence: Synthetic oligonucleotide
gcccccgccaccaaacccagc

SEQ ID NO: 13371 - DNA, 21 bp, Artificial Sequence
  Description of Artificial Sequence: Synthetic oligonucleotide
gaacccaccggcagaaacaac

SEQ ID NO: 13372 - DNA, 21 bp, Artificial Sequence
  Description of Artificial Sequence: Synthetic oligonucleotide
ctgaggagtaaggagtctact

SEQ ID NO: 13373 - DNA, 21 bp, Artificial Sequence
  Description of Artificial Sequence: Synthetic oligonucleotide
gacggcgccggcaaacccacc

SEQ ID NO: 13374 - DNA, 21 bp, Artificial Sequence
  Description of Artificial Sequence: Synthetic oligonucleotide
gttcagacgggtgcgtctaag

SEQ ID NO: 13375 - DNA, 21 bp, Artificial Sequence
  Description of Artificial Sequence: Synthetic oligonucleotide
ggcgccagcaacggccacggc

SEQ ID NO: 13376 - DNA, 21 bp, Artificial Sequence
  Description of Artificial Sequence: Synthetic oligonucleotide
atggacaaacccaccgtcgtc

SEQ ID NO: 13377 - DNA, 21 bp, Artificial Sequence
  Description of Artificial Sequence: Synthetic oligonucleotide
gacccccaacccaccgccaaa

SEQ ID NO: 13378 - DNA, 21 bp, Artificial Sequence
  Description of Artificial Sequence: Synthetic oligonucleotide
gacagcagccccaccctcaaa

SEQ ID NO: 13379 - DNA, 21 bp, Artificial Sequence
  Description of Artificial Sequence: Synthetic oligonucleotide
ggtcttcgtggtcagaatacg

SEQ ID NO: 13380 - DNA, 21 bp, Artificial Sequence
  Description of Artificial Sequence: Synthetic oligonucleotide
tcggcttcggatagggcgtct

SEQ ID NO: 13381 - DNA, 21 bp, Artificial Sequence
  Description of Artificial Sequence: Synthetic oligonucleotide
ggtactacgggtgcgcgtacg

SEQ ID NO: 13382 - DNA, 21 bp, Artificial Sequence
  Description of Artificial Sequence: Synthetic oligonucleotide
gatggtacgtcttcgcttagg

SEQ ID NO: 13383 - DNA, 21 bp, Artificial Sequence
  Description of Artificial Sequence: Synthetic oligonucleotide
agagacggcgccagccaagcc

SEQ ID NO: 13384 - DNA, 21 bp, Artificial Sequence
  Description of Artificial Sequence: Synthetic oligonucleotide
accggcggcagcaaagccacc

SEQ ID NO: 13385 - DNA, 21 bp, Artificial Sequence
  Description of Artificial Sequence: Synthetic oligonucleotide
atgcatgataaggcgactgcg

SEQ ID NO: 13386 - DNA, 21 bp, Artificial Sequence
  Description of Artificial Sequence: Synthetic oligonucleotide
ggcgccagcagccccagaaac

SEQ ID NO: 13387 - DNA, 21 bp, Artificial Sequence
  Description of Artificial Sequence: Synthetic oligonucleotide
tcgggtaataataattcgaag

SEQ ID NO: 13388 - DNA, 21 bp, Artificial Sequence
  Description of Artificial Sequence: Synthetic oligonucleotide
aatgggggtcgtgctccggtt

SEQ ID NO: 13389 - DNA, 21 bp, Artificial Sequence
  Description of Artificial Sequence: Synthetic oligonucleotide
agcaccgtcgccagccccaaa

SEQ ID NO: 13390 - DNA, 21 bp, Artificial Sequence
  Description of Artificial Sequence: Synthetic oligonucleotide
gtcaacaacggcaaacccagc

SEQ ID NO: 13391 - DNA, 21 bp, Artificial Sequence
  Description of Artificial Sequence: Synthetic oligonucleotide
gggggtgttaagcattctgat

SEQ ID NO: 13392 - DNA, 21 bp, Artificial Sequence
  Description of Artificial Sequence: Synthetic oligonucleotide
agaaacagccaagccagcggc

SEQ ID NO: 13393 - DNA, 21 bp, Artificial Sequence
  Description of Artificial Sequence: Synthetic oligonucleotide
tcgaatcagtcggggtctaag

SEQ ID NO: 13394 - DNA, 21 bp, Artificial Sequence
  Description of Artificial Sequence: Synthetic oligonucleotide
gccatgaacaacaaagccgaa

SEQ ID NO: 13395 - DNA, 21 bp, Artificial Sequence
  Description of Artificial Sequence: Synthetic oligonucleotide
gccagcaacaaccccagaacc

SEQ ID NO: 13396 - DNA, 21 bp, Artificial Sequence
  Description of Artificial Sequence: Synthetic oligonucleotide
gaggggcagagtccgcagtct

SEQ ID NO: 13397 - DNA, 21 bp, Artificial Sequence
  Description of Artificial Sequence: Synthetic oligonucleotide
accggcagcggcaacagcagc

SEQ ID NO: 13398 - DNA, 21 bp, Artificial Sequence
  Description of Artificial Sequence: Synthetic oligonucleotide
agcggcagcgccaacctcacc

SEQ ID NO: 13399 - DNA, 21 bp, Artificial Sequence
  Description of Artificial Sequence: Synthetic oligonucleotide
atgggccaagccagcaacatc

SEQ ID NO: 13400 - DNA, 21 bp, Artificial Sequence
  Description of Artificial Sequence: Synthetic oligonucleotide
ctggggaatcagtctcctaag

SEQ ID NO: 13401 - DNA, 21 bp, Artificial Sequence
  Description of Artificial Sequence: Synthetic oligonucleotide
ggcagcgacagaagcagcggc

SEQ ID NO: 13402 - DNA, 21 bp, Artificial Sequence
  Description of Artificial Sequence: Synthetic oligonucleotide
gttgttaataaggcttcgtcg

SEQ ID NO: 13403 - DNA, 21 bp, Artificial Sequence
  Description of Artificial Sequence: Synthetic oligonucleotide
acggggcgtcctagtcctact

SEQ ID NO: 13404 - DNA, 21 bp, Artificial Sequence
  Description of Artificial Sequence: Synthetic oligonucleotide
agcagcggcgacaaaagacac

SEQ ID NO: 13405 - DNA, 21 bp, Artificial Sequence
  Description of Artificial Sequence: Synthetic oligonucleotide
gatagtgcggcgaagatgagt

SEQ ID NO: 13406 - DNA, 21 bp, Artificial Sequence
  Description of Artificial Sequence: Synthetic oligonucleotide
ggcaccagcacccccgtcacc

SEQ ID NO: 13407 - DNA, 21 bp, Artificial Sequence
  Description of Artificial Sequence: Synthetic oligonucleotide
acggtgggtaaggttaatagt

SEQ ID NO: 13408 - DNA, 21 bp, Artificial Sequence
  Description of Artificial Sequence: Synthetic oligonucleotide
gttgggaattcgcagcctcct

SEQ ID NO: 13409 - DNA, 21 bp, Artificial Sequence
  Description of Artificial Sequence: Synthetic oligonucleotide
acgggggtttcgaagcctgtt

SEQ ID NO: 13410 - DNA, 21 bp, Artificial Sequence
  Description of Artificial Sequence: Synthetic oligonucleotide
agtgagaagacggcgaattct

SEQ ID NO: 13411 - DNA, 21 bp, Artificial Sequence
  Description of Artificial Sequence: Synthetic oligonucleotide
tcgtctggtacttctgctggt

SEQ ID NO: 13412 - DNA, 21 bp, Artificial Sequence
  Description of Artificial Sequence: Synthetic oligonucleotide
gggcgtagtggtacgaatgct

SEQ ID NO: 13413 - DNA, 21 bp, Artificial Sequence
  Description of Artificial Sequence: Synthetic oligonucleotide
gttgcgcagtctccgacttct

SEQ ID NO: 13414 - DNA, 21 bp, Artificial Sequence
  Description of Artificial Sequence: Synthetic oligonucleotide
catgggtcgtctagtggtaag

SEQ ID NO: 13415 - DNA, 21 bp, Artificial Sequence
  Description of Artificial Sequence: Synthetic oligonucleotide
aatccgtctgggtcgacgggt

SEQ ID NO: 13416 - DNA, 21 bp, Artificial Sequence
  Description of Artificial Sequence: Synthetic oligonucleotide
caagccgaaaacagcagaaac

SEQ ID NO: 13417 - DNA, 21 bp, Artificial Sequence
  Description of Artificial Sequence: Synthetic oligonucleotide
accagcagcaccaacttcagc

SEQ ID NO: 13418 - DNA, 21 bp, Artificial Sequence
  Description of Artificial Sequence: Synthetic oligonucleotide
actggtagtcagtcgtcgggt

SEQ ID NO: 13419 - DNA, 21 bp, Artificial Sequence
  Description of Artificial Sequence: Synthetic oligonucleotide
tctggtgttacgaagtcgtcg

SEQ ID NO: 13420 - DNA, 21 bp, Artificial Sequence
  Description of Artificial Sequence: Synthetic oligonucleotide
caaggcagcaaaagcgtcctc

SEQ ID NO: 13421 - DNA, 21 bp, Artificial Sequence
  Description of Artificial Sequence: Synthetic oligonucleotide
gcgggtgcttctgttaatgcg

SEQ ID NO: 13422 - DNA, 21 bp, Artificial Sequence
  Description of Artificial Sequence: Synthetic oligonucleotide
tctcgtgatagtccgcctaag

SEQ ID NO: 13423 - DNA, 21 bp, Artificial Sequence
  Description of Artificial Sequence: Synthetic oligonucleotide
cgttctgataataaggcgagt

SEQ ID NO: 13424 - DNA, 21 bp, Artificial Sequence
  Description of Artificial Sequence: Synthetic oligonucleotide
caagtccaaaaaagcagcagc

SEQ ID NO: 13425 - DNA, 21 bp, Artificial Sequence
  Description of Artificial Sequence: Synthetic oligonucleotide
ggcagcgtcaccaacagcggc

SEQ ID NO: 13426 - DNA, 21 bp, Artificial Sequence
  Description of Artificial Sequence: Synthetic oligonucleotide
ggcggcgccagccccagcaga

SEQ ID NO: 13427 - DNA, 21 bp, Artificial Sequence
  Description of Artificial Sequence: Synthetic oligonucleotide
ctgcaggcgaataagtctcag

SEQ ID NO: 13428 - DNA, 21 bp, Artificial Sequence
  Description of Artificial Sequence: Synthetic oligonucleotide
gggcgttctggtgagaattcg

SEQ ID NO: 13429 - DNA, 21 bp, Artificial Sequence
  Description of Artificial Sequence: Synthetic oligonucleotide
aacgaaagcaacagacaaagc

SEQ ID NO: 13430 - DNA, 21 bp, Artificial Sequence
  Description of Artificial Sequence: Synthetic oligonucleotide
accatcggcaaaggcggcagc

SEQ ID NO: 13431 - DNA, 21 bp, Artificial Sequence
  Description of Artificial Sequence: Synthetic oligonucleotide
ggcaccggcagcggcagcaga

SEQ ID NO: 13432 - DNA, 21 bp, Artificial Sequence
  Description of Artificial Sequence: Synthetic oligonucleotide
atttcgggtagtaattctaag

SEQ ID NO: 13433 - DNA, 21 bp, Artificial Sequence
  Description of Artificial Sequence: Synthetic oligonucleotide
gaaaacagcaccgcccccaaa

SEQ ID NO: 13434 - DNA, 21 bp, Artificial Sequence
  Description of Artificial Sequence: Synthetic oligonucleotide
gggggttctgggactatgaag

SEQ ID NO: 13435 - DNA, 21 bp, Artificial Sequence
  Description of Artificial Sequence: Synthetic oligonucleotide
gccggcgccagccccaaccac

SEQ ID NO: 13436 - DNA, 21 bp, Artificial Sequence
  Description of Artificial Sequence: Synthetic oligonucleotide
gaccaaagcaccaaaggcagc

SEQ ID NO: 13437 - DNA, 21 bp, Artificial Sequence
  Description of Artificial Sequence: Synthetic oligonucleotide
ggcgacctcaccagcaccaaa

SEQ ID NO: 13438 - DNA, 21 bp, Artificial Sequence
  Description of Artificial Sequence: Synthetic oligonucleotide
gccggcaaaagcaccgtcaac

SEQ ID NO: 13439 - DNA, 21 bp, Artificial Sequence
  Description of Artificial Sequence: Synthetic oligonucleotide
gctactcatgctcctcagagt

SEQ ID NO: 13440 - DNA, 21 bp, Artificial Sequence
  Description of Artificial Sequence: Synthetic oligonucleotide
gccaccaaacccagccaaggc

SEQ ID NO: 13441 - DNA, 21 bp, Artificial Sequence
  Description of Artificial Sequence: Synthetic oligonucleotide
acggatagtggggcttcgaag

SEQ ID NO: 13442 - DNA, 21 bp, Artificial Sequence
  Description of Artificial Sequence: Synthetic oligonucleotide
acgactgggtcgaagggtatg

SEQ ID NO: 13443 - DNA, 21 bp, Artificial Sequence
  Description of Artificial Sequence: Synthetic oligonucleotide
actggtgcgaataatctgaag

SEQ ID NO: 13444 - DNA, 21 bp, Artificial Sequence
  Description of Artificial Sequence: Synthetic oligonucleotide
agcagaagcaccaaacccgaa

SEQ ID NO: 13445 - DNA, 21 bp, Artificial Sequence
  Description of Artificial Sequence: Synthetic oligonucleotide
gggagtggtggtagtaagagt

SEQ ID NO: 13446 - DNA, 21 bp, Artificial Sequence
  Description of Artificial Sequence: Synthetic oligonucleotide
accagcggcagccccaacagc

SEQ ID NO: 13447 - DNA, 21 bp, Artificial Sequence
  Description of Artificial Sequence: Synthetic oligonucleotide
agtatgggtaagtcggcggtg

SEQ ID NO: 13448 - DNA, 21 bp, Artificial Sequence
  Description of Artificial Sequence: Synthetic oligonucleotide
tcggctgctggtagtccgact

SEQ ID NO: 13449 - DNA, 21 bp, Artificial Sequence
  Description of Artificial Sequence: Synthetic oligonucleotide
actcagaatagtccgaatggt

SEQ ID NO: 13450 - DNA, 21 bp, Artificial Sequence
  Description of Artificial Sequence: Synthetic oligonucleotide
agttcttcgcagaagccgtcg

SEQ ID NO: 13451 - DNA, 21 bp, Artificial Sequence
  Description of Artificial Sequence: Synthetic oligonucleotide
aagggggcgccgaataattct

SEQ ID NO: 13452 - DNA, 21 bp, Artificial Sequence
  Description of Artificial Sequence: Synthetic oligonucleotide
actagggatgttaaggcgggg

SEQ ID NO: 13453 - DNA, 21 bp, Artificial Sequence
  Description of Artificial Sequence: Synthetic oligonucleotide
cacagagaaagcaaaagcacc

SEQ ID NO: 13454 - DNA, 21 bp, Artificial Sequence
  Description of Artificial Sequence: Synthetic oligonucleotide
ggttcggataagaatcggggg

SEQ ID NO: 13455 - DNA, 21 bp, Artificial Sequence
  Description of Artificial Sequence: Synthetic oligonucleotide
atcagcaacaaaagcagcaac

SEQ ID NO: 13456 - DNA, 21 bp, Artificial Sequence
  Description of Artificial Sequence: Synthetic oligonucleotide
gggaattcgggtccttcgaag

SEQ ID NO: 13457 - DNA, 21 bp, Artificial Sequence
  Description of Artificial Sequence: Synthetic oligonucleotide
caggggaatgatcgtaaggtt

SEQ ID NO: 13458 - DNA, 21 bp, Artificial Sequence
  Description of Artificial Sequence: Synthetic oligonucleotide
gctccggatacgaagccgact

SEQ ID NO: 13459 - DNA, 21 bp, Artificial Sequence
  Description of Artificial Sequence: Synthetic oligonucleotide
cagggtaagactgggtcggtt

SEQ ID NO: 13460 - DNA, 21 bp, Artificial Sequence
  Description of Artificial Sequence: Synthetic oligonucleotide
gcgaatacgactgcgagtgtt

SEQ ID NO: 13461 - DNA, 21 bp, Artificial Sequence
  Description of Artificial Sequence: Synthetic oligonucleotide
actaattcttcgtctcatatg

SEQ ID NO: 13462 - DNA, 21 bp, Artificial Sequence
  Description of Artificial Sequence: Synthetic oligonucleotide
ggtgcggggcgtgagggggct

SEQ ID NO: 13463 - DNA, 21 bp, Artificial Sequence
  Description of Artificial Sequence: Synthetic oligonucleotide
gatagttcgacgcgtcctttg

SEQ ID NO: 13464 - DNA, 21 bp, Artificial Sequence
  Description of Artificial Sequence: Synthetic oligonucleotide
acgcctggttcgaagactatg

SEQ ID NO: 13465 - DNA, 21 bp, Artificial Sequence
  Description of Artificial Sequence: Synthetic oligonucleotide
gagtctgctacgaagtcgtcg

SEQ ID NO: 13466 - DNA, 21 bp, Artificial Sequence
  Description of Artificial Sequence: Synthetic oligonucleotide
aatcaggatgcgaagcagtat

SEQ ID NO: 13467 - DNA, 21 bp, Artificial Sequence
  Description of Artificial Sequence: Synthetic oligonucleotide
tcggtggggaattcgaataag

SEQ ID NO: 13468 - DNA, 21 bp, Artificial Sequence
  Description of Artificial Sequence: Synthetic oligonucleotide
tctcagggtgataagactacg

SEQ ID NO: 13469 - DNA, 21 bp, Artificial Sequence
  Description of Artificial Sequence: Synthetic oligonucleotide
aatcggaatggtacttcgggg

SEQ ID NO: 13470 - DNA, 21 bp, Artificial Sequence
  Description of Artificial Sequence: Synthetic oligonucleotide
cagtcgagtggtaaggggggt

SEQ ID NO: 13471 - DNA, 21 bp, Artificial Sequence
  Description of Artificial Sequence: Synthetic oligonucleotide
ggcgccagccaaaaaaccgtc

SEQ ID NO: 13472 - DNA, 21 bp, Artificial Sequence
  Description of Artificial Sequence: Synthetic oligonucleotide
aatggtactactacggggggg

SEQ ID NO: 13473 - DNA, 21 bp, Artificial Sequence
  Description of Artificial Sequence: Synthetic oligonucleotide
gtccccagcaaaaccagcacc

SEQ ID NO: 13474 - DNA, 21 bp, Artificial Sequence
  Description of Artificial Sequence: Synthetic oligonucleotide
acccccagcaacagaaccgaa

SEQ ID NO: 13475 - DNA, 21 bp, Artificial Sequence
  Description of Artificial Sequence: Synthetic oligonucleotide
ggtagggataagggtacgggt

SEQ ID NO: 13476 - DNA, 21 bp, Artificial Sequence
  Description of Artificial Sequence: Synthetic oligonucleotide
accagccccggcaaacccgtc

SEQ ID NO: 13477 - DNA, 21 bp, Artificial Sequence
  Description of Artificial Sequence: Synthetic oligonucleotide
ggtcgtactaatgagcctaag

SEQ ID NO: 13478 - DNA, 21 bp, Artificial Sequence
  Description of Artificial Sequence: Synthetic oligonucleotide
ggcagcagcagccccatcaaa

SEQ ID NO: 13479 - DNA, 21 bp, Artificial Sequence
  Description of Artificial Sequence: Synthetic oligonucleotide
acccaagccgtcaaaagcatc

SEQ ID NO: 13480 - DNA, 21 bp, Artificial Sequence
  Description of Artificial Sequence: Synthetic oligonucleotide
agttcggggagtggtgctggt

SEQ ID NO: 13481 - DNA, 21 bp, Artificial Sequence
  Description of Artificial Sequence: Synthetic oligonucleotide
cagactactcctgcttctggt

SEQ ID NO: 13482 - DNA, 21 bp, Artificial Sequence
  Description of Artificial Sequence: Synthetic oligonucleotide
caggctcagactgataagagt

SEQ ID NO: 13483 - DNA, 21 bp, Artificial Sequence
  Description of Artificial Sequence: Synthetic oligonucleotide
cataataattctaaggagcgg

SEQ ID NO: 13484 - DNA, 21 bp, Artificial Sequence
  Description of Artificial Sequence: Synthetic oligonucleotide
gcccacggcagcaacccccaa

SEQ ID NO: 13485 - DNA, 21 bp, Artificial Sequence
  Description of Artificial Sequence: Synthetic oligonucleotide
ggcaccgaaaacgccggcaga

SEQ ID NO: 13486 - DNA, 21 bp, Artificial Sequence
  Description of Artificial Sequence: Synthetic oligonucleotide
ggccccagcaccagcggcgcc

SEQ ID NO: 13487 - DNA, 21 bp, Artificial Sequence
  Description of Artificial Sequence: Synthetic oligonucleotide
caaaacaaaagcgtcgccagc

SEQ ID NO: 13488 - DNA, 21 bp, Artificial Sequence
  Description of Artificial Sequence: Synthetic oligonucleotide
ggtaatcagaagcctccgact

SEQ ID NO: 13489 - DNA, 21 bp, Artificial Sequence
  Description of Artificial Sequence: Synthetic oligonucleotide
tcggcgcatgttaaggggtct

SEQ ID NO: 13490 - DNA, 21 bp, Artificial Sequence
  Description of Artificial Sequence: Synthetic oligonucleotide
ggtgttgcgacttctgcttct

SEQ ID NO: 13491 - DNA, 21 bp, Artificial Sequence
  Description of Artificial Sequence: Synthetic oligonucleotide
tctggtcattctcctgttaat

SEQ ID NO: 13492 - DNA, 21 bp, Artificial Sequence
  Description of Artificial Sequence: Synthetic oligonucleotide
agcaacgacagcgccagaaaa

SEQ ID NO: 13493 - DNA, 21 bp, Artificial Sequence
  Description of Artificial Sequence: Synthetic oligonucleotide
aacgccagcaccaaagccctc

SEQ ID NO: 13494 - DNA, 21 bp, Artificial Sequence
  Description of Artificial Sequence: Synthetic oligonucleotide
actaatatgaagccgagttct

SEQ ID NO: 13495 - DNA, 21 bp, Artificial Sequence
  Description of Artificial Sequence: Synthetic oligonucleotide
gccagcgcccaagtcagcaaa

SEQ ID NO: 13496 - DNA, 21 bp, Artificial Sequence
  Description of Artificial Sequence: Synthetic oligonucleotide
ggcaccagcaaaagcgccgcc

SEQ ID NO: 13497 - DNA, 21 bp, Artificial Sequence
  Description of Artificial Sequence: Synthetic oligonucleotide
acccccgacagcaaaggcaaa

SEQ ID NO: 13498 - DNA, 21 bp, Artificial Sequence
  Description of Artificial Sequence: Synthetic oligonucleotide
cagcagaattctgatacgaag

SEQ ID NO: 13499 - DNA, 21 bp, Artificial Sequence
  Description of Artificial Sequence: Synthetic oligonucleotide
gataggtcgccggggactgct

SEQ ID NO: 13500 - DNA, 21 bp, Artificial Sequence
  Description of Artificial Sequence: Synthetic oligonucleotide
gccggcggcggcggcgtcaac

SEQ ID NO: 13501 - DNA, 21 bp, Artificial Sequence
  Description of Artificial Sequence: Synthetic oligonucleotide
ttgactcagaagcagagtggt

SEQ ID NO: 13502 - DNA, 21 bp, Artificial Sequence
  Description of Artificial Sequence: Synthetic oligonucleotide
gaaagaagcaccagcagcgcc

SEQ ID NO: 13503 - DNA, 21 bp, Artificial Sequence
  Description of Artificial Sequence: Synthetic oligonucleotide
cacagaggcgacagccaagcc

SEQ ID NO: 13504 - DNA, 21 bp, Artificial Sequence
  Description of Artificial Sequence: Synthetic oligonucleotide
aacagccacaccaccccccaa

SEQ ID NO: 13505 - DNA, 21 bp, Artificial Sequence
  Description of Artificial Sequence: Synthetic oligonucleotide
ggcaccaacacccccagagcc

SEQ ID NO: 13506 - DNA, 21 bp, Artificial Sequence
  Description of Artificial Sequence: Synthetic oligonucleotide
gggggggttcagtcttctaag

SEQ ID NO: 13507 - DNA, 21 bp, Artificial Sequence
  Description of Artificial Sequence: Synthetic oligonucleotide
ggttctaatcgttctagtgag

SEQ ID NO: 13508 - DNA, 21 bp, Artificial Sequence
  Description of Artificial Sequence: Synthetic oligonucleotide
gacagagccaccagcgcccaa

SEQ ID NO: 13509 - DNA, 21 bp, Artificial Sequence
  Description of Artificial Sequence: Synthetic oligonucleotide
aatcagagtgggactaagggt

SEQ ID NO: 13510 - DNA, 21 bp, Artificial Sequence
  Description of Artificial Sequence: Synthetic oligonucleotide
agcggcagcggccccaccaga

SEQ ID NO: 13511 - DNA, 21 bp, Artificial Sequence
  Description of Artificial Sequence: Synthetic oligonucleotide
agccaaaccaaaagcctcacc

SEQ ID NO: 13512 - DNA, 21 bp, Artificial Sequence
  Description of Artificial Sequence: Synthetic oligonucleotide
cagtctaagcctggtggttct

SEQ ID NO: 13513 - DNA, 21 bp, Artificial Sequence
  Description of Artificial Sequence: Synthetic oligonucleotide
caggcggttcctacggctggt

SEQ ID NO: 13514 - DNA, 21 bp, Artificial Sequence
  Description of Artificial Sequence: Synthetic oligonucleotide
agcggcaccgaagtcatcaaa

SEQ ID NO: 13515 - DNA, 21 bp, Artificial Sequence
  Description of Artificial Sequence: Synthetic oligonucleotide
agtctgactaagcctcagacg

SEQ ID NO: 13516 - DNA, 21 bp, Artificial Sequence
  Description of Artificial Sequence: Synthetic oligonucleotide
cacggcgaaagaaccaacaac

SEQ ID NO: 13517 - DNA, 21 bp, Artificial Sequence
  Description of Artificial Sequence: Synthetic oligonucleotide
ggtaataataagacgcttatg

SEQ ID NO: 13518 - DNA, 21 bp, Artificial Sequence
  Description of Artificial Sequence: Synthetic oligonucleotide
actacgggtgagaagcgtcct

SEQ ID NO: 13519 - DNA, 21 bp, Artificial Sequence
  Description of Artificial Sequence: Synthetic oligonucleotide
gaaatgatcagcaaaagcaaa

SEQ ID NO: 13520 - DNA, 21 bp, Artificial Sequence
  Description of Artificial Sequence: Synthetic oligonucleotide
gaacacagaagccccagcatc

SEQ ID NO: 13521 - DNA, 21 bp, Artificial Sequence
  Description of Artificial Sequence: Synthetic oligonucleotide
ggcctcgaaaccagagcccaa

SEQ ID NO: 13522 - DNA, 21 bp, Artificial Sequence
  Description of Artificial Sequence: Synthetic oligonucleotide
actggtgtgtcgccggtggcg

SEQ ID NO: 13523 - DNA, 21 bp, Artificial Sequence
  Description of Artificial Sequence: Synthetic oligonucleotide
tcttcgacttcttcggcttct

SEQ ID NO: 13524 - DNA, 21 bp, Artificial Sequence
  Description of Artificial Sequence: Synthetic oligonucleotide
tctggtaatgctaagagtaat

SEQ ID NO: 13525 - DNA, 21 bp, Artificial Sequence
  Description of Artificial Sequence: Synthetic oligonucleotide
ggtgtggcgtctccgcgttct

SEQ ID NO: 13526 - DNA, 21 bp, Artificial Sequence
  Description of Artificial Sequence: Synthetic oligonucleotide
ggtcctttggctactgttaag

SEQ ID NO: 13527 - DNA, 21 bp, Artificial Sequence
  Description of Artificial Sequence: Synthetic oligonucleotide
agccccaccagccaaaacaac

SEQ ID NO: 13528 - DNA, 21 bp, Artificial Sequence
  Description of Artificial Sequence: Synthetic oligonucleotide
cagggtaaggcgcagcaggcg

SEQ ID NO: 13529 - DNA, 21 bp, Artificial Sequence
  Description of Artificial Sequence: Synthetic oligonucleotide
ggcaccgccagccaaaacagc

SEQ ID NO: 13530 - DNA, 21 bp, Artificial Sequence
  Description of Artificial Sequence: Synthetic oligonucleotide
aacagcgccagcagcagcagc

SEQ ID NO: 13531 - DNA, 21 bp, Artificial Sequence
  Description of Artificial Sequence: Synthetic oligonucleotide
ctcgccaccaaaggcagcgcc

SEQ ID NO: 13532 - DNA, 21 bp, Artificial Sequence
  Description of Artificial Sequence: Synthetic oligonucleotide
ggcagagaccacaaaaccagc

SEQ ID NO: 13533 - DNA, 21 bp, Artificial Sequence
  Description of Artificial Sequence: Synthetic oligonucleotide
ggcagccccggcaccagcaac

SEQ ID NO: 13534 - DNA, 21 bp, Artificial Sequence
  Description of Artificial Sequence: Synthetic oligonucleotide
aggtcggatggtaataagggg

SEQ ID NO: 13535 - DNA, 21 bp, Artificial Sequence
  Description of Artificial Sequence: Synthetic oligonucleotide
accagccaaagagaccacgcc

SEQ ID NO: 13536 - DNA, 21 bp, Artificial Sequence
  Description of Artificial Sequence: Synthetic oligonucleotide
ggggtgcctaaggataagggg

SEQ ID NO: 13537 - DNA, 21 bp, Artificial Sequence
  Description of Artificial Sequence: Synthetic oligonucleotide
gttggtacgaagtctcagggg

SEQ ID NO: 13538 - DNA, 21 bp, Artificial Sequence
  Description of Artificial Sequence: Synthetic oligonucleotide
gaagccaacagcagaagcacc

SEQ ID NO: 13539 - DNA, 21 bp, Artificial Sequence
  Description of Artificial Sequence: Synthetic oligonucleotide
accgtcagcacccccagcagc

SEQ ID NO: 13540 - DNA, 21 bp, Artificial Sequence
  Description of Artificial Sequence: Synthetic oligonucleotide
ggcaccaacagcccccccaga

SEQ ID NO: 13541 - DNA, 21 bp, Artificial Sequence
  Description of Artificial Sequence: Synthetic oligonucleotide
ggcccccaaggcgaaaacaga

SEQ ID NO: 13542 - DNA, 21 bp, Artificial Sequence
  Description of Artificial Sequence: Synthetic oligonucleotide
gaccaagccaaaggcggcaga

SEQ ID NO: 13543 - DNA, 21 bp, Artificial Sequence
  Description of Artificial Sequence: Synthetic oligonucleotide
agccaaagaagccccggcacc

SEQ ID NO: 13544 - DNA, 21 bp, Artificial Sequence
  Description of Artificial Sequence: Synthetic oligonucleotide
accaccaacaccaaagccacc

SEQ ID NO: 13545 - DNA, 21 bp, Artificial Sequence
  Description of Artificial Sequence: Synthetic oligonucleotide
gatggggttggtggtcgtggg

SEQ ID NO: 13546 - DNA, 21 bp, Artificial Sequence
  Description of Artificial Sequence: Synthetic oligonucleotide
ggccccaccaacagcgtcaaa

SEQ ID NO: 13547 - DNA, 21 bp, Artificial Sequence
  Description of Artificial Sequence: Synthetic oligonucleotide
actcctgtgaatagtccgcat

SEQ ID NO: 13548 - DNA, 21 bp, Artificial Sequence
  Description of Artificial Sequence: Synthetic oligonucleotide
agaggcagcggcagcagcagc

SEQ ID NO: 13549 - DNA, 21 bp, Artificial Sequence
  Description of Artificial Sequence: Synthetic oligonucleotide
ctccacagcgacaaaaccacc

SEQ ID NO: 13550 - DNA, 21 bp, Artificial Sequence
  Description of Artificial Sequence: Synthetic oligonucleotide
actagtcatgataagattcgg

SEQ ID NO: 13551 - DNA, 21 bp, Artificial Sequence
  Description of Artificial Sequence: Synthetic oligonucleotide
agcgtcgaaggcaaaaacaga

SEQ ID NO: 13552 - DNA, 21 bp, Artificial Sequence
  Description of Artificial Sequence: Synthetic oligonucleotide
ggtacgtcggtgaaggctact

SEQ ID NO: 13553 - DNA, 21 bp, Artificial Sequence
  Description of Artificial Sequence: Synthetic oligonucleotide
agcaacaccaacgccagcgtc

SEQ ID NO: 13554 - DNA, 21 bp, Artificial Sequence
  Description of Artificial Sequence: Synthetic oligonucleotide
gccaacagcagcaaagtcgtc

SEQ ID NO: 13555 - DNA, 21 bp, Artificial Sequence
  Description of Artificial Sequence: Synthetic oligonucleotide
cacaacagcagcaccagcagc

SEQ ID NO: 13556 - DNA, 21 bp, Artificial Sequence
  Description of Artificial Sequence: Synthetic oligonucleotide
aatgatggtaagaatagtttg

SEQ ID NO: 13557 - DNA, 21 bp, Artificial Sequence
  Description of Artificial Sequence: Synthetic oligonucleotide
actggtcagaatgggagtgcg

SEQ ID NO: 13558 - DNA, 21 bp, Artificial Sequence
  Description of Artificial Sequence: Synthetic oligonucleotide
ggccacgccgaaagcagcaaa

SEQ ID NO: 13559 - DNA, 21 bp, Artificial Sequence
  Description of Artificial Sequence: Synthetic oligonucleotide
agcgccggcggcaaacccgcc

SEQ ID NO: 13560 - DNA, 21 bp, Artificial Sequence
  Description of Artificial Sequence: Synthetic oligonucleotide
actcagtcgaagtcggcgatg

SEQ ID NO: 13561 - DNA, 21 bp, Artificial Sequence
  Description of Artificial Sequence: Synthetic oligonucleotide
cacacccacagccccacccaa

SEQ ID NO: 13562 - DNA, 21 bp, Artificial Sequence
  Description of Artificial Sequence: Synthetic oligonucleotide
acgaataataagcaggctctt

SEQ ID NO: 13563 - DNA, 21 bp, Artificial Sequence
  Description of Artificial Sequence: Synthetic oligonucleotide
tctagtacttcgaagacggtt

SEQ ID NO: 13564 - DNA, 21 bp, Artificial Sequence
  Description of Artificial Sequence: Synthetic oligonucleotide
actcaggagtctaagtatggt

SEQ ID NO: 13565 - DNA, 21 bp, Artificial Sequence
  Description of Artificial Sequence: Synthetic oligonucleotide
ggcctcaccggcaaaagcagc

SEQ ID NO: 13566 - DNA, 21 bp, Artificial Sequence
  Description of Artificial Sequence: Synthetic oligonucleotide
aacggcgtcccccccaaccaa

SEQ ID NO: 13567 - DNA, 21 bp, Artificial Sequence
  Description of Artificial Sequence: Synthetic oligonucleotide
agagacggcaacaacgccacc

SEQ ID NO: 13568 - DNA, 21 bp, Artificial Sequence
  Description of Artificial Sequence: Synthetic oligonucleotide
agcaccgccaccgccagcagc

SEQ ID NO: 13569 - DNA, 21 bp, Artificial Sequence
  Description of Artificial Sequence: Synthetic oligonucleotide
agcatgaccaaaaccaacgtc

SEQ ID NO: 13570 - DNA, 21 bp, Artificial Sequence
  Description of Artificial Sequence: Synthetic oligonucleotide
agcggcaaaagcgtcaacaac

SEQ ID NO: 13571 - DNA, 21 bp, Artificial Sequence
  Description of Artificial Sequence: Synthetic oligonucleotide
cacatcaacggcaaaagccaa

SEQ ID NO: 13572 - DNA, 21 bp, Artificial Sequence
  Description of Artificial Sequence: Synthetic oligonucleotide
ggcgccagcagcaaagaaaaa

SEQ ID NO: 13573 - DNA, 21 bp, Artificial Sequence
  Description of Artificial Sequence: Synthetic oligonucleotide
tcgtctccgcagagtacgggt

SEQ ID NO: 13574 - DNA, 21 bp, Artificial Sequence
  Description of Artificial Sequence: Synthetic oligonucleotide
gcttcggctaagtcgagtacg

SEQ ID NO: 13575 - DNA, 21 bp, Artificial Sequence
  Description of Artificial Sequence: Synthetic oligonucleotide
aatcaggctacggctttgtcg

SEQ ID NO: 13576 - DNA, 21 bp, Artificial Sequence
  Description of Artificial Sequence: Synthetic oligonucleotide
caagtcaccaaaaccaacaac

SEQ ID NO: 13577 - DNA, 21 bp, Artificial Sequence
  Description of Artificial Sequence: Synthetic oligonucleotide
caacaaaacagcaaactcgtc

SEQ ID NO: 13578 - DNA, 21 bp, Artificial Sequence
  Description of Artificial Sequence: Synthetic oligonucleotide
gccgccggcgccaaaagcggc

SEQ ID NO: 13579 - DNA, 21 bp, Artificial Sequence
  Description of Artificial Sequence: Synthetic oligonucleotide
aaccccagcaacaaaaacaac

SEQ ID NO: 13580 - DNA, 21 bp, Artificial Sequence
  Description of Artificial Sequence: Synthetic oligonucleotide
agcgccagcagagacaaagcc

SEQ ID NO: 13581 - DNA, 21 bp, Artificial Sequence
  Description of Artificial Sequence: Synthetic oligonucleotide
accgccagcaacacccccagc

SEQ ID NO: 13582 - DNA, 21 bp, Artificial Sequence
  Description of Artificial Sequence: Synthetic oligonucleotide
acccccagccaaaaaggcacc

SEQ ID NO: 13583 - DNA, 21 bp, Artificial Sequence
  Description of Artificial Sequence: Synthetic oligonucleotide
gtcaccaacaccaaaagccac

SEQ ID NO: 13584 - DNA, 21 bp, Artificial Sequence
  Description of Artificial Sequence: Synthetic oligonucleotide
aacaccagcagcaaacccacc

SEQ ID NO: 13585 - DNA, 21 bp, Artificial Sequence
  Description of Artificial Sequence: Synthetic oligonucleotide
agcatgagccaaaaaagcggc

SEQ ID NO: 13586 - DNA, 21 bp, Artificial Sequence
  Description of Artificial Sequence: Synthetic oligonucleotide
aacagcggcaaaaccctcatc

SEQ ID NO: 13587 - DNA, 21 bp, Artificial Sequence
  Description of Artificial Sequence: Synthetic oligonucleotide
ggtgcttcgacgaagactgtg

SEQ ID NO: 13588 - DNA, 21 bp, Artificial Sequence
  Description of Artificial Sequence: Synthetic oligonucleotide
agtattgcgtctaagcctacg

SEQ ID NO: 13589 - DNA, 21 bp, Artificial Sequence
  Description of Artificial Sequence: Synthetic oligonucleotide
cagactgcttctagttctaag

SEQ ID NO: 13590 - DNA, 21 bp, Artificial Sequence
  Description of Artificial Sequence: Synthetic oligonucleotide
tctagtgatgctaagcctatt

SEQ ID NO: 13591 - DNA, 21 bp, Artificial Sequence
  Description of Artificial Sequence: Synthetic oligonucleotide
aacggttctggacagaataaa

SEQ ID NO: 13592 - DNA, 21 bp, Artificial Sequence
  Description of Artificial Sequence: Synthetic oligonucleotide
agtacggctaaggctacgggt

SEQ ID NO: 13593 - DNA, 21 bp, Artificial Sequence
  Description of Artificial Sequence: Synthetic oligonucleotide
atgcctgatcagaaggcgagt

SEQ ID NO: 13594 - DNA, 21 bp, Artificial Sequence
  Description of Artificial Sequence: Synthetic oligonucleotide
gatgggactttgtctagtaag

SEQ ID NO: 13595 - DNA, 21 bp, Artificial Sequence
  Description of Artificial Sequence: Synthetic oligonucleotide
tctgattcgagtaagtcgcag

SEQ ID NO: 13596 - DNA, 21 bp, Artificial Sequence
  Description of Artificial Sequence: Synthetic oligonucleotide
catcagaagtcgggtggtagt

SEQ ID NO: 13597 - DNA, 21 bp, Artificial Sequence
  Description of Artificial Sequence: Synthetic oligonucleotide
gacgggtctccgaggtctgtg

SEQ ID NO: 13598 - DNA, 21 bp, Artificial Sequence
  Description of Artificial Sequence: Synthetic oligonucleotide
tcgccggtgactcatggtaag

SEQ ID NO: 13599 - DNA, 21 bp, Artificial Sequence
  Description of Artificial Sequence: Synthetic oligonucleotide
cagattgctgataagaatcat

SEQ ID NO: 13600 - DNA, 21 bp, Artificial Sequence
  Description of Artificial Sequence: Synthetic oligonucleotide
actgcgggtaaggcgaatagt

SEQ ID NO: 13601 - DNA, 21 bp, Artificial Sequence
  Description of Artificial Sequence: Synthetic oligonucleotide
aacctcagagacgcccccaaa

SEQ ID NO: 13602 - DNA, 21 bp, Artificial Sequence
  Description of Artificial Sequence: Synthetic oligonucleotide
gctcatgagagtaaggcgtct

SEQ ID NO: 13603 - DNA, 21 bp, Artificial Sequence
  Description of Artificial Sequence: Synthetic oligonucleotide
acgggtgggcatagtactaat

SEQ ID NO: 13604 - DNA, 21 bp, Artificial Sequence
  Description of Artificial Sequence: Synthetic oligonucleotide
agcgtcggcaaagacagaaac

SEQ ID NO: 13605 - DNA, 21 bp, Artificial Sequence
  Description of Artificial Sequence: Synthetic oligonucleotide
aacgccaacaaaagcctcacc

SEQ ID NO: 13606 - DNA, 21 bp, Artificial Sequence
  Description of Artificial Sequence: Synthetic oligonucleotide
agtcagaatggggctcatcgt

SEQ ID NO: 13607 - DNA, 21 bp, Artificial Sequence
  Description of Artificial Sequence: Synthetic oligonucleotide
cacagcggcaaaagcaccacc

SEQ ID NO: 13608 - DNA, 21 bp, Artificial Sequence
  Description of Artificial Sequence: Synthetic oligonucleotide
aacctcagcaaaaccgaccaa

SEQ ID NO: 13609 - DNA, 21 bp, Artificial Sequence
  Description of Artificial Sequence: Synthetic oligonucleotide
gacgtcagcgccagccccaaa

SEQ ID NO: 13610 - DNA, 21 bp, Artificial Sequence
  Description of Artificial Sequence: Synthetic oligonucleotide
actagtctgaaggggactaat

SEQ ID NO: 13611 - DNA, 21 bp, Artificial Sequence
  Description of Artificial Sequence: Synthetic oligonucleotide
caagccgacagcaaacccgtc

SEQ ID NO: 13612 - DNA, 21 bp, Artificial Sequence
  Description of Artificial Sequence: Synthetic oligonucleotide
gccaaaagcaacaccaacagc

SEQ ID NO: 13613 - DNA, 21 bp, Artificial Sequence
  Description of Artificial Sequence: Synthetic oligonucleotide
ggtgggtctaaggctaattcg

SEQ ID NO: 13614 - DNA, 21 bp, Artificial Sequence
  Description of Artificial Sequence: Synthetic oligonucleotide
gggggtgcgaagggtcaggct

SEQ ID NO: 13615 - DNA, 21 bp, Artificial Sequence
  Description of Artificial Sequence: Synthetic oligonucleotide
tctaatgagaagccgttggtg

SEQ ID NO: 13616 - DNA, 21 bp, Artificial Sequence
  Description of Artificial Sequence: Synthetic oligonucleotide
cagaatcattctaagcaggat

SEQ ID NO: 13617 - DNA, 21 bp, Artificial Sequence
  Description of Artificial Sequence: Synthetic oligonucleotide
agcggcggcagcggcatccac

SEQ ID NO: 13618 - DNA, 21 bp, Artificial Sequence
  Description of Artificial Sequence: Synthetic oligonucleotide
gccggcaccaaacaacccaac

SEQ ID NO: 13619 - DNA, 21 bp, Artificial Sequence
  Description of Artificial Sequence: Synthetic oligonucleotide
tctaatgcgactggtacgagt

SEQ ID NO: 13620 - DNA, 21 bp, Artificial Sequence
  Description of Artificial Sequence: Synthetic oligonucleotide
acgagggatcagtctcatagt

SEQ ID NO: 13621 - DNA, 21 bp, Artificial Sequence
  Description of Artificial Sequence: Synthetic oligonucleotide
agcaacagccccgccaacacc

SEQ ID NO: 13622 - DNA, 21 bp, Artificial Sequence
  Description of Artificial Sequence: Synthetic oligonucleotide
aagaatgagactaagacgatt

SEQ ID NO: 13623 - DNA, 21 bp, Artificial Sequence
  Description of Artificial Sequence: Synthetic oligonucleotide
gggcctacgtctaagcagagt

SEQ ID NO: 13624 - DNA, 21 bp, Artificial Sequence
  Description of Artificial Sequence: Synthetic oligonucleotide
tcgacttcgacttcgtctagg

SEQ ID NO: 13625 - DNA, 21 bp, Artificial Sequence
  Description of Artificial Sequence: Synthetic oligonucleotide
caggattctcctcagcctagg

SEQ ID NO: 13626 - DNA, 21 bp, Artificial Sequence
  Description of Artificial Sequence: Synthetic oligonucleotide
ggcaacagcggcaaaatgttc

SEQ ID NO: 13627 - DNA, 21 bp, Artificial Sequence
  Description of Artificial Sequence: Synthetic oligonucleotide
ggcatcagaagccccagcgaa

SEQ ID NO: 13628 - DNA, 21 bp, Artificial Sequence
  Description of Artificial Sequence: Synthetic oligonucleotide
aacagcagcagcaaaagcagc

SEQ ID NO: 13629 - DNA, 21 bp, Artificial Sequence
  Description of Artificial Sequence: Synthetic oligonucleotide
agccccagcggcaaaggcctc

SEQ ID NO: 13630 - DNA, 21 bp, Artificial Sequence
  Description of Artificial Sequence: Synthetic oligonucleotide
agtacggataaggctcgtgtt

SEQ ID NO: 13631 - DNA, 21 bp, Artificial Sequence
  Description of Artificial Sequence: Synthetic oligonucleotide
cgtagtgaggcgtctgtgaag

SEQ ID NO: 13632 - DNA, 21 bp, Artificial Sequence
  Description of Artificial Sequence: Synthetic oligonucleotide
gacaacagcagcgtcaacaaa

SEQ ID NO: 13633 - DNA, 21 bp, Artificial Sequence
  Description of Artificial Sequence: Synthetic oligonucleotide
agcagcaccgtcaaacccgtc

SEQ ID NO: 13634 - DNA, 21 bp, Artificial Sequence
  Description of Artificial Sequence: Synthetic oligonucleotide
atgggcgtcaaacccgacctc

SEQ ID NO: 13635 - DNA, 21 bp, Artificial Sequence
  Description of Artificial Sequence: Synthetic oligonucleotide
accaaccaaaaaaccgccgcc

SEQ ID NO: 13636 - DNA, 21 bp, Artificial Sequence
  Description of Artificial Sequence: Synthetic oligonucleotide
ggcaccggcaacaaacacgcc

SEQ ID NO: 13637 - DNA, 21 bp, Artificial Sequence
  Description of Artificial Sequence: Synthetic oligonucleotide
ggtctgaataatagttcgggt

SEQ ID NO: 13638 - DNA, 21 bp, Artificial Sequence
  Description of Artificial Sequence: Synthetic oligonucleotide
gggcgggaggcgccgacgcgg

SEQ ID NO: 13639 - DNA, 21 bp, Artificial Sequence
  Description of Artificial Sequence: Synthetic oligonucleotide
agcaccctcaaacccatccaa

SEQ ID NO: 13640 - DNA, 21 bp, Artificial Sequence
  Description of Artificial Sequence: Synthetic oligonucleotide
agttctgctcaggctgtgagt

SEQ ID NO: 13641 - DNA, 21 bp, Artificial Sequence
  Description of Artificial Sequence: Synthetic oligonucleotide
gacggcctcaaaggccaaagc

SEQ ID NO: 13642 - DNA, 21 bp, Artificial Sequence
  Description of Artificial Sequence: Synthetic oligonucleotide
gtggctgggacttcgcagtct

SEQ ID NO: 13643 - DNA, 21 bp, Artificial Sequence
  Description of Artificial Sequence: Synthetic oligonucleotide
catgcgactcaggcgagtact

SEQ ID NO: 13644 - DNA, 21 bp, Artificial Sequence
  Description of Artificial Sequence: Synthetic oligonucleotide
acccaaggcagcagaaacagc

SEQ ID NO: 13645 - DNA, 21 bp, Artificial Sequence
  Description of Artificial Sequence: Synthetic oligonucleotide
actactagtggtcagagtaag

SEQ ID NO: 13646 - DNA, 21 bp, Artificial Sequence
  Description of Artificial Sequence: Synthetic oligonucleotide
gccgccgccggcagcaccaaa

SEQ ID NO: 13647 - DNA, 21 bp, Artificial Sequence
  Description of Artificial Sequence: Synthetic oligonucleotide
ttgagtactcagacttcttcg

SEQ ID NO: 13648 - DNA, 21 bp, Artificial Sequence
  Description of Artificial Sequence: Synthetic oligonucleotide
aacgcccaaggcacccccgtc

SEQ ID NO: 13649 - DNA, 21 bp, Artificial Sequence
  Description of Artificial Sequence: Synthetic oligonucleotide
tcgtcggggagtaagcagtct

SEQ ID NO: 13650 - DNA, 21 bp, Artificial Sequence
  Description of Artificial Sequence: Synthetic oligonucleotide
actgggggtgcgccgactact

SEQ ID NO: 13651 - DNA, 21 bp, Artificial Sequence
  Description of Artificial Sequence: Synthetic oligonucleotide
agaggcaccagccaacaagcc

SEQ ID NO: 13652 - DNA, 21 bp, Artificial Sequence
  Description of Artificial Sequence: Synthetic oligonucleotide
atcggcaccggcaaagcccaa

SEQ ID NO: 13653 - DNA, 21 bp, Artificial Sequence
  Description of Artificial Sequence: Synthetic oligonucleotide
gcggggtctaaggagacgcgg

SEQ ID NO: 13654 - DNA, 21 bp, Artificial Sequence
  Description of Artificial Sequence: Synthetic oligonucleotide
gggcaggcgagtcctcagaag

SEQ ID NO: 13655 - DNA, 21 bp, Artificial Sequence
  Description of Artificial Sequence: Synthetic oligonucleotide
agcagcgacagccaccccacc

SEQ ID NO: 13656 - DNA, 21 bp, Artificial Sequence
  Description of Artificial Sequence: Synthetic oligonucleotide
acgaatacggggaagccgctg

SEQ ID NO: 13657 - DNA, 21 bp, Artificial Sequence
  Description of Artificial Sequence: Synthetic oligonucleotide
gtcgtccaaaaacccgccgaa

SEQ ID NO: 13658 - DNA, 21 bp, Artificial Sequence
  Description of Artificial Sequence: Synthetic oligonucleotide
agtccggggtcgggtagtcag

SEQ ID NO: 13659 - DNA, 21 bp, Artificial Sequence
  Description of Artificial Sequence: Synthetic oligonucleotide
ctcggcacccaaaaaaccgtc

SEQ ID NO: 13660 - DNA, 21 bp, Artificial Sequence
  Description of Artificial Sequence: Synthetic oligonucleotide
agcggccaaagcggcgtcaaa

SEQ ID NO: 13661 - DNA, 21 bp, Artificial Sequence
  Description of Artificial Sequence: Synthetic oligonucleotide
gcttctacttctactcaggcg

SEQ ID NO: 13662 - DNA, 21 bp, Artificial Sequence
  Description of Artificial Sequence: Synthetic oligonucleotide
ggtatggcgggttcttcgcag

SEQ ID NO: 13663 - DNA, 21 bp, Artificial Sequence
  Description of Artificial Sequence: Synthetic oligonucleotide
accaaaagcaccacccccatc

SEQ ID NO: 13664 - DNA, 21 bp, Artificial Sequence
  Description of Artificial Sequence: Synthetic oligonucleotide
accagcggcaacaaccccatg

SEQ ID NO: 13665 - DNA, 21 bp, Artificial Sequence
  Description of Artificial Sequence: Synthetic oligonucleotide
gacaacatccaaaaagccaac

SEQ ID NO: 13666 - DNA, 21 bp, Artificial Sequence
  Description of Artificial Sequence: Synthetic oligonucleotide
accagcgacagagtccaaggc

SEQ ID NO: 13667 - DNA, 21 bp, Artificial Sequence
  Description of Artificial Sequence: Synthetic oligonucleotide
gatgggctgtctaagccgact

SEQ ID NO: 13668 - DNA, 21 bp, Artificial Sequence
  Description of Artificial Sequence: Synthetic oligonucleotide
ggccacaacagccccaccctc

SEQ ID NO: 13669 - DNA, 21 bp, Artificial Sequence
  Description of Artificial Sequence: Synthetic oligonucleotide
acttctagtcagcggtcttcg

SEQ ID NO: 13670 - DNA, 21 bp, Artificial Sequence
  Description of Artificial Sequence: Synthetic oligonucleotide
gctcaggcgactccgcatgtt

SEQ ID NO: 13671 - DNA, 21 bp, Artificial Sequence
  Description of Artificial Sequence: Synthetic oligonucleotide
gctaagagtacggtgaatact

SEQ ID NO: 13672 - DNA, 21 bp, Artificial Sequence
  Description of Artificial Sequence: Synthetic oligonucleotide
atgaacggcagcggcgcccac

SEQ ID NO: 13673 - DNA, 21 bp, Artificial Sequence
  Description of Artificial Sequence: Synthetic oligonucleotide
cagaatgctgcgaagaatcct

SEQ ID NO: 13674 - DNA, 21 bp, Artificial Sequence
  Description of Artificial Sequence: Synthetic oligonucleotide
atggccagcaaccccagagaa

SEQ ID NO: 13675 - DNA, 21 bp, Artificial Sequence
  Description of Artificial Sequence: Synthetic oligonucleotide
cagtctaatactgtttcgtcg

SEQ ID NO: 13676 - DNA, 21 bp, Artificial Sequence
  Description of Artificial Sequence: Synthetic oligonucleotide
gattcttcgcctactcatcgg

SEQ ID NO: 13677 - DNA, 21 bp, Artificial Sequence
  Description of Artificial Sequence: Synthetic oligonucleotide
aatgggacttcggagaggcgt

SEQ ID NO: 13678 - DNA, 21 bp, Artificial Sequence
  Description of Artificial Sequence: Synthetic oligonucleotide
gccgccagcgacggcagaaac

SEQ ID NO: 13679 - DNA, 21 bp, Artificial Sequence
  Description of Artificial Sequence: Synthetic oligonucleotide
gagatttcgtcgcctgggcgt

SEQ ID NO: 13680 - DNA, 21 bp, Artificial Sequence
  Description of Artificial Sequence: Synthetic oligonucleotide
tctgggcaggagcgtgctacg

SEQ ID NO: 13681 - DNA, 21 bp, Artificial Sequence
  Description of Artificial Sequence: Synthetic oligonucleotide
actcagaatggtgggggtaat

SEQ ID NO: 13682 - DNA, 21 bp, Artificial Sequence
  Description of Artificial Sequence: Synthetic oligonucleotide
agcagaagcggcagcagcagc

SEQ ID NO: 13683 - DNA, 21 bp, Artificial Sequence
  Description of Artificial Sequence: Synthetic oligonucleotide
cagactaagcctacgacgact

SEQ ID NO: 13684 - DNA, 21 bp, Artificial Sequence
  Description of Artificial Sequence: Synthetic oligonucleotide
gacaccgtcccccccagcaaa

SEQ ID NO: 13685 - DNA, 21 bp, Artificial Sequence
  Description of Artificial Sequence: Synthetic oligonucleotide
gatgggcggcaggctggggtt

SEQ ID NO: 13686 - DNA, 21 bp, Artificial Sequence
  Description of Artificial Sequence: Synthetic oligonucleotide
gtcggccccaacaaccaaagc

SEQ ID NO: 13687 - DNA, 21 bp, Artificial Sequence
  Description of Artificial Sequence: Synthetic oligonucleotide
cgtaattcgggtaatcagggg

SEQ ID NO: 13688 - DNA, 21 bp, Artificial Sequence
  Description of Artificial Sequence: Synthetic oligonucleotide
ggtgtgaataataaggcgggt

SEQ ID NO: 13689 - DNA, 21 bp, Artificial Sequence
  Description of Artificial Sequence: Synthetic oligonucleotide
caacccaacggccaaatcaaa

SEQ ID NO: 13690 - DNA, 21 bp, Artificial Sequence
  Description of Artificial Sequence: Synthetic oligonucleotide
aacctcagcaccagcggcggc

SEQ ID NO: 13691 - DNA, 21 bp, Artificial Sequence
  Description of Artificial Sequence: Synthetic oligonucleotide
caacacaccaaaacccccagc

SEQ ID NO: 13692 - DNA, 21 bp, Artificial Sequence
  Description of Artificial Sequence: Synthetic oligonucleotide
gatgcgggtaataaggctcgt

SEQ ID NO: 13693 - DNA, 21 bp, Artificial Sequence
  Description of Artificial Sequence: Synthetic oligonucleotide
actacttcggctaaggttcag

SEQ ID NO: 13694 - DNA, 21 bp, Artificial Sequence
  Description of Artificial Sequence: Synthetic oligonucleotide
agccacagcaccaaaagcacc

SEQ ID NO: 13695 - DNA, 21 bp, Artificial Sequence
  Description of Artificial Sequence: Synthetic oligonucleotide
gccaacgccggcaaactcagc

SEQ ID NO: 13696 - DNA, 21 bp, Artificial Sequence
  Description of Artificial Sequence: Synthetic oligonucleotide
tacggcagcaaagacctcagc

SEQ ID NO: 13697 - DNA, 21 bp, Artificial Sequence
  Description of Artificial Sequence: Synthetic oligonucleotide
agcaacaaaagcagcggcggc

SEQ ID NO: 13698 - DNA, 21 bp, Artificial Sequence
  Description of Artificial Sequence: Synthetic oligonucleotide
aataatgcgaataagtctgtt

SEQ ID NO: 13699 - DNA, 21 bp, Artificial Sequence
  Description of Artificial Sequence: Synthetic oligonucleotide
accagcagcaaaagcgccgtc

SEQ ID NO: 13700 - DNA, 21 bp, Artificial Sequence
  Description of Artificial Sequence: Synthetic oligonucleotide
agtaatgcgggttctatgcag

SEQ ID NO: 13701 - DNA, 21 bp, Artificial Sequence
  Description of Artificial Sequence: Synthetic oligonucleotide
ggcgtcgccaaaagcagcagc

SEQ ID NO: 13702 - DNA, 21 bp, Artificial Sequence
  Description of Artificial Sequence: Synthetic oligonucleotide
accaaagtcggcacccccgtc

SEQ ID NO: 13703 - DNA, 21 bp, Artificial Sequence
  Description of Artificial Sequence: Synthetic oligonucleotide
ggtacgagttctaagccgttg

SEQ ID NO: 13704 - DNA, 21 bp, Artificial Sequence
  Description of Artificial Sequence: Synthetic oligonucleotide
agcaccagcagcagcaacctc

SEQ ID NO: 13705 - DNA, 21 bp, Artificial Sequence
  Description of Artificial Sequence: Synthetic oligonucleotide
agccccagcaaaagcggcacc

SEQ ID NO: 13706 - DNA, 21 bp, Artificial Sequence
  Description of Artificial Sequence: Synthetic oligonucleotide
aacaacaacaccagcaacgtc

SEQ ID NO: 13707 - DNA, 21 bp, Artificial Sequence
  Description of Artificial Sequence: Synthetic oligonucleotide
gataatggttcttcgcgtcag

SEQ ID NO: 13708 - DNA, 21 bp, Artificial Sequence
  Description of Artificial Sequence: Synthetic oligonucleotide
agcaacgacccccccagcaaa

SEQ ID NO: 13709 - DNA, 21 bp, Artificial Sequence
  Description of Artificial Sequence: Synthetic oligonucleotide
caaggcagccaaagcgccatg

SEQ ID NO: 13710 - DNA, 21 bp, Artificial Sequence
  Description of Artificial Sequence: Synthetic oligonucleotide
aacaccgacaaacccgccgtc

SEQ ID NO: 13711 - DNA, 21 bp, Artificial Sequence
  Description of Artificial Sequence: Synthetic oligonucleotide
aggagtgatggttctccgagg

SEQ ID NO: 13712 - DNA, 21 bp, Artificial Sequence
  Description of Artificial Sequence: Synthetic oligonucleotide
atgggtaattcgagttctgtt

SEQ ID NO: 13713 - DNA, 21 bp, Artificial Sequence
  Description of Artificial Sequence: Synthetic oligonucleotide
aagattggggcttcgagtgct

SEQ ID NO: 13714 - DNA, 21 bp, Artificial Sequence
  Description of Artificial Sequence: Synthetic oligonucleotide
accaccagcaacagcaccaaa

SEQ ID NO: 13715 - DNA, 21 bp, Artificial Sequence
  Description of Artificial Sequence: Synthetic oligonucleotide
agcagaaacaccagcaacacc

SEQ ID NO: 13716 - DNA, 21 bp, Artificial Sequence
  Description of Artificial Sequence: Synthetic oligonucleotide
cacagcaccgaaaaacaaaga

SEQ ID NO: 13717 - DNA, 21 bp, Artificial Sequence
  Description of Artificial Sequence: Synthetic oligonucleotide
gacagacccggcaacggcggc

SEQ ID NO: 13718 - DNA, 21 bp, Artificial Sequence
  Description of Artificial Sequence: Synthetic oligonucleotide
agcggcctcaaacccaccgtc

SEQ ID NO: 13719 - DNA, 21 bp, Artificial Sequence
  Description of Artificial Sequence: Synthetic oligonucleotide
aaaggccaaggcagcaccgtc

SEQ ID NO: 13720 - DNA, 21 bp, Artificial Sequence
  Description of Artificial Sequence: Synthetic oligonucleotide
caaaccacccccagcagccaa

SEQ ID NO: 13721 - DNA, 21 bp, Artificial Sequence
  Description of Artificial Sequence: Synthetic oligonucleotide
gcccacggccaagtcccccaa

SEQ ID NO: 13722 - DNA, 21 bp, Artificial Sequence
  Description of Artificial Sequence: Synthetic oligonucleotide
gagactgggcataaggctgct

SEQ ID NO: 13723 - DNA, 21 bp, Artificial Sequence
  Description of Artificial Sequence: Synthetic oligonucleotide
accaaagcccaaagccccctc

SEQ ID NO: 13724 - DNA, 21 bp, Artificial Sequence
  Description of Artificial Sequence: Synthetic oligonucleotide
aatagttcgacgaagactccg

SEQ ID NO: 13725 - DNA, 21 bp, Artificial Sequence
  Description of Artificial Sequence: Synthetic oligonucleotide
gccaccaccggcgacagcaaa

SEQ ID NO: 13726 - DNA, 21 bp, Artificial Sequence
  Description of Artificial Sequence: Synthetic oligonucleotide
gcgggtacgactaatgcgcat

SEQ ID NO: 13727 - DNA, 21 bp, Artificial Sequence
  Description of Artificial Sequence: Synthetic oligonucleotide
gtcaacggcaaacccaacgcc

SEQ ID NO: 13728 - DNA, 21 bp, Artificial Sequence
  Description of Artificial Sequence: Synthetic oligonucleotide
cacagcgccacccccaacaaa

SEQ ID NO: 13729 - DNA, 21 bp, Artificial Sequence
  Description of Artificial Sequence: Synthetic oligonucleotide
agtaatgggcagaagcctccg

SEQ ID NO: 13730 - DNA, 21 bp, Artificial Sequence
  Description of Artificial Sequence: Synthetic oligonucleotide
ctcggcaacaaagaccaagcc

SEQ ID NO: 13731 - DNA, 21 bp, Artificial Sequence
  Description of Artificial Sequence: Synthetic oligonucleotide
gtccaaggcacccacacccaa

SEQ ID NO: 13732 - DNA, 21 bp, Artificial Sequence
  Description of Artificial Sequence: Synthetic oligonucleotide
gacgtccacgtcaaaaaccaa

SEQ ID NO: 13733 - DNA, 21 bp, Artificial Sequence
  Description of Artificial Sequence: Synthetic oligonucleotide
gccaccaccaaaagcagcacc

SEQ ID NO: 13734 - DNA, 21 bp, Artificial Sequence
  Description of Artificial Sequence: Synthetic oligonucleotide
agtacggctacgagttctcat

SEQ ID NO: 13735 - DNA, 21 bp, Artificial Sequence
  Description of Artificial Sequence: Synthetic oligonucleotide
gttagtcagccgtctgttgct

SEQ ID NO: 13736 - DNA, 21 bp, Artificial Sequence
  Description of Artificial Sequence: Synthetic oligonucleotide
agcagcaacggccacggcagc

SEQ ID NO: 13737 - DNA, 21 bp, Artificial Sequence
  Description of Artificial Sequence: Synthetic oligonucleotide
gccagcaacaccggcagcacc

SEQ ID NO: 13738 - DNA, 21 bp, Artificial Sequence
  Description of Artificial Sequence: Synthetic oligonucleotide
accggcgccagcaaccaaaaa

SEQ ID NO: 13739 - DNA, 21 bp, Artificial Sequence
  Description of Artificial Sequence: Synthetic oligonucleotide
agcagcgacaccaaccacgcc

SEQ ID NO: 13740 - DNA, 21 bp, Artificial Sequence
  Description of Artificial Sequence: Synthetic oligonucleotide
agtatgggtaagtcttcggtg

SEQ ID NO: 13741 - DNA, 21 bp, Artificial Sequence
  Description of Artificial Sequence: Synthetic oligonucleotide
ctcaacaacggcaaagccacc

SEQ ID NO: 13742 - DNA, 21 bp, Artificial Sequence
  Description of Artificial Sequence: Synthetic oligonucleotide
caggctgggcgtgattcgcag

SEQ ID NO: 13743 - DNA, 21 bp, Artificial Sequence
  Description of Artificial Sequence: Synthetic oligonucleotide
actccggcgcagaagagtcag

SEQ ID NO: 13744 - DNA, 21 bp, Artificial Sequence
  Description of Artificial Sequence: Synthetic oligonucleotide
cagaatgtgaagccttcggtg

SEQ ID NO: 13745 - DNA, 21 bp, Artificial Sequence
  Description of Artificial Sequence: Synthetic oligonucleotide
ctcggcaacagcggcaccaac

SEQ ID NO: 13746 - DNA, 21 bp, Artificial Sequence
  Description of Artificial Sequence: Synthetic oligonucleotide
gaaggcatgaaacccagcctc

SEQ ID NO: 13747 - DNA, 21 bp, Artificial Sequence
  Description of Artificial Sequence: Synthetic oligonucleotide
ggcggcggccacagccccaaa

SEQ ID NO: 13748 - DNA, 21 bp, Artificial Sequence
  Description of Artificial Sequence: Synthetic oligonucleotide
actcatcagactactagtgct

SEQ ID NO: 13749 - DNA, 21 bp, Artificial Sequence
  Description of Artificial Sequence: Synthetic oligonucleotide
gtcaccaccagcagccccaaa

SEQ ID NO: 13750 - DNA, 21 bp, Artificial Sequence
  Description of Artificial Sequence: Synthetic oligonucleotide
ggcgccgacagccccggcaga

SEQ ID NO: 13751 - DNA, 21 bp, Artificial Sequence
  Description of Artificial Sequence: Synthetic oligonucleotide
caacacgacgccaaaatggcc

SEQ ID NO: 13752 - DNA, 21 bp, Artificial Sequence
  Description of Artificial Sequence: Synthetic oligonucleotide
aggactggggcggagagtcgt

SEQ ID NO: 13753 - DNA, 21 bp, Artificial Sequence
  Description of Artificial Sequence: Synthetic oligonucleotide
agaaacggcgccagcagcggc

SEQ ID NO: 13754 - DNA, 21 bp, Artificial Sequence
  Description of Artificial Sequence: Synthetic oligonucleotide
ggtgcggagactaagccttcg

SEQ ID NO: 13755 - DNA, 21 bp, Artificial Sequence
  Description of Artificial Sequence: Synthetic oligonucleotide
tctcaggggaataagacgctg

SEQ ID NO: 13756 - DNA, 21 bp, Artificial Sequence
  Description of Artificial Sequence: Synthetic oligonucleotide
cattcggctacgaagtcttcg

SEQ ID NO: 13757 - DNA, 21 bp, Artificial Sequence
  Description of Artificial Sequence: Synthetic oligonucleotide
agcagcgccagcgtcgccaaa

SEQ ID NO: 13758 - DNA, 21 bp, Artificial Sequence
  Description of Artificial Sequence: Synthetic oligonucleotide
acttctcagagtggtcatcat

SEQ ID NO: 13759 - DNA, 21 bp, Artificial Sequence
  Description of Artificial Sequence: Synthetic oligonucleotide
ggcaccaccagccacgccagc

SEQ ID NO: 13760 - DNA, 21 bp, Artificial Sequence
  Description of Artificial Sequence: Synthetic oligonucleotide
cagacgacttctccttcgaag

SEQ ID NO: 13761 - DNA, 21 bp, Artificial Sequence
  Description of Artificial Sequence: Synthetic oligonucleotide
agcgccaacagacccggcgtc

SEQ ID NO: 13762 - DNA, 21 bp, Artificial Sequence
  Description of Artificial Sequence: Synthetic oligonucleotide
agcgccagcaccaaaagcctc

SEQ ID NO: 13763 - DNA, 21 bp, Artificial Sequence
  Description of Artificial Sequence: Synthetic oligonucleotide
gccaacggcgtcaaactccaa

SEQ ID NO: 13764 - DNA, 21 bp, Artificial Sequence
  Description of Artificial Sequence: Synthetic oligonucleotide
ttgcagagttctaagccgact

SEQ ID NO: 13765 - DNA, 21 bp, Artificial Sequence
  Description of Artificial Sequence: Synthetic oligonucleotide
ggcaccgccacccccgtcaaa

SEQ ID NO: 13766 - DNA, 21 bp, Artificial Sequence
  Description of Artificial Sequence: Synthetic oligonucleotide
gggaattctgggcagtcgagg

SEQ ID NO: 13767 - DNA, 21 bp, Artificial Sequence
  Description of Artificial Sequence: Synthetic oligonucleotide
ctcaacggcgaaaaaatcagc

SEQ ID NO: 13768 - DNA, 21 bp, Artificial Sequence
  Description of Artificial Sequence: Synthetic oligonucleotide
aatagggatggtagtactact

SEQ ID NO: 13769 - DNA, 21 bp, Artificial Sequence
  Description of Artificial Sequence: Synthetic oligonucleotide
atgggtaagtctagtgcgcag

SEQ ID NO: 13770 - DNA, 21 bp, Artificial Sequence
  Description of Artificial Sequence: Synthetic oligonucleotide
gtcagccaaagccccgtcaaa

SEQ ID NO: 13771 - DNA, 21 bp, Artificial Sequence
  Description of Artificial Sequence: Synthetic oligonucleotide
agtgttggggaggctcagaag

SEQ ID NO: 13772 - DNA, 21 bp, Artificial Sequence
  Description of Artificial Sequence: Synthetic oligonucleotide
gataagactcagccgcataag

SEQ ID NO: 13773 - DNA, 21 bp, Artificial Sequence
  Description of Artificial Sequence: Synthetic oligonucleotide
ggcgccggcagcaaacccatc

SEQ ID NO: 13774 - DNA, 21 bp, Artificial Sequence
  Description of Artificial Sequence: Synthetic oligonucleotide
aaccaacaaggcaacggcggc

SEQ ID NO: 13775 - DNA, 21 bp, Artificial Sequence
  Description of Artificial Sequence: Synthetic oligonucleotide
accatcaacaacaaacacagc

SEQ ID NO: 13776 - DNA, 21 bp, Artificial Sequence
  Description of Artificial Sequence: Synthetic oligonucleotide
tctggtggtagtccgtcggtg

SEQ ID NO: 13777 - DNA, 21 bp, Artificial Sequence
  Description of Artificial Sequence: Synthetic oligonucleotide
ggcaccagcgcccccgccaga

SEQ ID NO: 13778 - DNA, 21 bp, Artificial Sequence
  Description of Artificial Sequence: Synthetic oligonucleotide
tcggcgtctcattcgccggtg

SEQ ID NO: 13779 - DNA, 21 bp, Artificial Sequence
  Description of Artificial Sequence: Synthetic oligonucleotide
caaaacagccccagcatgagc

SEQ ID NO: 13780 - DNA, 21 bp, Artificial Sequence
  Description of Artificial Sequence: Synthetic oligonucleotide
ctgccgcagaatcctacttcg

SEQ ID NO: 13781 - DNA, 21 bp, Artificial Sequence
  Description of Artificial Sequence: Synthetic oligonucleotide
caaagaaccgaaaccaacgtc

SEQ ID NO: 13782 - DNA, 21 bp, Artificial Sequence
  Description of Artificial Sequence: Synthetic oligonucleotide
ggcctcggcaaagccgccgcc

SEQ ID NO: 13783 - DNA, 21 bp, Artificial Sequence
  Description of Artificial Sequence: Synthetic oligonucleotide
agcagcgccagcaaacccctc

SEQ ID NO: 13784 - DNA, 21 bp, Artificial Sequence
  Description of Artificial Sequence: Synthetic oligonucleotide
caaagcagcggcaaagccagc

SEQ ID NO: 13785 - DNA, 21 bp, Artificial Sequence
  Description of Artificial Sequence: Synthetic oligonucleotide
tgggggtcgaagaatgataat

SEQ ID NO: 13786 - DNA, 21 bp, Artificial Sequence
  Description of Artificial Sequence: Synthetic oligonucleotide
gatggtcatacgaagcagtcg

SEQ ID NO: 13787 - DNA, 21 bp, Artificial Sequence
  Description of Artificial Sequence: Synthetic oligonucleotide
gtccccaacagcagaaccacc

SEQ ID NO: 13788 - DNA, 21 bp, Artificial Sequence
  Description of Artificial Sequence: Synthetic oligonucleotide
aacaccagccaaaaagccagc

SEQ ID NO: 13789 - DNA, 21 bp, Artificial Sequence
  Description of Artificial Sequence: Synthetic oligonucleotide
agcggccaaagcagccacagc

SEQ ID NO: 13790 - DNA, 21 bp, Artificial Sequence
  Description of Artificial Sequence: Synthetic oligonucleotide
gccggcctcaaaagcacccaa

SEQ ID NO: 13791 - DNA, 21 bp, Artificial Sequence
  Description of Artificial Sequence: Synthetic oligonucleotide
ggcggcgtcaaacccttcacc

SEQ ID NO: 13792 - DNA, 21 bp, Artificial Sequence
  Description of Artificial Sequence: Synthetic oligonucleotide
ggtgtggaggctcgttctact

SEQ ID NO: 13793 - DNA, 21 bp, Artificial Sequence
  Description of Artificial Sequence: Synthetic oligonucleotide
gaaagaaacaaagtcaccacc

SEQ ID NO: 13794 - DNA, 21 bp, Artificial Sequence
  Description of Artificial Sequence: Synthetic oligonucleotide
accgccgcccaaagcggcggc

SEQ ID NO: 13795 - DNA, 21 bp, Artificial Sequence
  Description of Artificial Sequence: Synthetic oligonucleotide
agcctcgaaagcaaacccgcc

SEQ ID NO: 13796 - DNA, 21 bp, Artificial Sequence
  Description of Artificial Sequence: Synthetic oligonucleotide
agcggcgacagacaacaagcc

SEQ ID NO: 13797 - DNA, 21 bp, Artificial Sequence
  Description of Artificial Sequence: Synthetic oligonucleotide
cataagacgacgagtgcgaat

SEQ ID NO: 13798 - DNA, 21 bp, Artificial Sequence
  Description of Artificial Sequence: Synthetic oligonucleotide
ctcgaaggccaaagcaacaga

SEQ ID NO: 13799 - DNA, 21 bp, Artificial Sequence
  Description of Artificial Sequence: Synthetic oligonucleotide
ctcgccggcaaccaaaaagaa

SEQ ID NO: 13800 - DNA, 21 bp, Artificial Sequence
  Description of Artificial Sequence: Synthetic oligonucleotide
gatcctaagggtagttctagt

SEQ ID NO: 13801 - DNA, 21 bp, Artificial Sequence
  Description of Artificial Sequence: Synthetic oligonucleotide
gccctccaccaaaaagccggc

SEQ ID NO: 13802 - DNA, 21 bp, Artificial Sequence
  Description of Artificial Sequence: Synthetic oligonucleotide
agcctcaacaaacccatccaa

SEQ ID NO: 13803 - DNA, 21 bp, Artificial Sequence
  Description of Artificial Sequence: Synthetic oligonucleotide
gctgctagtccgcctaataag

SEQ ID NO: 13804 - DNA, 21 bp, Artificial Sequence
  Description of Artificial Sequence: Synthetic oligonucleotide
ctcggcgtcagcaacagcggc

SEQ ID NO: 13805 - DNA, 21 bp, Artificial Sequence
  Description of Artificial Sequence: Synthetic oligonucleotide
atgaattcgaaggcgcaggct

SEQ ID NO: 13806 - DNA, 21 bp, Artificial Sequence
  Description of Artificial Sequence: Synthetic oligonucleotide
aacagcagcagcaaagtcagc

SEQ ID NO: 13807 - DNA, 21 bp, Artificial Sequence
  Description of Artificial Sequence: Synthetic oligonucleotide
acccaaaccaaagtcaacctc

SEQ ID NO: 13808 - DNA, 21 bp, Artificial Sequence
  Description of Artificial Sequence: Synthetic oligonucleotide
cgtatgggtgatcagtctggg

SEQ ID NO: 13809 - DNA, 21 bp, Artificial Sequence
  Description of Artificial Sequence: Synthetic oligonucleotide
ttgccgaatagtaatcaggct

SEQ ID NO: 13810 - DNA, 21 bp, Artificial Sequence
  Description of Artificial Sequence: Synthetic oligonucleotide
acccaaggcaaaaccgtcggc

SEQ ID NO: 13811 - DNA, 21 bp, Artificial Sequence
  Description of Artificial Sequence: Synthetic oligonucleotide
actcagtcgaaggagcttcgt

SEQ ID NO: 13812 - DNA, 21 bp, Artificial Sequence
  Description of Artificial Sequence: Synthetic oligonucleotide
agttcggggaagtctgcgact

SEQ ID NO: 13813 - DNA, 21 bp, Artificial Sequence
  Description of Artificial Sequence: Synthetic oligonucleotide
gttggtagttctcctcaggtt

SEQ ID NO: 13814 - DNA, 21 bp, Artificial Sequence
  Description of Artificial Sequence: Synthetic oligonucleotide
agtaagtctaatagtgtgaat

SEQ ID NO: 13815 - DNA, 21 bp, Artificial Sequence
  Description of Artificial Sequence: Synthetic oligonucleotide
aacgacagaaaagaccaacaa

SEQ ID NO: 13816 - DNA, 21 bp, Artificial Sequence
  Description of Artificial Sequence: Synthetic oligonucleotide
actccgtctgcgaaggtgagt

SEQ ID NO: 13817 - DNA, 21 bp, Artificial Sequence
  Description of Artificial Sequence: Synthetic oligonucleotide
agtagggcgaagcagggtgag

SEQ ID NO: 13818 - DNA, 21 bp, Artificial Sequence
  Description of Artificial Sequence: Synthetic oligonucleotide
cattcggctcctaataatggg

SEQ ID NO: 13819 - DNA, 21 bp, Artificial Sequence
  Description of Artificial Sequence: Synthetic oligonucleotide
agcggcgtcaccagccccgcc

SEQ ID NO: 13820 - DNA, 21 bp, Artificial Sequence
  Description of Artificial Sequence: Synthetic oligonucleotide
atgggcagcaacggccaaaaa

SEQ ID NO: 13821 - DNA, 21 bp, Artificial Sequence
  Description of Artificial Sequence: Synthetic oligonucleotide
gccacccaaagccccagcctc

SEQ ID NO: 13822 - DNA, 21 bp, Artificial Sequence
  Description of Artificial Sequence: Synthetic oligonucleotide
ggttcggagacgcgtgctgct

SEQ ID NO: 13823 - DNA, 21 bp, Artificial Sequence
  Description of Artificial Sequence: Synthetic oligonucleotide
aacaccagcaccaccagcaga

SEQ ID NO: 13824 - DNA, 21 bp, Artificial Sequence
  Description of Artificial Sequence: Synthetic oligonucleotide
agcgtccacagcaaaagcgtc

SEQ ID NO: 13825 - DNA, 21 bp, Artificial Sequence
  Description of Artificial Sequence: Synthetic oligonucleotide
accctcggcaaccccagcaga

SEQ ID NO: 13826 - DNA, 21 bp, Artificial Sequence
  Description of Artificial Sequence: Synthetic oligonucleotide
tcgcggtcggggactccggtg

SEQ ID NO: 13827 - DNA, 21 bp, Artificial Sequence
  Description of Artificial Sequence: Synthetic oligonucleotide
accagcagcagccccagcgtc

SEQ ID NO: 13828 - DNA, 21 bp, Artificial Sequence
  Description of Artificial Sequence: Synthetic oligonucleotide
agcaacgccaccaaacccacc

SEQ ID NO: 13829 - DNA, 21 bp, Artificial Sequence
  Description of Artificial Sequence: Synthetic oligonucleotide
gcgggtaagtcgtctcagacg

SEQ ID NO: 13830 - DNA, 21 bp, Artificial Sequence
  Description of Artificial Sequence: Synthetic oligonucleotide
aattcgacgtctgggggtggt

SEQ ID NO: 13831 - DNA, 21 bp, Artificial Sequence
  Description of Artificial Sequence: Synthetic oligonucleotide
agcagcagaagcacccaagcc

SEQ ID NO: 13832 - DNA, 21 bp, Artificial Sequence
  Description of Artificial Sequence: Synthetic oligonucleotide
aagtcgaatgagcggacgacg

SEQ ID NO: 13833 - DNA, 21 bp, Artificial Sequence
  Description of Artificial Sequence: Synthetic oligonucleotide
tctcgtgggccgacgactgtt

SEQ ID NO: 13834 - DNA, 21 bp, Artificial Sequence
  Description of Artificial Sequence: Synthetic oligonucleotide
agcggcgtcagcaaacaaggc

SEQ ID NO: 13835 - DNA, 21 bp, Artificial Sequence
  Description of Artificial Sequence: Synthetic oligonucleotide
caaagccaaaacgccggcagc

SEQ ID NO: 13836 - DNA, 21 bp, Artificial Sequence
  Description of Artificial Sequence: Synthetic oligonucleotide
gtcgccaccagcaaaagcagc

SEQ ID NO: 13837 - DNA, 21 bp, Artificial Sequence
  Description of Artificial Sequence: Synthetic oligonucleotide
cggggttcgactagttctact

SEQ ID NO: 13838 - DNA, 21 bp, Artificial Sequence
  Description of Artificial Sequence: Synthetic oligonucleotide
gctccggcgggtgatcgtgtt

SEQ ID NO: 13839 - DNA, 21 bp, Artificial Sequence
  Description of Artificial Sequence: Synthetic oligonucleotide
ggtggtcttgatagtcataag

SEQ ID NO: 13840 - DNA, 21 bp, Artificial Sequence
  Description of Artificial Sequence: Synthetic oligonucleotide
gtccacgacggcaaaggcaaa

SEQ ID NO: 13841 - DNA, 21 bp, Artificial Sequence
  Description of Artificial Sequence: Synthetic oligonucleotide
ggcaacaccaaccccgccaaa

SEQ ID NO: 13842 - DNA, 21 bp, Artificial Sequence
  Description of Artificial Sequence: Synthetic oligonucleotide
tcgcggagtacggggaatcag

SEQ ID NO: 13843 - DNA, 21 bp, Artificial Sequence
  Description of Artificial Sequence: Synthetic oligonucleotide
ggttcggcgaattctccgaag

SEQ ID NO: 13844 - DNA, 21 bp, Artificial Sequence
  Description of Artificial Sequence: Synthetic oligonucleotide
aacaacaacaacaaagccagc

SEQ ID NO: 13845 - DNA, 21 bp, Artificial Sequence
  Description of Artificial Sequence: Synthetic oligonucleotide
cgttctgcgtcgcctactgtt

SEQ ID NO: 13846 - DNA, 21 bp, Artificial Sequence
  Description of Artificial Sequence: Synthetic oligonucleotide
gccagcaccggccccagagac

SEQ ID NO: 13847 - DNA, 21 bp, Artificial Sequence
  Description of Artificial Sequence: Synthetic oligonucleotide
ttcggcaacagcagcagcgcc

SEQ ID NO: 13848 - DNA, 21 bp, Artificial Sequence
  Description of Artificial Sequence: Synthetic oligonucleotide
gtccaacaagccgcccccagc

SEQ ID NO: 13849 - DNA, 21 bp, Artificial Sequence
  Description of Artificial Sequence: Synthetic oligonucleotide
gattctagttcgcggggtcat

SEQ ID NO: 13850 - DNA, 21 bp, Artificial Sequence
  Description of Artificial Sequence: Synthetic oligonucleotide
ggcctcgacagcaaaatgacc

SEQ ID NO: 13851 - DNA, 21 bp, Artificial Sequence
  Description of Artificial Sequence: Synthetic oligonucleotide
aaccccgccggcggcagcgcc

SEQ ID NO: 13852 - DNA, 21 bp, Artificial Sequence
  Description of Artificial Sequence: Synthetic oligonucleotide
ggcagcaacagcaccaaagcc

SEQ ID NO: 13853 - DNA, 21 bp, Artificial Sequence
  Description of Artificial Sequence: Synthetic oligonucleotide
tcgactactaagccgttgagt

SEQ ID NO: 13854 - DNA, 21 bp, Artificial Sequence
  Description of Artificial Sequence: Synthetic oligonucleotide
gccagcagcagcggcatggtc

SEQ ID NO: 13855 - DNA, 21 bp, Artificial Sequence
  Description of Artificial Sequence: Synthetic oligonucleotide
agcagccaaaaaaccagccaa

SEQ ID NO: 13856 - DNA, 21 bp, Artificial Sequence
  Description of Artificial Sequence: Synthetic oligonucleotide
ggcagcaccagccccgcccaa

SEQ ID NO: 13857 - DNA, 21 bp, Artificial Sequence
  Description of Artificial Sequence: Synthetic oligonucleotide
gttgcgggtcagagtgctgtt

SEQ ID NO: 13858 - DNA, 21 bp, Artificial Sequence
  Description of Artificial Sequence: Synthetic oligonucleotide
agcaccaccaaaggccccgaa

SEQ ID NO: 13859 - DNA, 21 bp, Artificial Sequence
  Description of Artificial Sequence: Synthetic oligonucleotide
agaagcgacaacggcaacaga

SEQ ID NO: 13860 - DNA, 21 bp, Artificial Sequence
  Description of Artificial Sequence: Synthetic oligonucleotide
tctgttggtacgcctacgtct

SEQ ID NO: 13861 - DNA, 21 bp, Artificial Sequence
  Description of Artificial Sequence: Synthetic oligonucleotide
acggctcatgggaagccggtt

SEQ ID NO: 13862 - DNA, 21 bp, Artificial Sequence
  Description of Artificial Sequence: Synthetic oligonucleotide
accagcaccagcaaagtcgcc

SEQ ID NO: 13863 - DNA, 21 bp, Artificial Sequence
  Description of Artificial Sequence: Synthetic oligonucleotide
aacatcagcaaaagcaacagc

SEQ ID NO: 13864 - DNA, 21 bp, Artificial Sequence
  Description of Artificial Sequence: Synthetic oligonucleotide
agcgtcggcaaagccgccgcc

SEQ ID NO: 13865 - DNA, 21 bp, Artificial Sequence
  Description of Artificial Sequence: Synthetic oligonucleotide
gaccccagcgacgtcaaaaga

SEQ ID NO: 13866 - DNA, 21 bp, Artificial Sequence
  Description of Artificial Sequence: Synthetic oligonucleotide
gtggttacgaagcctagtact

SEQ ID NO: 13867 - DNA, 21 bp, Artificial Sequence
  Description of Artificial Sequence: Synthetic oligonucleotide
agcaacaccgccagccccgtc

SEQ ID NO: 13868 - DNA, 21 bp, Artificial Sequence
  Description of Artificial Sequence: Synthetic oligonucleotide
atgcccgccaaaagcagcgtc

SEQ ID NO: 13869 - DNA, 21 bp, Artificial Sequence
  Description of Artificial Sequence: Synthetic oligonucleotide
gacaacggcaaaggccaactc

SEQ ID NO: 13870 - DNA, 21 bp, Artificial Sequence
  Description of Artificial Sequence: Synthetic oligonucleotide
ggtcatacggataagacgacg

SEQ ID NO: 13871 - DNA, 21 bp, Artificial Sequence
  Description of Artificial Sequence: Synthetic oligonucleotide
gatctgcgtgagaagcctgcg

SEQ ID NO: 13872 - DNA, 21 bp, Artificial Sequence
  Description of Artificial Sequence: Synthetic oligonucleotide
tctggggggtcgggtcatacg

SEQ ID NO: 13873 - DNA, 21 bp, Artificial Sequence
  Description of Artificial Sequence: Synthetic oligonucleotide
aatgttacttctaaggctatg

SEQ ID NO: 13874 - DNA, 21 bp, Artificial Sequence
  Description of Artificial Sequence: Synthetic oligonucleotide
aatgttagtcctacgcaggcg

SEQ ID NO: 13875 - DNA, 21 bp, Artificial Sequence
  Description of Artificial Sequence: Synthetic oligonucleotide
gaaagaagcagcgccaccagc

SEQ ID NO: 13876 - DNA, 21 bp, Artificial Sequence
  Description of Artificial Sequence: Synthetic oligonucleotide
ggcaccagcgaaaacaaaggc

SEQ ID NO: 13877 - DNA, 21 bp, Artificial Sequence
  Description of Artificial Sequence: Synthetic oligonucleotide
tcgcgggggggtagtagtggg

SEQ ID NO: 13878 - DNA, 21 bp, Artificial Sequence
  Description of Artificial Sequence: Synthetic oligonucleotide
cagaatagtaagtctgcggtg

SEQ ID NO: 13879 - DNA, 21 bp, Artificial Sequence
  Description of Artificial Sequence: Synthetic oligonucleotide
accaccagccccaaccaccaa

SEQ ID NO: 13880 - DNA, 21 bp, Artificial Sequence
  Description of Artificial Sequence: Synthetic oligonucleotide
aaccccggcggcagaaacggc

SEQ ID NO: 13881 - DNA, 21 bp, Artificial Sequence
  Description of Artificial Sequence: Synthetic oligonucleotide
accaacagcagcaaccccgcc

SEQ ID NO: 13882 - DNA, 21 bp, Artificial Sequence
  Description of Artificial Sequence: Synthetic oligonucleotide
ttggattctgttaagtctcgg

SEQ ID NO: 13883 - DNA, 21 bp, Artificial Sequence
  Description of Artificial Sequence: Synthetic oligonucleotide
gggcgtactgagcctcatacg

SEQ ID NO: 13884 - DNA, 21 bp, Artificial Sequence
  Description of Artificial Sequence: Synthetic oligonucleotide
gatagtgctgttaggggtaat

SEQ ID NO: 13885 - DNA, 21 bp, Artificial Sequence
  Description of Artificial Sequence: Synthetic oligonucleotide
attgctacgaaggtgggttct

SEQ ID NO: 13886 - DNA, 21 bp, Artificial Sequence
  Description of Artificial Sequence: Synthetic oligonucleotide
ctcggcgccagcaaaaacggc

SEQ ID NO: 13887 - DNA, 21 bp, Artificial Sequence
  Description of Artificial Sequence: Synthetic oligonucleotide
gacagacaagtcggcaccacc

SEQ ID NO: 13888 - DNA, 21 bp, Artificial Sequence
  Description of Artificial Sequence: Synthetic oligonucleotide
gatactgggactgctaggggt

SEQ ID NO: 13889 - DNA, 21 bp, Artificial Sequence
  Description of Artificial Sequence: Synthetic oligonucleotide
cggcagtcggataagagtgtg

SEQ ID NO: 13890 - DNA, 21 bp, Artificial Sequence
  Description of Artificial Sequence: Synthetic oligonucleotide
accggcgtcgccagcaacgtc

SEQ ID NO: 13891 - DNA, 21 bp, Artificial Sequence
  Description of Artificial Sequence: Synthetic oligonucleotide
ctggctgatactcctcggact

SEQ ID NO: 13892 - DNA, 21 bp, Artificial Sequence
  Description of Artificial Sequence: Synthetic oligonucleotide
atgagtagtaaggtgtcgact

SEQ ID NO: 13893 - DNA, 21 bp, Artificial Sequence
  Description of Artificial Sequence: Synthetic oligonucleotide
agtaataatagtaagccgcag

SEQ ID NO: 13894 - DNA, 21 bp, Artificial Sequence
  Description of Artificial Sequence: Synthetic oligonucleotide
ggcaccgaaaacgccagaggc

SEQ ID NO: 13895 - DNA, 21 bp, Artificial Sequence
  Description of Artificial Sequence: Synthetic oligonucleotide
ttggggaatagtagtcctgcg

SEQ ID NO: 13896 - DNA, 21 bp, Artificial Sequence
  Description of Artificial Sequence: Synthetic oligonucleotide
agaagcgaaagcaaaatcacc

SEQ ID NO: 13897 - DNA, 21 bp, Artificial Sequence
  Description of Artificial Sequence: Synthetic oligonucleotide
gcgtctgagtctcgtaatgtg

SEQ ID NO: 13898 - DNA, 21 bp, Artificial Sequence
  Description of Artificial Sequence: Synthetic oligonucleotide
ggcagcaccgaaggcctcaga

SEQ ID NO: 13899 - DNA, 21 bp, Artificial Sequence
  Description of Artificial Sequence: Synthetic oligonucleotide
tcgtcgcttccgtcgaagggg

SEQ ID NO: 13900 - DNA, 21 bp, Artificial Sequence
  Description of Artificial Sequence: Synthetic oligonucleotide
acggatcgtaaggatgatcgg

SEQ ID NO: 13901 - DNA, 21 bp, Artificial Sequence
  Description of Artificial Sequence: Synthetic oligonucleotide
gggactgctacgaataatcat

SEQ ID NO: 13902 - DNA, 21 bp, Artificial Sequence
  Description of Artificial Sequence: Synthetic oligonucleotide
accagcagcaccaaaaccgtc

SEQ ID NO: 13903 - DNA, 21 bp, Artificial Sequence
  Description of Artificial Sequence: Synthetic oligonucleotide
agtggtacgggtaattctggt

SEQ ID NO: 13904 - DNA, 21 bp, Artificial Sequence
  Description of Artificial Sequence: Synthetic oligonucleotide
ggcggcgacggcaaagccaga

SEQ ID NO: 13905 - DNA, 21 bp, Artificial Sequence
  Description of Artificial Sequence: Synthetic oligonucleotide
actcggtctgagggttcggtg

SEQ ID NO: 13906 - DNA, 21 bp, Artificial Sequence
  Description of Artificial Sequence: Synthetic oligonucleotide
agcggcctcggcaaacccgtc

SEQ ID NO: 13907 - DNA, 21 bp, Artificial Sequence
  Description of Artificial Sequence: Synthetic oligonucleotide
gcccccatccaaagcggcagc

SEQ ID NO: 13908 - DNA, 21 bp, Artificial Sequence
  Description of Artificial Sequence: Synthetic oligonucleotide
ttcggcagccccacccccagc

SEQ ID NO: 13909 - DNA, 21 bp, Artificial Sequence
  Description of Artificial Sequence: Synthetic oligonucleotide
tcgaggtctactactagtact

SEQ ID NO: 13910 - DNA, 21 bp, Artificial Sequence
  Description of Artificial Sequence: Synthetic oligonucleotide
aattctggtgggactcattct

SEQ ID NO: 13911 - DNA, 21 bp, Artificial Sequence
  Description of Artificial Sequence: Synthetic oligonucleotide
agcacccaaagcggcaacaga

SEQ ID NO: 13912 - DNA, 21 bp, Artificial Sequence
  Description of Artificial Sequence: Synthetic oligonucleotide
atggagggtactcatggtggt

SEQ ID NO: 13913 - DNA, 21 bp, Artificial Sequence
  Description of Artificial Sequence: Synthetic oligonucleotide
cagtcgggggggtcgaatgtg

SEQ ID NO: 13914 - DNA, 21 bp, Artificial Sequence
  Description of Artificial Sequence: Synthetic oligonucleotide
catggtactgcgaagacgtcg

SEQ ID NO: 13915 - DNA, 21 bp, Artificial Sequence
  Description of Artificial Sequence: Synthetic oligonucleotide
ctcggcaacggcaaaaccgtc

SEQ ID NO: 13916 - DNA, 21 bp, Artificial Sequence
  Description of Artificial Sequence: Synthetic oligonucleotide
cttaataatcagaagactgtt

SEQ ID NO: 13917 - DNA, 21 bp, Artificial Sequence
  Description of Artificial Sequence: Synthetic oligonucleotide
gatcagacggcgcgttcgacg

SEQ ID NO: 13918 - DNA, 21 bp, Artificial Sequence
  Description of Artificial Sequence: Synthetic oligonucleotide
gccggcaaaggcgccgccagc

SEQ ID NO: 13919 - DNA, 21 bp, Artificial Sequence
  Description of Artificial Sequence: Synthetic oligonucleotide
gcgagtgggcggagtgttagc

SEQ ID NO: 13920 - DNA, 21 bp, Artificial Sequence
  Description of Artificial Sequence: Synthetic oligonucleotide
ggcctcagcggcgacatcaaa

SEQ ID NO: 13921 - DNA, 21 bp, Artificial Sequence
  Description of Artificial Sequence: Synthetic oligonucleotide
ggtcctaatcgtgattcgggt

SEQ ID NO: 13922 - DNA, 21 bp, Artificial Sequence
  Description of Artificial Sequence: Synthetic oligonucleotide
tctcagggtcaggctaatact

SEQ ID NO: 13923 - DNA, 21 bp, Artificial Sequence
  Description of Artificial Sequence: Synthetic oligonucleotide
catcatgatgctcaggttaag

SEQ ID NO: 13924 - DNA, 21 bp, Artificial Sequence
  Description of Artificial Sequence: Synthetic oligonucleotide
ggttcggggactcctggtgct

SEQ ID NO: 13925 - DNA, 21 bp, Artificial Sequence
  Description of Artificial Sequence: Synthetic oligonucleotide
gacaccggcagcagaagcaga

SEQ ID NO: 13926 - DNA, 21 bp, Artificial Sequence
  Description of Artificial Sequence: Synthetic oligonucleotide
tcttctgtgccgtcgcaggcg

SEQ ID NO: 13927 - DNA, 21 bp, Artificial Sequence
  Description of Artificial Sequence: Synthetic oligonucleotide
tctgggacgcctactcataat

SEQ ID NO: 13928 - DNA, 21 bp, Artificial Sequence
  Description of Artificial Sequence: Synthetic oligonucleotide
tctggtggttcgtcttctaag

SEQ ID NO: 13929 - DNA, 21 bp, Artificial Sequence
  Description of Artificial Sequence: Synthetic oligonucleotide
ggcaccggcaaacccgcccaa

SEQ ID NO: 13930 - DNA, 21 bp, Artificial Sequence
  Description of Artificial Sequence: Synthetic oligonucleotide
aatgcgaataagacggctggt

SEQ ID NO: 13931 - DNA, 21 bp, Artificial Sequence
  Description of Artificial Sequence: Synthetic oligonucleotide
aatacggagcgtccgactgct

SEQ ID NO: 13932 - DNA, 21 bp, Artificial Sequence
  Description of Artificial Sequence: Synthetic oligonucleotide
gctagttctccgactcaggcg

SEQ ID NO: 13933 - DNA, 21 bp, Artificial Sequence
  Description of Artificial Sequence: Synthetic oligonucleotide
ggccacgccggcggcaacagc

SEQ ID NO: 13934 - DNA, 21 bp, Artificial Sequence
  Description of Artificial Sequence: Synthetic oligonucleotide
agccccgaaggcaaaaacaga

SEQ ID NO: 13935 - DNA, 21 bp, Artificial Sequence
  Description of Artificial Sequence: Synthetic oligonucleotide
agcatggtcgccagccaaggc

SEQ ID NO: 13936 - DNA, 21 bp, Artificial Sequence
  Description of Artificial Sequence: Synthetic oligonucleotide
gggcgtgaggtgtcgccgaag

SEQ ID NO: 13937 - DNA, 21 bp, Artificial Sequence
  Description of Artificial Sequence: Synthetic oligonucleotide
gccaccaccgccagccccaaa

SEQ ID NO: 13938 - DNA, 21 bp, Artificial Sequence
  Description of Artificial Sequence: Synthetic oligonucleotide
atgggggtgactggttcggct

SEQ ID NO: 13939 - DNA, 21 bp, Artificial Sequence
  Description of Artificial Sequence: Synthetic oligonucleotide
gcgccttctagtcagtctgct

SEQ ID NO: 13940 - DNA, 21 bp, Artificial Sequence
  Description of Artificial Sequence: Synthetic oligonucleotide
ggcagcaccgcccaacccaga

SEQ ID NO: 13941 - DNA, 21 bp, Artificial Sequence
  Description of Artificial Sequence: Synthetic oligonucleotide
aagaatggtaatagtacgtat

SEQ ID NO: 13942 - DNA, 21 bp, Artificial Sequence
  Description of Artificial Sequence: Synthetic oligonucleotide
agtaatcagggtgggattact

SEQ ID NO: 13943 - DNA, 21 bp, Artificial Sequence
  Description of Artificial Sequence: Synthetic oligonucleotide
agcgtcaacaaaagcgacaac

SEQ ID NO: 13944 - DNA, 21 bp, Artificial Sequence
  Description of Artificial Sequence: Synthetic oligonucleotide
accagcggcggcctcaaaagc

SEQ ID NO: 13945 - DNA, 21 bp, Artificial Sequence
  Description of Artificial Sequence: Synthetic oligonucleotide
ggcgtcgtcagccccgccaaa

SEQ ID NO: 13946 - DNA, 21 bp, Artificial Sequence
  Description of Artificial Sequence: Synthetic oligonucleotide
ggccaagtccaaggcaccacc

SEQ ID NO: 13947 - DNA, 21 bp, Artificial Sequence
  Description of Artificial Sequence: Synthetic oligonucleotide
agcatggccaaaagcacccaa

SEQ ID NO: 13948 - DNA, 21 bp, Artificial Sequence
  Description of Artificial Sequence: Synthetic oligonucleotide
acggcggcgaagattgggagt

SEQ ID NO: 13949 - DNA, 21 bp, Artificial Sequence
  Description of Artificial Sequence: Synthetic oligonucleotide
gggagtacgaagagtacttcg

SEQ ID NO: 13950 - DNA, 21 bp, Artificial Sequence
  Description of Artificial Sequence: Synthetic oligonucleotide
tcgtcgcataagtctgttgcg

SEQ ID NO: 13951 - DNA, 21 bp, Artificial Sequence
  Description of Artificial Sequence: Synthetic oligonucleotide
agccaaggcgccagcctcggc

SEQ ID NO: 13952 - DNA, 21 bp, Artificial Sequence
  Description of Artificial Sequence: Synthetic oligonucleotide
actaattcttcgtcggcgagt

SEQ ID NO: 13953 - DNA, 21 bp, Artificial Sequence
  Description of Artificial Sequence: Synthetic oligonucleotide
ggttcttcgagggatagtccg

SEQ ID NO: 13954 - DNA, 21 bp, Artificial Sequence
  Description of Artificial Sequence: Synthetic oligonucleotide
aaaagcgccaaaagcatcgaa

SEQ ID NO: 13955 - DNA, 21 bp, Artificial Sequence
  Description of Artificial Sequence: Synthetic oligonucleotide
agcagccaaaccccccaagcc

SEQ ID NO: 13956 - DNA, 21 bp, Artificial Sequence
  Description of Artificial Sequence: Synthetic oligonucleotide
ggcggcgacaaacccagcgtc

SEQ ID NO: 13957 - DNA, 21 bp, Artificial Sequence
  Description of Artificial Sequence: Synthetic oligonucleotide
aagtcgggttctgcgtcttct

SEQ ID NO: 13958 - DNA, 21 bp, Artificial Sequence
  Description of Artificial Sequence: Synthetic oligonucleotide
tacggcagcagcaaaaaccaa

SEQ ID NO: 13959 - DNA, 21 bp, Artificial Sequence
  Description of Artificial Sequence: Synthetic oligonucleotide
tctcatagtaaggagcagctt

SEQ ID NO: 13960 - DNA, 21 bp, Artificial Sequence
  Description of Artificial Sequence: Synthetic oligonucleotide
acgcgttcgactagtactact

SEQ ID NO: 13961 - DNA, 21 bp, Artificial Sequence
  Description of Artificial Sequence: Synthetic oligonucleotide
agcaaacccggcgaacacggc

SEQ ID NO: 13962 - DNA, 21 bp, Artificial Sequence
  Description of Artificial Sequence: Synthetic oligonucleotide
agtaaggggtctccgagtgct

SEQ ID NO: 13963 - DNA, 21 bp, Artificial Sequence
  Description of Artificial Sequence: Synthetic oligonucleotide
ggttcgcggcctaatagtggg

SEQ ID NO: 13964 - DNA, 21 bp, Artificial Sequence
  Description of Artificial Sequence: Synthetic oligonucleotide
ggcgcccaaaccgcccacgtc

SEQ ID NO: 13965 - DNA, 21 bp, Artificial Sequence
  Description of Artificial Sequence: Synthetic oligonucleotide
gcgaatggtgctcctacgcgt

SEQ ID NO: 13966 - DNA, 21 bp, Artificial Sequence
  Description of Artificial Sequence: Synthetic oligonucleotide
agcggcgccgccaaagaaagc

SEQ ID NO: 13967 - DNA, 21 bp, Artificial Sequence
  Description of Artificial Sequence: Synthetic oligonucleotide
atgcagacgtctagttctatt

SEQ ID NO: 13968 - DNA, 21 bp, Artificial Sequence
  Description of Artificial Sequence: Synthetic oligonucleotide
ggcagcagcacccccaaactc

SEQ ID NO: 13969 - DNA, 21 bp, Artificial Sequence
  Description of Artificial Sequence: Synthetic oligonucleotide
gggtcgactaagcctaattat

SEQ ID NO: 13970 - DNA, 21 bp, Artificial Sequence
  Description of Artificial Sequence: Synthetic oligonucleotide
gccgccggcgcccacaccgtc

SEQ ID NO: 13971 - DNA, 21 bp, Artificial Sequence
  Description of Artificial Sequence: Synthetic oligonucleotide
ggcctcgaagccagcaaagaa

SEQ ID NO: 13972 - DNA, 21 bp, Artificial Sequence
  Description of Artificial Sequence: Synthetic oligonucleotide
accaccaacgcccccgtcggc

SEQ ID NO: 13973 - DNA, 21 bp, Artificial Sequence
  Description of Artificial Sequence: Synthetic oligonucleotide
agcaccagcaccaaaagcatg

SEQ ID NO: 13974 - DNA, 21 bp, Artificial Sequence
  Description of Artificial Sequence: Synthetic oligonucleotide
gatgtggggaagcagagtaag

SEQ ID NO: 13975 - DNA, 21 bp, Artificial Sequence
  Description of Artificial Sequence: Synthetic oligonucleotide
caaagcaacaccaccagcagc

SEQ ID NO: 13976 - DNA, 21 bp, Artificial Sequence
  Description of Artificial Sequence: Synthetic oligonucleotide
agcagccacagccccagcctc

SEQ ID NO: 13977 - DNA, 21 bp, Artificial Sequence
  Description of Artificial Sequence: Synthetic oligonucleotide
ggcgtcggcagcaaaaccgcc

SEQ ID NO: 13978 - DNA, 21 bp, Artificial Sequence
  Description of Artificial Sequence: Synthetic oligonucleotide
agtcttaatggtaagcctggg

SEQ ID NO: 13979 - DNA, 21 bp, Artificial Sequence
  Description of Artificial Sequence: Synthetic oligonucleotide
actagtgagaagccgtttaat

SEQ ID NO: 13980 - DNA, 21 bp, Artificial Sequence
  Description of Artificial Sequence: Synthetic oligonucleotide
agtattacgaagggtaatcct

SEQ ID NO: 13981 - DNA, 21 bp, Artificial Sequence
  Description of Artificial Sequence: Synthetic oligonucleotide
ggtacggctaatccgtcgcgt

SEQ ID NO: 13982 - DNA, 21 bp, Artificial Sequence
  Description of Artificial Sequence: Synthetic oligonucleotide
agccccaacaaacccgccagc

SEQ ID NO: 13983 - DNA, 21 bp, Artificial Sequence
  Description of Artificial Sequence: Synthetic oligonucleotide
accaacagcaaacccgtcagc

SEQ ID NO: 13984 - DNA, 21 bp, Artificial Sequence
  Description of Artificial Sequence: Synthetic oligonucleotide
agtcgtgataagaatagtggt

SEQ ID NO: 13985 - DNA, 21 bp, Artificial Sequence
  Description of Artificial Sequence: Synthetic oligonucleotide
aattcgacgaatcatccgtct

SEQ ID NO: 13986 - DNA, 21 bp, Artificial Sequence
  Description of Artificial Sequence: Synthetic oligonucleotide
accgaaaaaagcaaagccatc

SEQ ID NO: 13987 - DNA, 21 bp, Artificial Sequence
  Description of Artificial Sequence: Synthetic oligonucleotide
agcggccccgacctcaaaagc

SEQ ID NO: 13988 - DNA, 21 bp, Artificial Sequence
  Description of Artificial Sequence: Synthetic oligonucleotide
gaccaaaccgccagaaacgtc

SEQ ID NO: 13989 - DNA, 21 bp, Artificial Sequence
  Description of Artificial Sequence: Synthetic oligonucleotide
tcggatagtcagaagactcgt

SEQ ID NO: 13990 - DNA, 21 bp, Artificial Sequence
  Description of Artificial Sequence: Synthetic oligonucleotide
atgagcgacaacaaagtcctc

SEQ ID NO: 13991 - DNA, 21 bp, Artificial Sequence
  Description of Artificial Sequence: Synthetic oligonucleotide
atgacgtctactaaggcttct

SEQ ID NO: 13992 - DNA, 21 bp, Artificial Sequence
  Description of Artificial Sequence: Synthetic oligonucleotide
gcggtttcgagtaagcattcg

SEQ ID NO: 13993 - DNA, 21 bp, Artificial Sequence
  Description of Artificial Sequence: Synthetic oligonucleotide
tcgcatcagtcgtctgctaat

SEQ ID NO: 13994 - DNA, 21 bp, Artificial Sequence
  Description of Artificial Sequence: Synthetic oligonucleotide
catggggttaaggattctaag

SEQ ID NO: 13995 - DNA, 21 bp, Artificial Sequence
  Description of Artificial Sequence: Synthetic oligonucleotide
ctcggcggcacccaaaacaaa

SEQ ID NO: 13996 - DNA, 21 bp, Artificial Sequence
  Description of Artificial Sequence: Synthetic oligonucleotide
tcgggggcgactccgattaag

SEQ ID NO: 13997 - DNA, 21 bp, Artificial Sequence
  Description of Artificial Sequence: Synthetic oligonucleotide
actggtgggaatacggctcat

SEQ ID NO: 13998 - DNA, 21 bp, Artificial Sequence
  Description of Artificial Sequence: Synthetic oligonucleotide
cttggtgatcagagggtgact

SEQ ID NO: 13999 - DNA, 21 bp, Artificial Sequence
  Description of Artificial Sequence: Synthetic oligonucleotide
tctgggtctgtgcagccggct

SEQ ID NO: 14000 - DNA, 21 bp, Artificial Sequence
  Description of Artificial Sequence: Synthetic oligonucleotide
aacgccgacaccagaagcagc

SEQ ID NO: 14001 - DNA, 21 bp, Artificial Sequence
  Description of Artificial Sequence: Synthetic oligonucleotide
tcttctgcttctaagtctaat

SEQ ID NO: 14002 - DNA, 21 bp, Artificial Sequence
  Description of Artificial Sequence: Synthetic oligonucleotide
aacggcagcgccagcagcagc

SEQ ID NO: 14003 - DNA, 21 bp, Artificial Sequence
  Description of Artificial Sequence: Synthetic oligonucleotide
aacgccaacggcagacaacaa

SEQ ID NO: 14004 - DNA, 21 bp, Artificial Sequence
  Description of Artificial Sequence: Synthetic oligonucleotide
ggcatgggccacagcgccgcc

SEQ ID NO: 14005 - DNA, 21 bp, Artificial Sequence
  Description of Artificial Sequence: Synthetic oligonucleotide
gctggttcgggtcattcgacg

SEQ ID NO: 14006 - DNA, 21 bp, Artificial Sequence
  Description of Artificial Sequence: Synthetic oligonucleotide
gacttcggcaaagccaacgcc

SEQ ID NO: 14007 - DNA, 21 bp, Artificial Sequence
  Description of Artificial Sequence: Synthetic oligonucleotide
ctcgccggcaacggcaacgcc

SEQ ID NO: 14008 - DNA, 21 bp, Artificial Sequence
  Description of Artificial Sequence: Synthetic oligonucleotide
gtccccgccggcaaaggcagc

SEQ ID NO: 14009 - DNA, 21 bp, Artificial Sequence
  Description of Artificial Sequence: Synthetic oligonucleotide
acgagtgctccgacgtctggg

SEQ ID NO: 14010 - DNA, 21 bp, Artificial Sequence
  Description of Artificial Sequence: Synthetic oligonucleotide
attagtagtaagcagtcttct

SEQ ID NO: 14011 - DNA, 21 bp, Artificial Sequence
  Description of Artificial Sequence: Synthetic oligonucleotide
gccaacaacggcaccggcggc

SEQ ID NO: 14012 - DNA, 21 bp, Artificial Sequence
  Description of Artificial Sequence: Synthetic oligonucleotide
tcttcgtcggggcggaatgag

SEQ ID NO: 14013 - DNA, 21 bp, Artificial Sequence
  Description of Artificial Sequence: Synthetic oligonucleotide
gctggtactacgcatggtggt

SEQ ID NO: 14014 - DNA, 21 bp, Artificial Sequence
  Description of Artificial Sequence: Synthetic oligonucleotide
atgcctacgtcttctcaggtt

SEQ ID NO: 14015 - DNA, 21 bp, Artificial Sequence
  Description of Artificial Sequence: Synthetic oligonucleotide
agaagcggcgaccccatcaaa

SEQ ID NO: 14016 - DNA, 21 bp, Artificial Sequence
  Description of Artificial Sequence: Synthetic oligonucleotide
caggcgggtagtagtaatggt

SEQ ID NO: 14017 - DNA, 21 bp, Artificial Sequence
  Description of Artificial Sequence: Synthetic oligonucleotide
ttcggcagcggcagcgccaac

SEQ ID NO: 14018 - DNA, 21 bp, Artificial Sequence
  Description of Artificial Sequence: Synthetic oligonucleotide
acgtctacgggtactcaggcg

SEQ ID NO: 14019 - DNA, 21 bp, Artificial Sequence
  Description of Artificial Sequence: Synthetic oligonucleotide
aacaaagaccacgccaacgtc

SEQ ID NO: 14020 - DNA, 21 bp, Artificial Sequence
  Description of Artificial Sequence: Synthetic oligonucleotide
gataattctagtatgtcgaag

SEQ ID NO: 14021 - DNA, 21 bp, Artificial Sequence
  Description of Artificial Sequence: Synthetic oligonucleotide
tctcctagtggtggtggtaat

SEQ ID NO: 14022 - DNA, 21 bp, Artificial Sequence
  Description of Artificial Sequence: Synthetic oligonucleotide
aatttggggggtaaggctgtg

SEQ ID NO: 14023 - DNA, 21 bp, Artificial Sequence
  Description of Artificial Sequence: Synthetic oligonucleotide
tcttcgacgaataaggctatg

SEQ ID NO: 14024 - DNA, 21 bp, Artificial Sequence
  Description of Artificial Sequence: Synthetic oligonucleotide
agcaccgacatcaaagcccaa

SEQ ID NO: 14025 - DNA, 21 bp, Artificial Sequence
  Description of Artificial Sequence: Synthetic oligonucleotide
tctgggagtagtaatcatgtt

SEQ ID NO: 14026 - DNA, 21 bp, Artificial Sequence
  Description of Artificial Sequence: Synthetic oligonucleotide
actactgttggttcgaattcg

SEQ ID NO: 14027 - DNA, 21 bp, Artificial Sequence
  Description of Artificial Sequence: Synthetic oligonucleotide
agcgccaaccacagccccacc

SEQ ID NO: 14028 - DNA, 21 bp, Artificial Sequence
  Description of Artificial Sequence: Synthetic oligonucleotide
gtcaccgccaacgccagcagc

SEQ ID NO: 14029 - DNA, 21 bp, Artificial Sequence
  Description of Artificial Sequence: Synthetic oligonucleotide
acccccagcaaaagcagcctc

SEQ ID NO: 14030 - DNA, 21 bp, Artificial Sequence
  Description of Artificial Sequence: Synthetic oligonucleotide
actggggggaggccgtcggag

SEQ ID NO: 14031 - DNA, 21 bp, Artificial Sequence
  Description of Artificial Sequence: Synthetic oligonucleotide
ctggtttcttctgagcagaag

SEQ ID NO: 14032 - DNA, 21 bp, Artificial Sequence
  Description of Artificial Sequence: Synthetic oligonucleotide
atgggcggcgcccaaggcagc

SEQ ID NO: 14033 - DNA, 21 bp, Artificial Sequence
  Description of Artificial Sequence: Synthetic oligonucleotide
aacggttctagacagaatcaa

SEQ ID NO: 14034 - DNA, 21 bp, Artificial Sequence
  Description of Artificial Sequence: Synthetic oligonucleotide
catggtacgggtaagggtgcg

SEQ ID NO: 14035 - DNA, 21 bp, Artificial Sequence
  Description of Artificial Sequence: Synthetic oligonucleotide
gggaattctgctggtcttagt

SEQ ID NO: 14036 - DNA, 21 bp, Artificial Sequence
  Description of Artificial Sequence: Synthetic oligonucleotide
agcggcatccaaaaacccgcc

SEQ ID NO: 14037 - DNA, 21 bp, Artificial Sequence
  Description of Artificial Sequence: Synthetic oligonucleotide
ggcagcaaaggcagccaaaac

SEQ ID NO: 14038 - DNA, 21 bp, Artificial Sequence
  Description of Artificial Sequence: Synthetic oligonucleotide
gctactggtgatccgcgtagg

SEQ ID NO: 14039 - DNA, 21 bp, Artificial Sequence
  Description of Artificial Sequence: Synthetic oligonucleotide
gatgcggcgcgtccgcaggct

SEQ ID NO: 14040 - DNA, 21 bp, Artificial Sequence
  Description of Artificial Sequence: Synthetic oligonucleotide
gaaaacaccagccccagcctc

SEQ ID NO: 14041 - DNA, 21 bp, Artificial Sequence
  Description of Artificial Sequence: Synthetic oligonucleotide
gatggtgataagtctcgtgcg

SEQ ID NO: 14042 - DNA, 21 bp, Artificial Sequence
  Description of Artificial Sequence: Synthetic oligonucleotide
agcgccagcggcgccaccggc

SEQ ID NO: 14043 - DNA, 21 bp, Artificial Sequence
  Description of Artificial Sequence: Synthetic oligonucleotide
ctccccggcaaaaccaacagc

SEQ ID NO: 14044 - DNA, 21 bp, Artificial Sequence
  Description of Artificial Sequence: Synthetic oligonucleotide
gaggtggggcatagtaagggg

SEQ ID NO: 14045 - DNA, 21 bp, Artificial Sequence
  Description of Artificial Sequence: Synthetic oligonucleotide
gccggcgccacccccatgaga

SEQ ID NO: 14046 - DNA, 21 bp, Artificial Sequence
  Description of Artificial Sequence: Synthetic oligonucleotide
atgagaagccaagacaccacc

SEQ ID NO: 14047 - DNA, 21 bp, Artificial Sequence
  Description of Artificial Sequence: Synthetic oligonucleotide
caaagcggccaacccggcaga

SEQ ID NO: 14048 - DNA, 21 bp, Artificial Sequence
  Description of Artificial Sequence: Synthetic oligonucleotide
gatggggttcggagttcgaat

SEQ ID NO: 14049 - DNA, 21 bp, Artificial Sequence
  Description of Artificial Sequence: Synthetic oligonucleotide
accaccacccacaaccccgtc

SEQ ID NO: 14050 - DNA, 21 bp, Artificial Sequence
  Description of Artificial Sequence: Synthetic oligonucleotide
cttccttcttcgccggcgact

SEQ ID NO: 14051 - DNA, 21 bp, Artificial Sequence
  Description of Artificial Sequence: Synthetic oligonucleotide
gatgggtctagtcctcagatt

SEQ ID NO: 14052 - DNA, 21 bp, Artificial Sequence
  Description of Artificial Sequence: Synthetic oligonucleotide
agcgccggcagcaaaaccgcc

SEQ ID NO: 14053 - DNA, 21 bp, Artificial Sequence
  Description of Artificial Sequence: Synthetic oligonucleotide
ggtagtaagactcattcttcg

SEQ ID NO: 14054 - DNA, 21 bp, Artificial Sequence
  Description of Artificial Sequence: Synthetic oligonucleotide
tcggggaatagtgcgaagacg

SEQ ID NO: 14055 - DNA, 21 bp, Artificial Sequence
  Description of Artificial Sequence: Synthetic oligonucleotide
catggtgggtctaagactacg

SEQ ID NO: 14056 - DNA, 21 bp, Artificial Sequence
  Description of Artificial Sequence: Synthetic oligonucleotide
gttccttcggataggtcgagt

SEQ ID NO: 14057 - DNA, 21 bp, Artificial Sequence
  Description of Artificial Sequence: Synthetic oligonucleotide
caacaaggcaaaagcgccctc

SEQ ID NO: 14058 - DNA, 21 bp, Artificial Sequence
  Description of Artificial Sequence: Synthetic oligonucleotide
atgcatgatggtaagtcggtt

SEQ ID NO: 14059 - DNA, 21 bp, Artificial Sequence
  Description of Artificial Sequence: Synthetic oligonucleotide
gattctgctggtaatcgtctt

SEQ ID NO: 14060 - DNA, 21 bp, Artificial Sequence
  Description of Artificial Sequence: Synthetic oligonucleotide
gtgagtgggtctagtcatgct

SEQ ID NO: 14061 - DNA, 21 bp, Artificial Sequence
  Description of Artificial Sequence: Synthetic oligonucleotide
agttctgatcggtctcctgtt

SEQ ID NO: 14062 - DNA, 21 bp, Artificial Sequence
  Description of Artificial Sequence: Synthetic oligonucleotide
gggaatgctaaggcgccgagt

SEQ ID NO: 14063 - DNA, 21 bp, Artificial Sequence
  Description of Artificial Sequence: Synthetic oligonucleotide
ggtactgctggttcgaggaat

SEQ ID NO: 14064 - DNA, 21 bp, Artificial Sequence
  Description of Artificial Sequence: Synthetic oligonucleotide
gtcagcgacaaacccgccatc

SEQ ID NO: 14065 - DNA, 21 bp, Artificial Sequence
  Description of Artificial Sequence: Synthetic oligonucleotide
ttgcgtggtgcgtcgtctgag

SEQ ID NO: 14066 - DNA, 21 bp, Artificial Sequence
  Description of Artificial Sequence: Synthetic oligonucleotide
gaaagcagcggcagcatgaga

SEQ ID NO: 14067 - DNA, 21 bp, Artificial Sequence
  Description of Artificial Sequence: Synthetic oligonucleotide
ggtagtactaaggttacgcag

SEQ ID NO: 14068 - DNA, 21 bp, Artificial Sequence
  Description of Artificial Sequence: Synthetic oligonucleotide
agtggtgctaaggcttctggg

SEQ ID NO: 14069 - DNA, 21 bp, Artificial Sequence
  Description of Artificial Sequence: Synthetic oligonucleotide
ggcagagacacccacaacaaa

SEQ ID NO: 14070 - DNA, 21 bp, Artificial Sequence
  Description of Artificial Sequence: Synthetic oligonucleotide
tcgggtacgcctaatgggcat

SEQ ID NO: 14071 - DNA, 21 bp, Artificial Sequence
  Description of Artificial Sequence: Synthetic oligonucleotide
ggcagccacagccaaaaaggc

SEQ ID NO: 14072 - DNA, 21 bp, Artificial Sequence
  Description of Artificial Sequence: Synthetic oligonucleotide
tctaatggtgttcgttcttcg

SEQ ID NO: 14073 - DNA, 21 bp, Artificial Sequence
  Description of Artificial Sequence: Synthetic oligonucleotide
gggcgtggttctggtgataag

SEQ ID NO: 14074 - DNA, 21 bp, Artificial Sequence
  Description of Artificial Sequence: Synthetic oligonucleotide
agtagtgggaattcgcggtcg

SEQ ID NO: 14075 - DNA, 21 bp, Artificial Sequence
  Description of Artificial Sequence: Synthetic oligonucleotide
gtccccgacaaaagcagcaaa

SEQ ID NO: 14076 - DNA, 21 bp, Artificial Sequence
  Description of Artificial Sequence: Synthetic oligonucleotide
attccgtctactaagtctcag

SEQ ID NO: 14077 - DNA, 21 bp, Artificial Sequence
  Description of Artificial Sequence: Synthetic oligonucleotide
agaaacggcaaagaaaacagc

SEQ ID NO: 14078 - DNA, 21 bp, Artificial Sequence
  Description of Artificial Sequence: Synthetic oligonucleotide
caaatccaagcccccgccagc

SEQ ID NO: 14079 - DNA, 21 bp, Artificial Sequence
  Description of Artificial Sequence: Synthetic oligonucleotide
ggttcggtgaaggtggagagt

SEQ ID NO: 14080 - DNA, 21 bp, Artificial Sequence
  Description of Artificial Sequence: Synthetic oligonucleotide
acccccaccggcgccagaaac

SEQ ID NO: 14081 - DNA, 21 bp, Artificial Sequence
  Description of Artificial Sequence: Synthetic oligonucleotide
gataatcagggtgggcgtggt

SEQ ID NO: 14082 - DNA, 21 bp, Artificial Sequence
  Description of Artificial Sequence: Synthetic oligonucleotide
ggcaccagccccagcgacaga

SEQ ID NO: 14083 - DNA, 21 bp, Artificial Sequence
  Description of Artificial Sequence: Synthetic oligonucleotide
gcgtcggatcagacgggtaag

SEQ ID NO: 14084 - DNA, 21 bp, Artificial Sequence
  Description of Artificial Sequence: Synthetic oligonucleotide
gtcacccaaagccacagcacc

SEQ ID NO: 14085 - DNA, 21 bp, Artificial Sequence
  Description of Artificial Sequence: Synthetic oligonucleotide
agccccgacaccagacccgtc

SEQ ID NO: 14086 - DNA, 21 bp, Artificial Sequence
  Description of Artificial Sequence: Synthetic oligonucleotide
ggcagcggcaacagcaccctc

SEQ ID NO: 14087 - DNA, 21 bp, Artificial Sequence
  Description of Artificial Sequence: Synthetic oligonucleotide
aatggtggtagtaagccgcct

SEQ ID NO: 14088 - DNA, 21 bp, Artificial Sequence
  Description of Artificial Sequence: Synthetic oligonucleotide
atgggttctaatgagcagagg

SEQ ID NO: 14089 - DNA, 21 bp, Artificial Sequence
  Description of Artificial Sequence: Synthetic oligonucleotide
agcagcaccaccaccaacgtc

SEQ ID NO: 14090 - DNA, 21 bp, Artificial Sequence
  Description of Artificial Sequence: Synthetic oligonucleotide
ggcagcaacgcccccatcaaa

SEQ ID NO: 14091 - DNA, 21 bp, Artificial Sequence
  Description of Artificial Sequence: Synthetic oligonucleotide
actcctagtaagacttctact

SEQ ID NO: 14092 - DNA, 21 bp, Artificial Sequence
  Description of Artificial Sequence: Synthetic oligonucleotide
agtactagtaggactaatact

SEQ ID NO: 14093 - DNA, 21 bp, Artificial Sequence
  Description of Artificial Sequence: Synthetic oligonucleotide
caagtcagcgcccccagagaa

SEQ ID NO: 14094 - DNA, 21 bp, Artificial Sequence
  Description of Artificial Sequence: Synthetic oligonucleotide
gacatggccagcaaacccgcc

SEQ ID NO: 14095 - DNA, 21 bp, Artificial Sequence
  Description of Artificial Sequence: Synthetic oligonucleotide
ctcaaccaaaaaagcgtcgcc

SEQ ID NO: 14096 - DNA, 21 bp, Artificial Sequence
  Description of Artificial Sequence: Synthetic oligonucleotide
aacgccggcgcccacgccggc

SEQ ID NO: 14097 - DNA, 21 bp, Artificial Sequence
  Description of Artificial Sequence: Synthetic oligonucleotide
accagcggcgacagcaacaga

SEQ ID NO: 14098 - DNA, 21 bp, Artificial Sequence
  Description of Artificial Sequence: Synthetic oligonucleotide
agcaccaccggcagcagaagc

SEQ ID NO: 14099 - DNA, 21 bp, Artificial Sequence
  Description of Artificial Sequence: Synthetic oligonucleotide
agtattggtaatccttctact

SEQ ID NO: 14100 - DNA, 21 bp, Artificial Sequence
  Description of Artificial Sequence: Synthetic oligonucleotide
attgggactactcctgcgagg

SEQ ID NO: 14101 - DNA, 21 bp, Artificial Sequence
  Description of Artificial Sequence: Synthetic oligonucleotide
gggactaataagacggtttct

SEQ ID NO: 14102 - DNA, 21 bp, Artificial Sequence
  Description of Artificial Sequence: Synthetic oligonucleotide
gtcaccggcagccccagcaga

SEQ ID NO: 14103 - DNA, 21 bp, Artificial Sequence
  Description of Artificial Sequence: Synthetic oligonucleotide
gttcgggattctaagtctacg

SEQ ID NO: 14104 - DNA, 21 bp, Artificial Sequence
  Description of Artificial Sequence: Synthetic oligonucleotide
tctcagaaggcgtcggttcag

SEQ ID NO: 14105 - DNA, 21 bp, Artificial Sequence
  Description of Artificial Sequence: Synthetic oligonucleotide
acgagggctcagccttcttct

SEQ ID NO: 14106 - DNA, 21 bp, Artificial Sequence
  Description of Artificial Sequence: Synthetic oligonucleotide
accaccaaacccaacagcgcc

SEQ ID NO: 14107 - DNA, 21 bp, Artificial Sequence
  Description of Artificial Sequence: Synthetic oligonucleotide
gacaaccccatccccgtcaaa

SEQ ID NO: 14108 - DNA, 21 bp, Artificial Sequence
  Description of Artificial Sequence: Synthetic oligonucleotide
ggtaagacggatcgtaatagt

SEQ ID NO: 14109 - DNA, 21 bp, Artificial Sequence
  Description of Artificial Sequence: Synthetic oligonucleotide
aatagtacggggaagctgggg

SEQ ID NO: 14110 - DNA, 21 bp, Artificial Sequence
  Description of Artificial Sequence: Synthetic oligonucleotide
accgtcagcagcaccaaccac

SEQ ID NO: 14111 - DNA, 21 bp, Artificial Sequence
  Description of Artificial Sequence: Synthetic oligonucleotide
agcagcagcaccggcatgcaa

SEQ ID NO: 14112 - DNA, 21 bp, Artificial Sequence
  Description of Artificial Sequence: Synthetic oligonucleotide
gcgtctaatgtgccgaataag

SEQ ID NO: 14113 - DNA, 21 bp, Artificial Sequence
  Description of Artificial Sequence: Synthetic oligonucleotide
gcttctgctagtcctactctt

SEQ ID NO: 14114 - DNA, 21 bp, Artificial Sequence
  Description of Artificial Sequence: Synthetic oligonucleotide
cacaccagcgacaaaaccgtc

SEQ ID NO: 14115 - DNA, 21 bp, Artificial Sequence
  Description of Artificial Sequence: Synthetic oligonucleotide
tctagtactaagcctactagt

SEQ ID NO: 14116 - DNA, 21 bp, Artificial Sequence
  Description of Artificial Sequence: Synthetic oligonucleotide
aacagaaaaaacgacacccaa

SEQ ID NO: 14117 - DNA, 21 bp, Artificial Sequence
  Description of Artificial Sequence: Synthetic oligonucleotide
agcgtccccaccggcaaaggc

SEQ ID NO: 14118 - DNA, 21 bp, Artificial Sequence
  Description of Artificial Sequence: Synthetic oligonucleotide
gagccttctaagagtatgatt

SEQ ID NO: 14119 - DNA, 21 bp, Artificial Sequence
  Description of Artificial Sequence: Synthetic oligonucleotide
gcccaagccaccaaacccagc

SEQ ID NO: 14120 - DNA, 21 bp, Artificial Sequence
  Description of Artificial Sequence: Synthetic oligonucleotide
aatactggtaagtctcagacg

SEQ ID NO: 14121 - DNA, 21 bp, Artificial Sequence
  Description of Artificial Sequence: Synthetic oligonucleotide
agaggcaccaaaccccaagaa

SEQ ID NO: 14122 - DNA, 21 bp, Artificial Sequence
  Description of Artificial Sequence: Synthetic oligonucleotide
agcaaagaaaacaaagccagc

SEQ ID NO: 14123 - DNA, 21 bp, Artificial Sequence
  Description of Artificial Sequence: Synthetic oligonucleotide
cagcaggctaaggggaatgcg

SEQ ID NO: 14124 - DNA, 21 bp, Artificial Sequence
  Description of Artificial Sequence: Synthetic oligonucleotide
aaaggcaacagcaccgtcaac

SEQ ID NO: 14125 - DNA, 21 bp, Artificial Sequence
  Description of Artificial Sequence: Synthetic oligonucleotide
caaggcagcagcggcctcggc

SEQ ID NO: 14126 - DNA, 21 bp, Artificial Sequence
  Description of Artificial Sequence: Synthetic oligonucleotide
gacagaagccccagcaacgtc

SEQ ID NO: 14127 - DNA, 21 bp, Artificial Sequence
  Description of Artificial Sequence: Synthetic oligonucleotide
gccggcgacagcaaagccaga

SEQ ID NO: 14128 - DNA, 21 bp, Artificial Sequence
  Description of Artificial Sequence: Synthetic oligonucleotide
actccttcgaaggataaggcg

SEQ ID NO: 14129 - DNA, 21 bp, Artificial Sequence
  Description of Artificial Sequence: Synthetic oligonucleotide
aaacaaggccccagcgccgaa

SEQ ID NO: 14130 - DNA, 21 bp, Artificial Sequence
  Description of Artificial Sequence: Synthetic oligonucleotide
tcgcggggtgctcctggtacg

SEQ ID NO: 14131 - DNA, 21 bp, Artificial Sequence
  Description of Artificial Sequence: Synthetic oligonucleotide
ggcagcgcccaaagccccaga

SEQ ID NO: 14132 - DNA, 21 bp, Artificial Sequence
  Description of Artificial Sequence: Synthetic oligonucleotide
accaacagaaaccccaacctc

SEQ ID NO: 14133 - DNA, 21 bp, Artificial Sequence
  Description of Artificial Sequence: Synthetic oligonucleotide
atcgacagcaaacccaccaac

SEQ ID NO: 14134 - DNA, 21 bp, Artificial Sequence
  Description of Artificial Sequence: Synthetic oligonucleotide
gtcaccggcggcaccaaaggc

SEQ ID NO: 14135 - DNA, 21 bp, Artificial Sequence
  Description of Artificial Sequence: Synthetic oligonucleotide
accaccaacacccccctcaaa

SEQ ID NO: 14136 - DNA, 21 bp, Artificial Sequence
  Description of Artificial Sequence: Synthetic oligonucleotide
agccacgaaggcaaaagcacc

SEQ ID NO: 14137 - DNA, 21 bp, Artificial Sequence
  Description of Artificial Sequence: Synthetic oligonucleotide
atggacaaacccagccaaggc

SEQ ID NO: 14138 - DNA, 21 bp, Artificial Sequence
  Description of Artificial Sequence: Synthetic oligonucleotide
acccaacaagccaaaaccgaa

SEQ ID NO: 14139 - DNA, 21 bp, Artificial Sequence
  Description of Artificial Sequence: Synthetic oligonucleotide
ggcgacaacaaagtcctcaaa

SEQ ID NO: 14140 - DNA, 21 bp, Artificial Sequence
  Description of Artificial Sequence: Synthetic oligonucleotide
acgcggagtaatccgcaggcg

SEQ ID NO: 14141 - DNA, 21 bp, Artificial Sequence
  Description of Artificial Sequence: Synthetic oligonucleotide
agcctcagcagcggcaccaaa

SEQ ID NO: 14142 - DNA, 21 bp, Artificial Sequence
  Description of Artificial Sequence: Synthetic oligonucleotide
atgagcggcggccccaaaaac

SEQ ID NO: 14143 - DNA, 21 bp, Artificial Sequence
  Description of Artificial Sequence: Synthetic oligonucleotide
gttgggactggtcagcagggt

SEQ ID NO: 14144 - DNA, 21 bp, Artificial Sequence
  Description of Artificial Sequence: Synthetic oligonucleotide
gctgagtctgggcgtaatacg

SEQ ID NO: 14145 - DNA, 21 bp, Artificial Sequence
  Description of Artificial Sequence: Synthetic oligonucleotide
accatcaacaaacaagccacc

SEQ ID NO: 14146 - DNA, 21 bp, Artificial Sequence
  Description of Artificial Sequence: Synthetic oligonucleotide
gccaaaagcagcggcagcggc

SEQ ID NO: 14147 - DNA, 21 bp, Artificial Sequence
  Description of Artificial Sequence: Synthetic oligonucleotide
aacaccagcaaagccagcgcc

SEQ ID NO: 14148 - DNA, 21 bp, Artificial Sequence
  Description of Artificial Sequence: Synthetic oligonucleotide
agcggcaaacccgccagcgcc

SEQ ID NO: 14149 - DNA, 21 bp, Artificial Sequence
  Description of Artificial Sequence: Synthetic oligonucleotide
tcgatgacgaagagtaatgtt

SEQ ID NO: 14150 - DNA, 21 bp, Artificial Sequence
  Description of Artificial Sequence: Synthetic oligonucleotide
agcaccagaaccagcagcgaa

SEQ ID NO: 14151 - DNA, 21 bp, Artificial Sequence
  Description of Artificial Sequence: Synthetic oligonucleotide
agacaaggcagcgacgccaga

SEQ ID NO: 14152 - DNA, 21 bp, Artificial Sequence
  Description of Artificial Sequence: Synthetic oligonucleotide
cagaaggctccttctgcttcg

SEQ ID NO: 14153 - DNA, 21 bp, Artificial Sequence
  Description of Artificial Sequence: Synthetic oligonucleotide
ggcggcagccccgccgccagc

SEQ ID NO: 14154 - DNA, 21 bp, Artificial Sequence
  Description of Artificial Sequence: Synthetic oligonucleotide
gtcggcagcagcagcagcatg

SEQ ID NO: 14155 - DNA, 21 bp, Artificial Sequence
  Description of Artificial Sequence: Synthetic oligonucleotide
agcctcagcgtccccaaagac

SEQ ID NO: 14156 - DNA, 21 bp, Artificial Sequence
  Description of Artificial Sequence: Synthetic oligonucleotide
atgtcttctaagcctgctacg

SEQ ID NO: 14157 - DNA, 21 bp, Artificial Sequence
  Description of Artificial Sequence: Synthetic oligonucleotide
agtgtgatgcagaaggctagt

SEQ ID NO: 14158 - DNA, 21 bp, Artificial Sequence
  Description of Artificial Sequence: Synthetic oligonucleotide
actgggtctactgcgactctg

SEQ ID NO: 14159 - DNA, 21 bp, Artificial Sequence
  Description of Artificial Sequence: Synthetic oligonucleotide
tcgccgcagaagaataatggt

SEQ ID NO: 14160 - DNA, 21 bp, Artificial Sequence
  Description of Artificial Sequence: Synthetic oligonucleotide
gggccggagcgtcctgcgggt

SEQ ID NO: 14161 - DNA, 21 bp, Artificial Sequence
  Description of Artificial Sequence: Synthetic oligonucleotide
aaacccagagaaagcagcggc

SEQ ID NO: 14162 - DNA, 21 bp, Artificial Sequence
  Description of Artificial Sequence: Synthetic oligonucleotide
catgctgatcgtcaggctagt

SEQ ID NO: 14163 - DNA, 21 bp, Artificial Sequence
  Description of Artificial Sequence: Synthetic oligonucleotide
gccagcggcagcggccaaagc

SEQ ID NO: 14164 - DNA, 21 bp, Artificial Sequence
  Description of Artificial Sequence: Synthetic oligonucleotide
tcgagtactaataatcctaag

SEQ ID NO: 14165 - DNA, 21 bp, Artificial Sequence
  Description of Artificial Sequence: Synthetic oligonucleotide
gctggtactccttctcctcgg

SEQ ID NO: 14166 - DNA, 21 bp, Artificial Sequence
  Description of Artificial Sequence: Synthetic oligonucleotide
agtggtaggccggatgtgtcg

SEQ ID NO: 14167 - DNA, 21 bp, Artificial Sequence
  Description of Artificial Sequence: Synthetic oligonucleotide
cacaccagccccggcaaaaac

SEQ ID NO: 14168 - DNA, 21 bp, Artificial Sequence
  Description of Artificial Sequence: Synthetic oligonucleotide
ggttctgctaagaattctgcg

SEQ ID NO: 14169 - DNA, 21 bp, Artificial Sequence
  Description of Artificial Sequence: Synthetic oligonucleotide
gcccaagccagccaaaccaaa

SEQ ID NO: 14170 - DNA, 21 bp, Artificial Sequence
  Description of Artificial Sequence: Synthetic oligonucleotide
ggcagccaaaaaccctacagc

SEQ ID NO: 14171 - DNA, 21 bp, Artificial Sequence
  Description of Artificial Sequence: Synthetic oligonucleotide
gtcagcagcaccacccaaacc

SEQ ID NO: 14172 - DNA, 21 bp, Artificial Sequence
  Description of Artificial Sequence: Synthetic oligonucleotide
tctgtgacttctcaggggaag

SEQ ID NO: 14173 - DNA, 21 bp, Artificial Sequence
  Description of Artificial Sequence: Synthetic oligonucleotide
agcgtcgccagcggcaacaaa

SEQ ID NO: 14174 - DNA, 21 bp, Artificial Sequence
  Description of Artificial Sequence: Synthetic oligonucleotide
tctggtgctcagcagccgcgg

SEQ ID NO: 14175 - DNA, 21 bp, Artificial Sequence
  Description of Artificial Sequence: Synthetic oligonucleotide
cattctaagcctagtactatg

SEQ ID NO: 14176 - DNA, 21 bp, Artificial Sequence
  Description of Artificial Sequence: Synthetic oligonucleotide
aacggcagaggcggcacccaa

SEQ ID NO: 14177 - DNA, 21 bp, Artificial Sequence
  Description of Artificial Sequence: Synthetic oligonucleotide
ctgcctggtaaggcgatgact

SEQ ID NO: 14178 - DNA, 21 bp, Artificial Sequence
  Description of Artificial Sequence: Synthetic oligonucleotide
caaaccggcgaaatcggcaaa

SEQ ID NO: 14179 - DNA, 21 bp, Artificial Sequence
  Description of Artificial Sequence: Synthetic oligonucleotide
agcagcaaccacaccagcagc

SEQ ID NO: 14180 - DNA, 21 bp, Artificial Sequence
  Description of Artificial Sequence: Synthetic oligonucleotide
cggcaggagtcgaagagtatg

SEQ ID NO: 14181 - DNA, 21 bp, Artificial Sequence
  Description of Artificial Sequence: Synthetic oligonucleotide
gttggtcagggtaagaatgcg

SEQ ID NO: 14182 - DNA, 21 bp, Artificial Sequence
  Description of Artificial Sequence: Synthetic oligonucleotide
acccccggcagcaacggcaga

SEQ ID NO: 14183 - DNA, 21 bp, Artificial Sequence
  Description of Artificial Sequence: Synthetic oligonucleotide
acgactgggacggataagttg

SEQ ID NO: 14184 - DNA, 21 bp, Artificial Sequence
  Description of Artificial Sequence: Synthetic oligonucleotide
gaacccagcgccacccaaaga

SEQ ID NO: 14185 - DNA, 21 bp, Artificial Sequence
  Description of Artificial Sequence: Synthetic oligonucleotide
aatgttggtacggcttctaag

SEQ ID NO: 14186 - DNA, 21 bp, Artificial Sequence
  Description of Artificial Sequence: Synthetic oligonucleotide
ggtgggggtactgcgcatatg

SEQ ID NO: 14187 - DNA, 21 bp, Artificial Sequence
  Description of Artificial Sequence: Synthetic oligonucleotide
ggtcagtctactcatcatcag

SEQ ID NO: 14188 - DNA, 21 bp, Artificial Sequence
  Description of Artificial Sequence: Synthetic oligonucleotide
aaggctaatcaggggtctggg

SEQ ID NO: 14189 - DNA, 21 bp, Artificial Sequence
  Description of Artificial Sequence: Synthetic oligonucleotide
ggcagaaccaacatcacccaa

SEQ ID NO: 14190 - DNA, 21 bp, Artificial Sequence
  Description of Artificial Sequence: Synthetic oligonucleotide
agcaccagcagcaaaatgggc

SEQ ID NO: 14191 - DNA, 21 bp, Artificial Sequence
  Description of Artificial Sequence: Synthetic oligonucleotide
gtccaaaccggcagccacagc

SEQ ID NO: 14192 - DNA, 21 bp, Artificial Sequence
  Description of Artificial Sequence: Synthetic oligonucleotide
agtgcgagtccgacgagtggt

SEQ ID NO: 14193 - DNA, 21 bp, Artificial Sequence
  Description of Artificial Sequence: Synthetic oligonucleotide
gtcagagacaaaagcaccgcc

SEQ ID NO: 14194 - DNA, 21 bp, Artificial Sequence
  Description of Artificial Sequence: Synthetic oligonucleotide
caaagcagcggcagcagaagc

SEQ ID NO: 14195 - DNA, 21 bp, Artificial Sequence
  Description of Artificial Sequence: Synthetic oligonucleotide
aatgctcagagtccgattcgg

SEQ ID NO: 14196 - DNA, 21 bp, Artificial Sequence
  Description of Artificial Sequence: Synthetic oligonucleotide
ggcgccagcgtcggcagccac

SEQ ID NO: 14197 - DNA, 21 bp, Artificial Sequence
  Description of Artificial Sequence: Synthetic oligonucleotide
aaaggcgacaaagtcttcctc

SEQ ID NO: 14198 - DNA, 21 bp, Artificial Sequence
  Description of Artificial Sequence: Synthetic oligonucleotide
acggggcatgcgcctaatgtg

SEQ ID NO: 14199 - DNA, 21 bp, Artificial Sequence
  Description of Artificial Sequence: Synthetic oligonucleotide
aatgctctgggtgcggggggg

SEQ ID NO: 14200 - DNA, 21 bp, Artificial Sequence
  Description of Artificial Sequence: Synthetic oligonucleotide
agcgtcagcaaacccatcagc

SEQ ID NO: 14201 - DNA, 21 bp, Artificial Sequence
  Description of Artificial Sequence: Synthetic oligonucleotide
tacaacggcagcaaactccaa

SEQ ID NO: 14202 - DNA, 21 bp, Artificial Sequence
  Description of Artificial Sequence: Synthetic oligonucleotide
gaggctaatactaagcctcat

SEQ ID NO: 14203 - DNA, 21 bp, Artificial Sequence
  Description of Artificial Sequence: Synthetic oligonucleotide
aatacgaatggtgctgggcgt

SEQ ID NO: 14204 - DNA, 21 bp, Artificial Sequence
  Description of Artificial Sequence: Synthetic oligonucleotide
gtcagcgccaaccccccccaa

SEQ ID NO: 14205 - DNA, 21 bp, Artificial Sequence
  Description of Artificial Sequence: Synthetic oligonucleotide
aatactagtggtaagggtgtt

SEQ ID NO: 14206 - DNA, 21 bp, Artificial Sequence
  Description of Artificial Sequence: Synthetic oligonucleotide
agtagtactagtgttatgaag

SEQ ID NO: 14207 - DNA, 21 bp, Artificial Sequence
  Description of Artificial Sequence: Synthetic oligonucleotide
gacagaagcaaagccagcacc

SEQ ID NO: 14208 - DNA, 21 bp, Artificial Sequence
  Description of Artificial Sequence: Synthetic oligonucleotide
agaagcaaagaaagccaagtc

SEQ ID NO: 14209 - DNA, 21 bp, Artificial Sequence
  Description of Artificial Sequence: Synthetic oligonucleotide
agttctgggcagtctatttcg

SEQ ID NO: 14210 - DNA, 21 bp, Artificial Sequence
  Description of Artificial Sequence: Synthetic oligonucleotide
acgcctagtacgtcgggtagg

SEQ ID NO: 14211 - DNA, 21 bp, Artificial Sequence
  Description of Artificial Sequence: Synthetic oligonucleotide
gaccccaccagcggcaaaggc

SEQ ID NO: 14212 - DNA, 21 bp, Artificial Sequence
  Description of Artificial Sequence: Synthetic oligonucleotide
gggactgcgtctccggcgaat

SEQ ID NO: 14213 - DNA, 21 bp, Artificial Sequence
  Description of Artificial Sequence: Synthetic oligonucleotide
cagccgacttcgaagtcgcac

SEQ ID NO: 14214 - DNA, 21 bp, Artificial Sequence
  Description of Artificial Sequence: Synthetic oligonucleotide
accggcagcgccaaccacgtc

SEQ ID NO: 14215 - DNA, 21 bp, Artificial Sequence
  Description of Artificial Sequence: Synthetic oligonucleotide
caggctcgtagtagtcaggag

SEQ ID NO: 14216 - DNA, 21 bp, Artificial Sequence
  Description of Artificial Sequence: Synthetic oligonucleotide
gacgccagacaaaaaagcgtc

SEQ ID NO: 14217 - DNA, 21 bp, Artificial Sequence
  Description of Artificial Sequence: Synthetic oligonucleotide
gccggcgccagcagcgtcaac

SEQ ID NO: 14218 - DNA, 21 bp, Artificial Sequence
  Description of Artificial Sequence: Synthetic oligonucleotide
catgagcttaaggggactacg

SEQ ID NO: 14219 - DNA, 21 bp, Artificial Sequence
  Description of Artificial Sequence: Synthetic oligonucleotide
gtcagcaaccccgaaaccaaa

SEQ ID NO: 14220 - DNA, 21 bp, Artificial Sequence
  Description of Artificial Sequence: Synthetic oligonucleotide
cagcagcagtctccttctttg

SEQ ID NO: 14221 - DNA, 21 bp, Artificial Sequence
  Description of Artificial Sequence: Synthetic oligonucleotide
gctgatactactccgactaag

SEQ ID NO: 14222 - DNA, 21 bp, Artificial Sequence
  Description of Artificial Sequence: Synthetic oligonucleotide
gataattctaaggggtctcgt

SEQ ID NO: 14223 - DNA, 21 bp, Artificial Sequence
  Description of Artificial Sequence: Synthetic oligonucleotide
gccaacgccaaacccagccaa

SEQ ID NO: 14224 - DNA, 21 bp, Artificial Sequence
  Description of Artificial Sequence: Synthetic oligonucleotide
gcggggggggcttctggtact

SEQ ID NO: 14225 - DNA, 21 bp, Artificial Sequence
  Description of Artificial Sequence: Synthetic oligonucleotide
gggaatggtgctccgggtctg

SEQ ID NO: 14226 - DNA, 21 bp, Artificial Sequence
  Description of Artificial Sequence: Synthetic oligonucleotide
aacagaaccggcaaactcgaa

SEQ ID NO: 14227 - DNA, 21 bp, Artificial Sequence
  Description of Artificial Sequence: Synthetic oligonucleotide
ggtaatgataagcagcattct

SEQ ID NO: 14228 - DNA, 21 bp, Artificial Sequence
  Description of Artificial Sequence: Synthetic oligonucleotide
cagagtggtcctcctaatcgt

SEQ ID NO: 14229 - DNA, 21 bp, Artificial Sequence
  Description of Artificial Sequence: Synthetic oligonucleotide
ggcagcgccagcaacaacaaa

SEQ ID NO: 14230 - DNA, 21 bp, Artificial Sequence
  Description of Artificial Sequence: Synthetic oligonucleotide
agcaccgtcagcaaaaccgcc

SEQ ID NO: 14231 - DNA, 21 bp, Artificial Sequence
  Description of Artificial Sequence: Synthetic oligonucleotide
atgagcacccaaaaactcggc

SEQ ID NO: 14232 - DNA, 21 bp, Artificial Sequence
  Description of Artificial Sequence: Synthetic oligonucleotide
atttctcgtagtagtcagcag

SEQ ID NO: 14233 - DNA, 21 bp, Artificial Sequence
  Description of Artificial Sequence: Synthetic oligonucleotide
gagtctaatactcctcctaag

SEQ ID NO: 14234 - DNA, 21 bp, Artificial Sequence
  Description of Artificial Sequence: Synthetic oligonucleotide
acgcgtgctcaggcgaatagt

SEQ ID NO: 14235 - DNA, 21 bp, Artificial Sequence
  Description of Artificial Sequence: Synthetic oligonucleotide
actaatgcggcgaagagtagt

SEQ ID NO: 14236 - DNA, 21 bp, Artificial Sequence
  Description of Artificial Sequence: Synthetic oligonucleotide
catcctttgcagtctggtacg

SEQ ID NO: 14237 - DNA, 21 bp, Artificial Sequence
  Description of Artificial Sequence: Synthetic oligonucleotide
gatccttctaagaagaatgcg

SEQ ID NO: 14238 - DNA, 21 bp, Artificial Sequence
  Description of Artificial Sequence: Synthetic oligonucleotide
aacggcagagaaacccccaaa

SEQ ID NO: 14239 - DNA, 21 bp, Artificial Sequence
  Description of Artificial Sequence: Synthetic oligonucleotide
agcacccacaaaagcagcgtc

SEQ ID NO: 14240 - DNA, 21 bp, Artificial Sequence
  Description of Artificial Sequence: Synthetic oligonucleotide
gacaccggcagaacccccacc

SEQ ID NO: 14241 - DNA, 21 bp, Artificial Sequence
  Description of Artificial Sequence: Synthetic oligonucleotide
gatgctggtactaggagtctt

SEQ ID NO: 14242 - DNA, 21 bp, Artificial Sequence
  Description of Artificial Sequence: Synthetic oligonucleotide
gttagtggtcagcatcagaag

SEQ ID NO: 14243 - DNA, 21 bp, Artificial Sequence
  Description of Artificial Sequence: Synthetic oligonucleotide
agaaacggccaaagcgccgcc

SEQ ID NO: 14244 - DNA, 21 bp, Artificial Sequence
  Description of Artificial Sequence: Synthetic oligonucleotide
gggacgagtggtgatcgtgtt

SEQ ID NO: 14245 - DNA, 21 bp, Artificial Sequence
  Description of Artificial Sequence: Synthetic oligonucleotide
aaccacagcggcagccccagc

SEQ ID NO: 14246 - DNA, 21 bp, Artificial Sequence
  Description of Artificial Sequence: Synthetic oligonucleotide
ggcagcggccaaaaacaactc

SEQ ID NO: 14247 - DNA, 21 bp, Artificial Sequence
  Description of Artificial Sequence: Synthetic oligonucleotide
ggctacgccgacgcccacaaa

SEQ ID NO: 14248 - DNA, 21 bp, Artificial Sequence
  Description of Artificial Sequence: Synthetic oligonucleotide
aacggcaacagcaaccaccaa

SEQ ID NO: 14249 - DNA, 21 bp, Artificial Sequence
  Description of Artificial Sequence: Synthetic oligonucleotide
gctggtgagaaggggcgtaat

SEQ ID NO: 14250 - DNA, 21 bp, Artificial Sequence
  Description of Artificial Sequence: Synthetic oligonucleotide
cagcgtagtactacttctact

SEQ ID NO: 14251 - DNA, 21 bp, Artificial Sequence
  Description of Artificial Sequence: Synthetic oligonucleotide
ctcccccaaggcaccagaagc

SEQ ID NO: 14252 - DNA, 21 bp, Artificial Sequence
  Description of Artificial Sequence: Synthetic oligonucleotide
aatacgaatccgccgtctaag

SEQ ID NO: 14253 - DNA, 21 bp, Artificial Sequence
  Description of Artificial Sequence: Synthetic oligonucleotide
cagacttctaagtctagtgtt

SEQ ID NO: 14254 - DNA, 21 bp, Artificial Sequence
  Description of Artificial Sequence: Synthetic oligonucleotide
agtcagcataagccgtatacg

SEQ ID NO: 14255 - DNA, 21 bp, Artificial Sequence
  Description of Artificial Sequence: Synthetic oligonucleotide
gaaagcacccccagaaccgcc

SEQ ID NO: 14256 - DNA, 21 bp, Artificial Sequence
  Description of Artificial Sequence: Synthetic oligonucleotide
atgaatgataagtctaggaat

SEQ ID NO: 14257 - DNA, 21 bp, Artificial Sequence
  Description of Artificial Sequence: Synthetic oligonucleotide
tcgcctggtgttacgaatact

SEQ ID NO: 14258 - DNA, 21 bp, Artificial Sequence
  Description of Artificial Sequence: Synthetic oligonucleotide
gaccaactcaaaagcagcgcc

SEQ ID NO: 14259 - DNA, 21 bp, Artificial Sequence
  Description of Artificial Sequence: Synthetic oligonucleotide
gctgagagtgatcgtaagcat

SEQ ID NO: 14260 - DNA, 21 bp, Artificial Sequence
  Description of Artificial Sequence: Synthetic oligonucleotide
acgtcggttacgaagccggtt

SEQ ID NO: 14261 - DNA, 21 bp, Artificial Sequence
  Description of Artificial Sequence: Synthetic oligonucleotide
tctggttctccttctgcgcat

SEQ ID NO: 14262 - DNA, 21 bp, Artificial Sequence
  Description of Artificial Sequence: Synthetic oligonucleotide
gcgccgggtgggaatcatact

SEQ ID NO: 14263 - DNA, 21 bp, Artificial Sequence
  Description of Artificial Sequence: Synthetic oligonucleotide
gcgggtaattctgaggctaag

SEQ ID NO: 14264 - DNA, 21 bp, Artificial Sequence
  Description of Artificial Sequence: Synthetic oligonucleotide
ggcaccaccaccagcgtcaga

SEQ ID NO: 14265 - DNA, 21 bp, Artificial Sequence
  Description of Artificial Sequence: Synthetic oligonucleotide
agccaaaccccccccagcgcc

SEQ ID NO: 14266 - DNA, 21 bp, Artificial Sequence
  Description of Artificial Sequence: Synthetic oligonucleotide
ggtgctagtcagtcgctgtcg

SEQ ID NO: 14267 - DNA, 21 bp, Artificial Sequence
  Description of Artificial Sequence: Synthetic oligonucleotide
gccggcagcacccacgccgtc

SEQ ID NO: 14268 - DNA, 21 bp, Artificial Sequence
  Description of Artificial Sequence: Synthetic oligonucleotide
agcaccaaccccaccagaggc

SEQ ID NO: 14269 - DNA, 21 bp, Artificial Sequence
  Description of Artificial Sequence: Synthetic oligonucleotide
ggcagagacacccccagcaga

SEQ ID NO: 14270 - DNA, 21 bp, Artificial Sequence
  Description of Artificial Sequence: Synthetic oligonucleotide
gagtcgtcgagggatatgaag

SEQ ID NO: 14271 - DNA, 21 bp, Artificial Sequence
  Description of Artificial Sequence: Synthetic oligonucleotide
gccgccaacagcaaaaacctc

SEQ ID NO: 14272 - DNA, 21 bp, Artificial Sequence
  Description of Artificial Sequence: Synthetic oligonucleotide
cagacgggtgctcatactgcg

SEQ ID NO: 14273 - DNA, 21 bp, Artificial Sequence
  Description of Artificial Sequence: Synthetic oligonucleotide
tctaatgcgtctagtaattcg

SEQ ID NO: 14274 - DNA, 21 bp, Artificial Sequence
  Description of Artificial Sequence: Synthetic oligonucleotide
gtcagcagcagcaaagccacc

SEQ ID NO: 14275 - DNA, 21 bp, Artificial Sequence
  Description of Artificial Sequence: Synthetic oligonucleotide
gaaaaaaccaacgccatggtc

SEQ ID NO: 14276 - DNA, 21 bp, Artificial Sequence
  Description of Artificial Sequence: Synthetic oligonucleotide
gaaggcatgagcaccaccaga

SEQ ID NO: 14277 - DNA, 21 bp, Artificial Sequence
  Description of Artificial Sequence: Synthetic oligonucleotide
gatacgcgtgggacgcattct

SEQ ID NO: 14278 - DNA, 21 bp, Artificial Sequence
  Description of Artificial Sequence: Synthetic oligonucleotide
aatgagcaggctgctgctcgt

SEQ ID NO: 14279 - DNA, 21 bp, Artificial Sequence
  Description of Artificial Sequence: Synthetic oligonucleotide
accaaaagcggcgtcaaccaa

SEQ ID NO: 14280 - DNA, 21 bp, Artificial Sequence
  Description of Artificial Sequence: Synthetic oligonucleotide
accgaaaacgccagacccggc

SEQ ID NO: 14281 - DNA, 21 bp, Artificial Sequence
  Description of Artificial Sequence: Synthetic oligonucleotide
actactggtgctaagcctcat

SEQ ID NO: 14282 - DNA, 21 bp, Artificial Sequence
  Description of Artificial Sequence: Synthetic oligonucleotide
agcaacagcaaaggcgaaggc

SEQ ID NO: 14283 - DNA, 21 bp, Artificial Sequence
  Description of Artificial Sequence: Synthetic oligonucleotide
agcaccgccagaggcaacagc

SEQ ID NO: 14284 - DNA, 21 bp, Artificial Sequence
  Description of Artificial Sequence: Synthetic oligonucleotide
agccccgtcaccgccagccaa

SEQ ID NO: 14285 - DNA, 21 bp, Artificial Sequence
  Description of Artificial Sequence: Synthetic oligonucleotide
agcggcaacagccccatggtc

SEQ ID NO: 14286 - DNA, 21 bp, Artificial Sequence
  Description of Artificial Sequence: Synthetic oligonucleotide
agtaggaatgatgctaaggtg

SEQ ID NO: 14287 - DNA, 21 bp, Artificial Sequence
  Description of Artificial Sequence: Synthetic oligonucleotide
agtgggggtaatcatgggagt

SEQ ID NO: 14288 - DNA, 21 bp, Artificial Sequence
  Description of Artificial Sequence: Synthetic oligonucleotide
caaggcaccggcagcctcggc

SEQ ID NO: 14289 - DNA, 21 bp, Artificial Sequence
  Description of Artificial Sequence: Synthetic oligonucleotide
cacagcaccgcccaacaaaaa

SEQ ID NO: 14290 - DNA, 21 bp, Artificial Sequence
  Description of Artificial Sequence: Synthetic oligonucleotide
gaattcaaaagcaacaacgtc

SEQ ID NO: 14291 - DNA, 21 bp, Artificial Sequence
  Description of Artificial Sequence: Synthetic oligonucleotide
gatggtgagcggcctagtgtg

SEQ ID NO: 14292 - DNA, 21 bp, Artificial Sequence
  Description of Artificial Sequence: Synthetic oligonucleotide
gatggtgctaaggtgaataag

SEQ ID NO: 14293 - DNA, 21 bp, Artificial Sequence
  Description of Artificial Sequence: Synthetic oligonucleotide
gccggcaccaacaaaccccaa

SEQ ID NO: 14294 - DNA, 21 bp, Artificial Sequence
  Description of Artificial Sequence: Synthetic oligonucleotide
ggtactgttaagccgcagtct

SEQ ID NO: 14295 - DNA, 21 bp, Artificial Sequence
  Description of Artificial Sequence: Synthetic oligonucleotide
ggtatggctcataatagtggg

SEQ ID NO: 14296 - DNA, 21 bp, Artificial Sequence
  Description of Artificial Sequence: Synthetic oligonucleotide
ggtgggaatcatgagatgaag

SEQ ID NO: 14297 - DNA, 21 bp, Artificial Sequence
  Description of Artificial Sequence: Synthetic oligonucleotide
gtgacgaataagccgagtatg

SEQ ID NO: 14298 - DNA, 21 bp, Artificial Sequence
  Description of Artificial Sequence: Synthetic oligonucleotide
aacagcggcaacaccgtcaaa

SEQ ID NO: 14299 - DNA, 21 bp, Artificial Sequence
  Description of Artificial Sequence: Synthetic oligonucleotide
gacaacaaccccagaaccagc

SEQ ID NO: 14300 - DNA, 21 bp, Artificial Sequence
  Description of Artificial Sequence: Synthetic oligonucleotide
gaacccaccaccagaaacagc

SEQ ID NO: 14301 - DNA, 21 bp, Artificial Sequence
  Description of Artificial Sequence: Synthetic oligonucleotide
ggcagcgccagcggcaccgcc

SEQ ID NO: 14302 - DNA, 21 bp, Artificial Sequence
  Description of Artificial Sequence: Synthetic oligonucleotide
aatactagtcagacggggcgt

SEQ ID NO: 14303 - DNA, 21 bp, Artificial Sequence
  Description of Artificial Sequence: Synthetic oligonucleotide
agcagcaccaccagcaccaaa

SEQ ID NO: 14304 - DNA, 21 bp, Artificial Sequence
  Description of Artificial Sequence: Synthetic oligonucleotide
acggggcaggataagcctggg

SEQ ID NO: 14305 - DNA, 21 bp, Artificial Sequence
  Description of Artificial Sequence: Synthetic oligonucleotide
acggctgcgaggagtggtagt

SEQ ID NO: 14306 - DNA, 21 bp, Artificial Sequence
  Description of Artificial Sequence: Synthetic oligonucleotide
ggcgtccccagcaccggcggc

SEQ ID NO: 14307 - DNA, 21 bp, Artificial Sequence
  Description of Artificial Sequence: Synthetic oligonucleotide
gcgccgagttcgacgaagggg

SEQ ID NO: 14308 - DNA, 21 bp, Artificial Sequence
  Description of Artificial Sequence: Synthetic oligonucleotide
accaaaaacagccccacccaa

SEQ ID NO: 14309 - DNA, 21 bp, Artificial Sequence
  Description of Artificial Sequence: Synthetic oligonucleotide
cttgcgactactaagccttct

SEQ ID NO: 14310 - DNA, 21 bp, Artificial Sequence
  Description of Artificial Sequence: Synthetic oligonucleotide
gtgcgggagtcgtctaatact

SEQ ID NO: 14311 - DNA, 21 bp, Artificial Sequence
  Description of Artificial Sequence: Synthetic oligonucleotide
gacgtcagcaacaaaagcagc

SEQ ID NO: 14312 - DNA, 21 bp, Artificial Sequence
  Description of Artificial Sequence: Synthetic oligonucleotide
ggcaaaagcagccccgtcaaa

SEQ ID NO: 14313 - DNA, 21 bp, Artificial Sequence
  Description of Artificial Sequence: Synthetic oligonucleotide
cttcctgggaagactcatagt

SEQ ID NO: 14314 - DNA, 21 bp, Artificial Sequence
  Description of Artificial Sequence: Synthetic oligonucleotide
gctggggtgaagccggcgact

SEQ ID NO: 14315 - DNA, 21 bp, Artificial Sequence
  Description of Artificial Sequence: Synthetic oligonucleotide
ctcggcaacggccaaggccaa

SEQ ID NO: 14316 - DNA, 21 bp, Artificial Sequence
  Description of Artificial Sequence: Synthetic oligonucleotide
ctgcctactaataagtctctt

SEQ ID NO: 14317 - DNA, 21 bp, Artificial Sequence
  Description of Artificial Sequence: Synthetic oligonucleotide
ggttctgatggtaagttttcg

SEQ ID NO: 14318 - DNA, 21 bp, Artificial Sequence
  Description of Artificial Sequence: Synthetic oligonucleotide
caaagcggcgcccaacacagc

SEQ ID NO: 14319 - DNA, 21 bp, Artificial Sequence
  Description of Artificial Sequence: Synthetic oligonucleotide
ctcaccagcaccagcagcacc

SEQ ID NO: 14320 - DNA, 21 bp, Artificial Sequence
  Description of Artificial Sequence: Synthetic oligonucleotide
caggcgactaattcgggtggg

SEQ ID NO: 14321 - DNA, 21 bp, Artificial Sequence
  Description of Artificial Sequence: Synthetic oligonucleotide
ggtgcttcggttaagcctctg

SEQ ID NO: 14322 - DNA, 21 bp, Artificial Sequence
  Description of Artificial Sequence: Synthetic oligonucleotide
gacgtcaaagccaaaacccaa

SEQ ID NO: 14323 - DNA, 21 bp, Artificial Sequence
  Description of Artificial Sequence: Synthetic oligonucleotide
actgatggggcggcgcctaag

SEQ ID NO: 14324 - DNA, 21 bp, Artificial Sequence
  Description of Artificial Sequence: Synthetic oligonucleotide
gaccacaccaaaaaaagcagc

SEQ ID NO: 14325 - DNA, 21 bp, Artificial Sequence
  Description of Artificial Sequence: Synthetic oligonucleotide
agaagcggccaacaaatggtc

SEQ ID NO: 14326 - DNA, 21 bp, Artificial Sequence
  Description of Artificial Sequence: Synthetic oligonucleotide
gacgaaagcaccagaaacagc

SEQ ID NO: 14327 - DNA, 21 bp, Artificial Sequence
  Description of Artificial Sequence: Synthetic oligonucleotide
gattctagtgagaggattagg

SEQ ID NO: 14328 - DNA, 21 bp, Artificial Sequence
  Description of Artificial Sequence: Synthetic oligonucleotide
atgagaaacagcgccaccagc

SEQ ID NO: 14329 - DNA, 21 bp, Artificial Sequence
  Description of Artificial Sequence: Synthetic oligonucleotide
ggcgacgccgccgtcagcaga

SEQ ID NO: 14330 - DNA, 21 bp, Artificial Sequence
  Description of Artificial Sequence: Synthetic oligonucleotide
gatagtactaagcctgggagg

SEQ ID NO: 14331 - DNA, 21 bp, Artificial Sequence
  Description of Artificial Sequence: Synthetic oligonucleotide
ttcggcgacaacaccgtcaga

SEQ ID NO: 14332 - DNA, 21 bp, Artificial Sequence
  Description of Artificial Sequence: Synthetic oligonucleotide
atggataagagtgggtcgcat

SEQ ID NO: 14333 - DNA, 21 bp, Artificial Sequence
  Description of Artificial Sequence: Synthetic oligonucleotide
gacagaagagacagcagcagc

SEQ ID NO: 14334 - DNA, 21 bp, Artificial Sequence
  Description of Artificial Sequence: Synthetic oligonucleotide
ggcagaagcgacaaaagctac

SEQ ID NO: 14335 - DNA, 21 bp, Artificial Sequence
  Description of Artificial Sequence: Synthetic oligonucleotide
gccaccggcagcaaaaccgcc

SEQ ID NO: 14336 - DNA, 21 bp, Artificial Sequence
  Description of Artificial Sequence: Synthetic oligonucleotide
ggcagcagcgccaaacccacc

SEQ ID NO: 14337 - DNA, 21 bp, Artificial Sequence
  Description of Artificial Sequence: Synthetic oligonucleotide
accagaggcggcagcgccacc

SEQ ID NO: 14338 - DNA, 21 bp, Artificial Sequence
  Description of Artificial Sequence: Synthetic oligonucleotide
agcaccaccagcaaaagcacc

SEQ ID NO: 14339 - DNA, 21 bp, Artificial Sequence
  Description of Artificial Sequence: Synthetic oligonucleotide
agcaccgacaccagacccagc

SEQ ID NO: 14340 - DNA, 21 bp, Artificial Sequence
  Description of Artificial Sequence: Synthetic oligonucleotide
acgggtacggtgagtactagg

SEQ ID NO: 14341 - DNA, 21 bp, Artificial Sequence
  Description of Artificial Sequence: Synthetic oligonucleotide
ggtactcttaaggggggtgag

SEQ ID NO: 14342 - DNA, 21 bp, Artificial Sequence
  Description of Artificial Sequence: Synthetic oligonucleotide
ggtcagggtaagacttctcag

SEQ ID NO: 14343 - DNA, 21 bp, Artificial Sequence
  Description of Artificial Sequence: Synthetic oligonucleotide
ggcggcggcaacgtcggcaaa

SEQ ID NO: 14344 - DNA, 21 bp, Artificial Sequence
  Description of Artificial Sequence: Synthetic oligonucleotide
cacggcggcagcagcgtcaac

SEQ ID NO: 14345 - DNA, 21 bp, Artificial Sequence
  Description of Artificial Sequence: Synthetic oligonucleotide
accaaagccgacggcagcaga

SEQ ID NO: 14346 - DNA, 21 bp, Artificial Sequence
  Description of Artificial Sequence: Synthetic oligonucleotide
caccccagcaacgccccccac

SEQ ID NO: 14347 - DNA, 21 bp, Artificial Sequence
  Description of Artificial Sequence: Synthetic oligonucleotide
gtcaccgcccccagcaccaaa

SEQ ID NO: 14348 - DNA, 21 bp, Artificial Sequence
  Description of Artificial Sequence: Synthetic oligonucleotide
accagcggcaaaggcgccctc

SEQ ID NO: 14349 - DNA, 21 bp, Artificial Sequence
  Description of Artificial Sequence: Synthetic oligonucleotide
tctgtgtctgatcgtaatcat

SEQ ID NO: 14350 - DNA, 21 bp, Artificial Sequence
  Description of Artificial Sequence: Synthetic oligonucleotide
gtcgccgccaacgccaccaaa

SEQ ID NO: 14351 - DNA, 21 bp, Artificial Sequence
  Description of Artificial Sequence: Synthetic oligonucleotide
agcgtccaccaaaaaagcagc

SEQ ID NO: 14352 - DNA, 21 bp, Artificial Sequence
  Description of Artificial Sequence: Synthetic oligonucleotide
gaaggcgcccacagcaaagtc

SEQ ID NO: 14353 - DNA, 21 bp, Artificial Sequence
  Description of Artificial Sequence: Synthetic oligonucleotide
gagactacggcgcttagtaag

SEQ ID NO: 14354 - DNA, 21 bp, Artificial Sequence
  Description of Artificial Sequence: Synthetic oligonucleotide
cgtagtgaggcgcagcctaag

SEQ ID NO: 14355 - DNA, 21 bp, Artificial Sequence
  Description of Artificial Sequence: Synthetic oligonucleotide
acgaattcggctgcggcgaag

SEQ ID NO: 14356 - DNA, 21 bp, Artificial Sequence
  Description of Artificial Sequence: Synthetic oligonucleotide
actgctgctaagtctgctcag

SEQ ID NO: 14357 - DNA, 21 bp, Artificial Sequence
  Description of Artificial Sequence: Synthetic oligonucleotide
accggcgccggcgccagcctc

SEQ ID NO: 14358 - DNA, 21 bp, Artificial Sequence
  Description of Artificial Sequence: Synthetic oligonucleotide
gccggcaccgacaaaaccgcc

SEQ ID NO: 14359 - DNA, 21 bp, Artificial Sequence
  Description of Artificial Sequence: Synthetic oligonucleotide
ttgggttctcagacgagtacg

SEQ ID NO: 14360 - DNA, 21 bp, Artificial Sequence
  Description of Artificial Sequence: Synthetic oligonucleotide
caaggcagcaaaccccaaaac

SEQ ID NO: 14361 - DNA, 21 bp, Artificial Sequence
  Description of Artificial Sequence: Synthetic oligonucleotide
gagagggagagttcggcgacg

SEQ ID NO: 14362 - DNA, 21 bp, Artificial Sequence
  Description of Artificial Sequence: Synthetic oligonucleotide
ggtactaatactagggcgagt

SEQ ID NO: 14363 - DNA, 21 bp, Artificial Sequence
  Description of Artificial Sequence: Synthetic oligonucleotide
accaacgcccaaaaaatcaac

SEQ ID NO: 14364 - DNA, 21 bp, Artificial Sequence
  Description of Artificial Sequence: Synthetic oligonucleotide
aatcagcatcagtcgtctagt

SEQ ID NO: 14365 - DNA, 21 bp, Artificial Sequence
  Description of Artificial Sequence: Synthetic oligonucleotide
agcaccaccaacgccaaagtc

SEQ ID NO: 14366 - DNA, 21 bp, Artificial Sequence
  Description of Artificial Sequence: Synthetic oligonucleotide
ggcctcggcaaagccgccaac

SEQ ID NO: 14367 - DNA, 21 bp, Artificial Sequence
  Description of Artificial Sequence: Synthetic oligonucleotide
aataataagcctcagatggtt

SEQ ID NO: 14368 - DNA, 21 bp, Artificial Sequence
  Description of Artificial Sequence: Synthetic oligonucleotide
acccaccccaaacccaccgaa

SEQ ID NO: 14369 - DNA, 21 bp, Artificial Sequence
  Description of Artificial Sequence: Synthetic oligonucleotide
acgcatggtactcctctgtcg

SEQ ID NO: 14370 - DNA, 21 bp, Artificial Sequence
  Description of Artificial Sequence: Synthetic oligonucleotide
tcttctgggaatgggacgccg

SEQ ID NO: 14371 - DNA, 21 bp, Artificial Sequence
  Description of Artificial Sequence: Synthetic oligonucleotide
accaccagcaacaaacaagac

SEQ ID NO: 14372 - DNA, 21 bp, Artificial Sequence
  Description of Artificial Sequence: Synthetic oligonucleotide
atggggttggataagtcgctt

SEQ ID NO: 14373 - DNA, 21 bp, Artificial Sequence
  Description of Artificial Sequence: Synthetic oligonucleotide
aatattggtgctagtaattcg

SEQ ID NO: 14374 - DNA, 21 bp, Artificial Sequence
  Description of Artificial Sequence: Synthetic oligonucleotide
gggtctcagaagagtgcgagt

SEQ ID NO: 14375 - DNA, 21 bp, Artificial Sequence
  Description of Artificial Sequence: Synthetic oligonucleotide
gacggcctcagcggcacccac

SEQ ID NO: 14376 - DNA, 21 bp, Artificial Sequence
  Description of Artificial Sequence: Synthetic oligonucleotide
cagcgtgtgaaggacacgtct

SEQ ID NO: 14377 - DNA, 21 bp, Artificial Sequence
  Description of Artificial Sequence: Synthetic oligonucleotide
accctcagcgacagaaacagc

SEQ ID NO: 14378 - DNA, 21 bp, Artificial Sequence
  Description of Artificial Sequence: Synthetic oligonucleotide
actacgaatgcgccgcagggg

SEQ ID NO: 14379 - DNA, 21 bp, Artificial Sequence
  Description of Artificial Sequence: Synthetic oligonucleotide
gtcagaagcgacaaaacccaa

SEQ ID NO: 14380 - DNA, 21 bp, Artificial Sequence
  Description of Artificial Sequence: Synthetic oligonucleotide
acgaatattgcttcttcgaag

SEQ ID NO: 14381 - DNA, 21 bp, Artificial Sequence
  Description of Artificial Sequence: Synthetic oligonucleotide
agcagcaccagcagacccagc

SEQ ID NO: 14382 - DNA, 21 bp, Artificial Sequence
  Description of Artificial Sequence: Synthetic oligonucleotide
agtggggtggatagtcggact

SEQ ID NO: 14383 - DNA, 21 bp, Artificial Sequence
  Description of Artificial Sequence: Synthetic oligonucleotide
ctccaccaaagcagccccacc

SEQ ID NO: 14384 - DNA, 21 bp, Artificial Sequence
  Description of Artificial Sequence: Synthetic oligonucleotide
cttgggggtggtaagagtggt

SEQ ID NO: 14385 - DNA, 21 bp, Artificial Sequence
  Description of Artificial Sequence: Synthetic oligonucleotide
cttacttcggcgtcgccgtcg

SEQ ID NO: 14386 - DNA, 21 bp, Artificial Sequence
  Description of Artificial Sequence: Synthetic oligonucleotide
gaccccagcagccccggcgtc

SEQ ID NO: 14387 - DNA, 21 bp, Artificial Sequence
  Description of Artificial Sequence: Synthetic oligonucleotide
gaagtcaccaccccccacacc

SEQ ID NO: 14388 - DNA, 21 bp, Artificial Sequence
  Description of Artificial Sequence: Synthetic oligonucleotide
agcggcggcaccggcaacaga

SEQ ID NO: 14389 - DNA, 21 bp, Artificial Sequence
  Description of Artificial Sequence: Synthetic oligonucleotide
gggcggattgctgatgttaag

SEQ ID NO: 14390 - DNA, 21 bp, Artificial Sequence
  Description of Artificial Sequence: Synthetic oligonucleotide
cataataatgatacgcctcgt

SEQ ID NO: 14391 - DNA, 21 bp, Artificial Sequence
  Description of Artificial Sequence: Synthetic oligonucleotide
gcccaaaaaagcaccatcagc

SEQ ID NO: 14392 - DNA, 21 bp, Artificial Sequence
  Description of Artificial Sequence: Synthetic oligonucleotide
agagacggcaacagcagcagc

SEQ ID NO: 14393 - DNA, 21 bp, Artificial Sequence
  Description of Artificial Sequence: Synthetic oligonucleotide
cacggcggcaccagcgtcaaa

SEQ ID NO: 14394 - DNA, 21 bp, Artificial Sequence
  Description of Artificial Sequence: Synthetic oligonucleotide
aaccccgtcgccaacaacaaa

SEQ ID NO: 14395 - DNA, 21 bp, Artificial Sequence
  Description of Artificial Sequence: Synthetic oligonucleotide
gggactacgcttaagcctggg

SEQ ID NO: 14396 - DNA, 21 bp, Artificial Sequence
  Description of Artificial Sequence: Synthetic oligonucleotide
accagccaaccccccaacgcc

SEQ ID NO: 14397 - DNA, 21 bp, Artificial Sequence
  Description of Artificial Sequence: Synthetic oligonucleotide
agcatcggcaacgtcgccaaa

SEQ ID NO: 14398 - DNA, 21 bp, Artificial Sequence
  Description of Artificial Sequence: Synthetic oligonucleotide
gttggtggggttacttcgagt

SEQ ID NO: 14399 - DNA, 21 bp, Artificial Sequence
  Description of Artificial Sequence: Synthetic oligonucleotide
cggggtactacgagtacgtcg

SEQ ID NO: 14400 - DNA, 21 bp, Artificial Sequence
  Description of Artificial Sequence: Synthetic oligonucleotide
aacctcggcaaaagccccacc

SEQ ID NO: 14401 - DNA, 21 bp, Artificial Sequence
  Description of Artificial Sequence: Synthetic oligonucleotide
caacccggcggcaaaaacgtc

SEQ ID NO: 14402 - DNA, 21 bp, Artificial Sequence
  Description of Artificial Sequence: Synthetic oligonucleotide
aaaaccaccggcgcccaaagc

SEQ ID NO: 14403 - DNA, 21 bp, Artificial Sequence
  Description of Artificial Sequence: Synthetic oligonucleotide
gctggggttcctagtggtaat

SEQ ID NO: 14404 - DNA, 21 bp, Artificial Sequence
  Description of Artificial Sequence: Synthetic oligonucleotide
ggcagcacccaaagagccaac

SEQ ID NO: 14405 - DNA, 21 bp, Artificial Sequence
  Description of Artificial Sequence: Synthetic oligonucleotide
aattctgctcagcctccgaat

SEQ ID NO: 14406 - DNA, 21 bp, Artificial Sequence
  Description of Artificial Sequence: Synthetic oligonucleotide
tctacggggatgtcggggaag

SEQ ID NO: 14407 - DNA, 21 bp, Artificial Sequence
  Description of Artificial Sequence: Synthetic oligonucleotide
gaaggcagcaccagcaaaaga

SEQ ID NO: 14408 - DNA, 21 bp, Artificial Sequence
  Description of Artificial Sequence: Synthetic oligonucleotide
ggcaccgcccacaacagcggc

SEQ ID NO: 14409 - DNA, 21 bp, Artificial Sequence
  Description of Artificial Sequence: Synthetic oligonucleotide
agcgtccaaagaagcagcggc

SEQ ID NO: 14410 - DNA, 21 bp, Artificial Sequence
  Description of Artificial Sequence: Synthetic oligonucleotide
agtggggctcctgctaataag

SEQ ID NO: 14411 - DNA, 21 bp, Artificial Sequence
  Description of Artificial Sequence: Synthetic oligonucleotide
cagaatagttcgagggtggag

SEQ ID NO: 14412 - DNA, 21 bp, Artificial Sequence
  Description of Artificial Sequence: Synthetic oligonucleotide
ggtcgggatacgaagatgatg

SEQ ID NO: 14413 - DNA, 21 bp, Artificial Sequence
  Description of Artificial Sequence: Synthetic oligonucleotide
tctggtatttctgctcatacg

SEQ ID NO: 14414 - DNA, 21 bp, Artificial Sequence
  Description of Artificial Sequence: Synthetic oligonucleotide
aatctttcgcataagtcgggt

SEQ ID NO: 14415 - DNA, 21 bp, Artificial Sequence
  Description of Artificial Sequence: Synthetic oligonucleotide
tctgagacgcggtcgtcgact

SEQ ID NO: 14416 - DNA, 21 bp, Artificial Sequence
  Description of Artificial Sequence: Synthetic oligonucleotide
gggagggctgattctcagaag

SEQ ID NO: 14417 - DNA, 21 bp, Artificial Sequence
  Description of Artificial Sequence: Synthetic oligonucleotide
accagaagcagccccgccaac

SEQ ID NO: 14418 - DNA, 21 bp, Artificial Sequence
  Description of Artificial Sequence: Synthetic oligonucleotide
gatcctcagttgtctatgaag

SEQ ID NO: 14419 - DNA, 21 bp, Artificial Sequence
  Description of Artificial Sequence: Synthetic oligonucleotide
cgggggagtagtcagcagggg

SEQ ID NO: 14420 - DNA, 21 bp, Artificial Sequence
  Description of Artificial Sequence: Synthetic oligonucleotide
tctaatgcgaataagtcgtat

SEQ ID NO: 14421 - DNA, 21 bp, Artificial Sequence
  Description of Artificial Sequence: Synthetic oligonucleotide
cagggtactcgtcctagtgag

SEQ ID NO: 14422 - DNA, 21 bp, Artificial Sequence
  Description of Artificial Sequence: Synthetic oligonucleotide
tctggtggttcttctgtgaag

SEQ ID NO: 14423 - DNA, 21 bp, Artificial Sequence
  Description of Artificial Sequence: Synthetic oligonucleotide
ctcaccagcaaaggcagccaa

SEQ ID NO: 14424 - DNA, 21 bp, Artificial Sequence
  Description of Artificial Sequence: Synthetic oligonucleotide
agcggcgaaagaagcaacgaa

SEQ ID NO: 14425 - DNA, 21 bp, Artificial Sequence
  Description of Artificial Sequence: Synthetic oligonucleotide
atgcccggcagcaccagcggc

SEQ ID NO: 14426 - DNA, 21 bp, Artificial Sequence
  Description of Artificial Sequence: Synthetic oligonucleotide
gaggctcgtaataagcaggtg

SEQ ID NO: 14427 - DNA, 21 bp, Artificial Sequence
  Description of Artificial Sequence: Synthetic oligonucleotide
ttgtcgtctaagacgtcgaat

SEQ ID NO: 14428 - DNA, 21 bp, Artificial Sequence
  Description of Artificial Sequence: Synthetic oligonucleotide
agcggcaccaccaaacccagc

SEQ ID NO: 14429 - DNA, 21 bp, Artificial Sequence
  Description of Artificial Sequence: Synthetic oligonucleotide
atcgccaacaaaagccccgtc

SEQ ID NO: 14430 - DNA, 21 bp, Artificial Sequence
  Description of Artificial Sequence: Synthetic oligonucleotide
atggctaattcgcctaatcgt

SEQ ID NO: 14431 - DNA, 21 bp, Artificial Sequence
  Description of Artificial Sequence: Synthetic oligonucleotide
gatagtactcggggtagtggg

SEQ ID NO: 14432 - DNA, 21 bp, Artificial Sequence
  Description of Artificial Sequence: Synthetic oligonucleotide
ggccaaagccaaaccagccac

SEQ ID NO: 14433 - DNA, 21 bp, Artificial Sequence
  Description of Artificial Sequence: Synthetic oligonucleotide
aataattctacggtgggtcat

SEQ ID NO: 14434 - DNA, 21 bp, Artificial Sequence
  Description of Artificial Sequence: Synthetic oligonucleotide
accggcaacagacccaccgaa

SEQ ID NO: 14435 - DNA, 21 bp, Artificial Sequence
  Description of Artificial Sequence: Synthetic oligonucleotide
gccaccaacaaagtcgccacc

SEQ ID NO: 14436 - DNA, 21 bp, Artificial Sequence
  Description of Artificial Sequence: Synthetic oligonucleotide
gccaccggcaaagcccaagcc

SEQ ID NO: 14437 - DNA, 21 bp, Artificial Sequence
  Description of Artificial Sequence: Synthetic oligonucleotide
gaagtcagcggcaaacaactc

SEQ ID NO: 14438 - DNA, 21 bp, Artificial Sequence
  Description of Artificial Sequence: Synthetic oligonucleotide
gatcaggcggcgaataggcag

SEQ ID NO: 14439 - DNA, 21 bp, Artificial Sequence
  Description of Artificial Sequence: Synthetic oligonucleotide
gcgaatacgggggctgcgaag

SEQ ID NO: 14440 - DNA, 21 bp, Artificial Sequence
  Description of Artificial Sequence: Synthetic oligonucleotide
agcagcgacagcaacaacaga

SEQ ID NO: 14441 - DNA, 21 bp, Artificial Sequence
  Description of Artificial Sequence: Synthetic oligonucleotide
ggcaccaaaagcgtcggcagc

SEQ ID NO: 14442 - DNA, 21 bp, Artificial Sequence
  Description of Artificial Sequence: Synthetic oligonucleotide
tcgcctttgaattcttctaag

SEQ ID NO: 14443 - DNA, 21 bp, Artificial Sequence
  Description of Artificial Sequence: Synthetic oligonucleotide
accaaaggcggcagcaacacc

SEQ ID NO: 14444 - DNA, 21 bp, Artificial Sequence
  Description of Artificial Sequence: Synthetic oligonucleotide
gtcaacggcaccagaaacacc

SEQ ID NO: 14445 - DNA, 21 bp, Artificial Sequence
  Description of Artificial Sequence: Synthetic oligonucleotide
gtccccaacaaaagcagcagc

SEQ ID NO: 14446 - DNA, 21 bp, Artificial Sequence
  Description of Artificial Sequence: Synthetic oligonucleotide
aagtcggatgctaagggtaat

SEQ ID NO: 14447 - DNA, 21 bp, Artificial Sequence
  Description of Artificial Sequence: Synthetic oligonucleotide
ggcgaaggcagacccagcgtc

SEQ ID NO: 14448 - DNA, 21 bp, Artificial Sequence
  Description of Artificial Sequence: Synthetic oligonucleotide
gctacggagcggccttctact

SEQ ID NO: 14449 - DNA, 21 bp, Artificial Sequence
  Description of Artificial Sequence: Synthetic oligonucleotide
gccggcaccaccaccaacaaa

SEQ ID NO: 14450 - DNA, 21 bp, Artificial Sequence
  Description of Artificial Sequence: Synthetic oligonucleotide
gatactgtgcgggcggggtcg

SEQ ID NO: 14451 - DNA, 21 bp, Artificial Sequence
  Description of Artificial Sequence: Synthetic oligonucleotide
agccaacaaaaaaccggcatg

SEQ ID NO: 14452 - DNA, 21 bp, Artificial Sequence
  Description of Artificial Sequence: Synthetic oligonucleotide
caaagcgacaacaaaacccac

SEQ ID NO: 14453 - DNA, 21 bp, Artificial Sequence
  Description of Artificial Sequence: Synthetic oligonucleotide
aaaagcggcgaaagacccacc

SEQ ID NO: 14454 - DNA, 21 bp, Artificial Sequence
  Description of Artificial Sequence: Synthetic oligonucleotide
agccaaagcggcaccctcgcc

SEQ ID NO: 14455 - DNA, 21 bp, Artificial Sequence
  Description of Artificial Sequence: Synthetic oligonucleotide
agcggcagcgacagaaacagc

SEQ ID NO: 14456 - DNA, 21 bp, Artificial Sequence
  Description of Artificial Sequence: Synthetic oligonucleotide
agggaggatcgggctaaggag

SEQ ID NO: 14457 - DNA, 21 bp, Artificial Sequence
  Description of Artificial Sequence: Synthetic oligonucleotide
atgcccaacagcaacgccagc

SEQ ID NO: 14458 - DNA, 21 bp, Artificial Sequence
  Description of Artificial Sequence: Synthetic oligonucleotide
caaggcacccaaaccaaaagc

SEQ ID NO: 14459 - DNA, 21 bp, Artificial Sequence
  Description of Artificial Sequence: Synthetic oligonucleotide
caaggcgtcggcaacaccgcc

SEQ ID NO: 14460 - DNA, 21 bp, Artificial Sequence
  Description of Artificial Sequence: Synthetic oligonucleotide
gctggtcgtcaggggagtaat

SEQ ID NO: 14461 - DNA, 21 bp, Artificial Sequence
  Description of Artificial Sequence: Synthetic oligonucleotide
tctcctggtgagcgtgcgaag

SEQ ID NO: 14462 - DNA, 21 bp, Artificial Sequence
  Description of Artificial Sequence: Synthetic oligonucleotide
tctggtccttctaagcctgct

SEQ ID NO: 14463 - DNA, 21 bp, Artificial Sequence
  Description of Artificial Sequence: Synthetic oligonucleotide
tgcaccaacaccaaacccggc

SEQ ID NO: 14464 - DNA, 21 bp, Artificial Sequence
  Description of Artificial Sequence: Synthetic oligonucleotide
agtcctccgaatactgggtcg

SEQ ID NO: 14465 - DNA, 21 bp, Artificial Sequence
  Description of Artificial Sequence: Synthetic oligonucleotide
gacggccaaagagtcagcctc

SEQ ID NO: 14466 - DNA, 21 bp, Artificial Sequence
  Description of Artificial Sequence: Synthetic oligonucleotide
aatgatacgaagtctccgtcg

SEQ ID NO: 14467 - DNA, 21 bp, Artificial Sequence
  Description of Artificial Sequence: Synthetic oligonucleotide
agcaccgaaagccccaccaga

SEQ ID NO: 14468 - DNA, 21 bp, Artificial Sequence
  Description of Artificial Sequence: Synthetic oligonucleotide
aagacgagtccgagtacgagt

SEQ ID NO: 14469 - DNA, 21 bp, Artificial Sequence
  Description of Artificial Sequence: Synthetic oligonucleotide
ctcaacggcagcgaaaaaagc

SEQ ID NO: 14470 - DNA, 21 bp, Artificial Sequence
  Description of Artificial Sequence: Synthetic oligonucleotide
agcacccaaggcagcgtcaaa

SEQ ID NO: 14471 - DNA, 21 bp, Artificial Sequence
  Description of Artificial Sequence: Synthetic oligonucleotide
gccagcggcagcggcatgcac

SEQ ID NO: 14472 - DNA, 21 bp, Artificial Sequence
  Description of Artificial Sequence: Synthetic oligonucleotide
ggcggcgccagcagcaaagcc

SEQ ID NO: 14473 - DNA, 21 bp, Artificial Sequence
  Description of Artificial Sequence: Synthetic oligonucleotide
attccttcggataaggggact

SEQ ID NO: 14474 - DNA, 21 bp, Artificial Sequence
  Description of Artificial Sequence: Synthetic oligonucleotide
ggcgaaaaaagcaaaccccaa

SEQ ID NO: 14475 - DNA, 21 bp, Artificial Sequence
  Description of Artificial Sequence: Synthetic oligonucleotide
acgcaggatcgttcttcgact

SEQ ID NO: 14476 - DNA, 21 bp, Artificial Sequence
  Description of Artificial Sequence: Synthetic oligonucleotide
gccatcggcaaacaaggcacc

SEQ ID NO: 14477 - DNA, 21 bp, Artificial Sequence
  Description of Artificial Sequence: Synthetic oligonucleotide
agtactgggtcgggtatgtcg

SEQ ID NO: 14478 - DNA, 21 bp, Artificial Sequence
  Description of Artificial Sequence: Synthetic oligonucleotide
gccgacgtcagacccaacacc

SEQ ID NO: 14479 - DNA, 21 bp, Artificial Sequence
  Description of Artificial Sequence: Synthetic oligonucleotide
gccggcaaaggcaccagcagc

SEQ ID NO: 14480 - DNA, 21 bp, Artificial Sequence
  Description of Artificial Sequence: Synthetic oligonucleotide
gccatgggcaaaaccagcgcc

SEQ ID NO: 14481 - DNA, 21 bp, Artificial Sequence
  Description of Artificial Sequence: Synthetic oligonucleotide
aaaggcaacagcgccctcacc

SEQ ID NO: 14482 - DNA, 21 bp, Artificial Sequence
  Description of Artificial Sequence: Synthetic oligonucleotide
gagggtcagtctcagaagatg

SEQ ID NO: 14483 - DNA, 21 bp, Artificial Sequence
  Description of Artificial Sequence: Synthetic oligonucleotide
cacaccgtcaaagccagccaa

SEQ ID NO: 14484 - DNA, 21 bp, Artificial Sequence
  Description of Artificial Sequence: Synthetic oligonucleotide
aacggccccagaagcaccagc

SEQ ID NO: 14485 - DNA, 21 bp, Artificial Sequence
  Description of Artificial Sequence: Synthetic oligonucleotide
gtcaacagcaaacccgcccaa

SEQ ID NO: 14486 - DNA, 21 bp, Artificial Sequence
  Description of Artificial Sequence: Synthetic oligonucleotide
catggtgagtctcggacttct

SEQ ID NO: 14487 - DNA, 21 bp, Artificial Sequence
  Description of Artificial Sequence: Synthetic oligonucleotide
gggaggaataatactaattcg

SEQ ID NO: 14488 - DNA, 21 bp, Artificial Sequence
  Description of Artificial Sequence: Synthetic oligonucleotide
actactaatactaaggttcag

SEQ ID NO: 14489 - DNA, 21 bp, Artificial Sequence
  Description of Artificial Sequence: Synthetic oligonucleotide
agcggcaccgccaccagagac

SEQ ID NO: 14490 - DNA, 21 bp, Artificial Sequence
  Description of Artificial Sequence: Synthetic oligonucleotide
gagcctactcagtctaggtct

SEQ ID NO: 14491 - DNA, 21 bp, Artificial Sequence
  Description of Artificial Sequence: Synthetic oligonucleotide
ggcctcgccagcaaaaacagc

SEQ ID NO: 14492 - DNA, 21 bp, Artificial Sequence
  Description of Artificial Sequence: Synthetic oligonucleotide
tggggcaccgacaaaatgaga

SEQ ID NO: 14493 - DNA, 21 bp, Artificial Sequence
  Description of Artificial Sequence: Synthetic oligonucleotide
cggggtgggcagaattctgtg

SEQ ID NO: 14494 - DNA, 21 bp, Artificial Sequence
  Description of Artificial Sequence: Synthetic oligonucleotide
ggcaccaccaacagcagcaga

SEQ ID NO: 14495 - DNA, 21 bp, Artificial Sequence
  Description of Artificial Sequence: Synthetic oligonucleotide
accgccaacacccaccccacc

SEQ ID NO: 14496 - DNA, 21 bp, Artificial Sequence
  Description of Artificial Sequence: Synthetic oligonucleotide
caaaccgccaacagcagccaa

SEQ ID NO: 14497 - DNA, 21 bp, Artificial Sequence
  Description of Artificial Sequence: Synthetic oligonucleotide
accaccagcagccacagcctc

SEQ ID NO: 14498 - DNA, 21 bp, Artificial Sequence
  Description of Artificial Sequence: Synthetic oligonucleotide
accgccgacaacagaaccgcc

SEQ ID NO: 14499 - DNA, 21 bp, Artificial Sequence
  Description of Artificial Sequence: Synthetic oligonucleotide
gagacgcggacgggtacggtg

SEQ ID NO: 14500 - DNA, 21 bp, Artificial Sequence
  Description of Artificial Sequence: Synthetic oligonucleotide
acccaaggccaaaaagccacc

SEQ ID NO: 14501 - DNA, 21 bp, Artificial Sequence
  Description of Artificial Sequence: Synthetic oligonucleotide
gaaagaaaaaccggcaacggc

SEQ ID NO: 14502 - DNA, 21 bp, Artificial Sequence
  Description of Artificial Sequence: Synthetic oligonucleotide
ggggataagtcgtctcgtgag

SEQ ID NO: 14503 - DNA, 21 bp, Artificial Sequence
  Description of Artificial Sequence: Synthetic oligonucleotide
aacaacagcgacagaagagac

SEQ ID NO: 14504 - DNA, 21 bp, Artificial Sequence
  Description of Artificial Sequence: Synthetic oligonucleotide
gcgcctggtgcgcatcagtcg

SEQ ID NO: 14505 - DNA, 21 bp, Artificial Sequence
  Description of Artificial Sequence: Synthetic oligonucleotide
cacagccaaggcaaaaacgtc

SEQ ID NO: 14506 - DNA, 21 bp, Artificial Sequence
  Description of Artificial Sequence: Synthetic oligonucleotide
agccaaaccagcaaccacatc

SEQ ID NO: 14507 - DNA, 21 bp, Artificial Sequence
  Description of Artificial Sequence: Synthetic oligonucleotide
ctcggcgaaaaaagccacagc

SEQ ID NO: 14508 - DNA, 21 bp, Artificial Sequence
  Description of Artificial Sequence: Synthetic oligonucleotide
gtgggtgatcggccggcgatt

SEQ ID NO: 14509 - DNA, 21 bp, Artificial Sequence
  Description of Artificial Sequence: Synthetic oligonucleotide
agtaattcgcaggttgctagt

SEQ ID NO: 14510 - DNA, 21 bp, Artificial Sequence
  Description of Artificial Sequence: Synthetic oligonucleotide
gcttctgtgccttctagtggt

SEQ ID NO: 14511 - DNA, 21 bp, Artificial Sequence
  Description of Artificial Sequence: Synthetic oligonucleotide
tctagggatggtaaggttgtt

SEQ ID NO: 14512 - DNA, 21 bp, Artificial Sequence
  Description of Artificial Sequence: Synthetic oligonucleotide
ggtactgggaagcatgctgcg

SEQ ID NO: 14513 - DNA, 21 bp, Artificial Sequence
  Description of Artificial Sequence: Synthetic oligonucleotide
agaggcgccggcaacagcaac

SEQ ID NO: 14514 - DNA, 21 bp, Artificial Sequence
  Description of Artificial Sequence: Synthetic oligonucleotide
acgaatgtgacgaagtcgtct

SEQ ID NO: 14515 - DNA, 21 bp, Artificial Sequence
  Description of Artificial Sequence: Synthetic oligonucleotide
agtagtgctgatcgtaattcg

SEQ ID NO: 14516 - DNA, 21 bp, Artificial Sequence
  Description of Artificial Sequence: Synthetic oligonucleotide
aacagcggcaccggcagcaga

SEQ ID NO: 14517 - DNA, 21 bp, Artificial Sequence
  Description of Artificial Sequence: Synthetic oligonucleotide
agcggcagcagacccagcgtc

SEQ ID NO: 14518 - DNA, 21 bp, Artificial Sequence
  Description of Artificial Sequence: Synthetic oligonucleotide
atgggggatcgttctcagggt

SEQ ID NO: 14519 - DNA, 21 bp, Artificial Sequence
  Description of Artificial Sequence: Synthetic oligonucleotide
gggcataataaggctgtgggt

SEQ ID NO: 14520 - DNA, 21 bp, Artificial Sequence
  Description of Artificial Sequence: Synthetic oligonucleotide
tcgtctcagaagcctggtggg

SEQ ID NO: 14521 - DNA, 21 bp, Artificial Sequence
  Description of Artificial Sequence: Synthetic oligonucleotide
agcggcagccccgccaacaga

SEQ ID NO: 14522 - DNA, 21 bp, Artificial Sequence
  Description of Artificial Sequence: Synthetic oligonucleotide
atgggcagcggcaccgccacc

SEQ ID NO: 14523 - DNA, 21 bp, Artificial Sequence
  Description of Artificial Sequence: Synthetic oligonucleotide
attgggggtgggccttcttca

SEQ ID NO: 14524 - DNA, 21 bp, Artificial Sequence
  Description of Artificial Sequence: Synthetic oligonucleotide
aatgttaggacgcctacgtcg

SEQ ID NO: 14525 - DNA, 21 bp, Artificial Sequence
  Description of Artificial Sequence: Synthetic oligonucleotide
tctggggagagtcagcataag

SEQ ID NO: 14526 - DNA, 21 bp, Artificial Sequence
  Description of Artificial Sequence: Synthetic oligonucleotide
caagtcagccccagcacccaa

SEQ ID NO: 14527 - DNA, 21 bp, Artificial Sequence
  Description of Artificial Sequence: Synthetic oligonucleotide
gccagccacaaacccatcacc

SEQ ID NO: 14528 - DNA, 21 bp, Artificial Sequence
  Description of Artificial Sequence: Synthetic oligonucleotide
gccagcgtccccagcaaagcc

SEQ ID NO: 14529 - DNA, 21 bp, Artificial Sequence
  Description of Artificial Sequence: Synthetic oligonucleotide
aacacccaaagcaacagcaga

SEQ ID NO: 14530 - DNA, 21 bp, Artificial Sequence
  Description of Artificial Sequence: Synthetic oligonucleotide
gttacgggtacgacgcagggg

SEQ ID NO: 14531 - DNA, 21 bp, Artificial Sequence
  Description of Artificial Sequence: Synthetic oligonucleotide
acggggacgactgggcatagt

SEQ ID NO: 14532 - DNA, 21 bp, Artificial Sequence
  Description of Artificial Sequence: Synthetic oligonucleotide
agcagaagccccagccaaagc

SEQ ID NO: 14533 - DNA, 21 bp, Artificial Sequence
  Description of Artificial Sequence: Synthetic oligonucleotide
ggcgacatgcaaggcggcaaa

SEQ ID NO: 14534 - DNA, 21 bp, Artificial Sequence
  Description of Artificial Sequence: Synthetic oligonucleotide
accaaagacaccagacccatc

SEQ ID NO: 14535 - DNA, 21 bp, Artificial Sequence
  Description of Artificial Sequence: Synthetic oligonucleotide
cagaatactaggtctattgcg

SEQ ID NO: 14536 - DNA, 21 bp, Artificial Sequence
  Description of Artificial Sequence: Synthetic oligonucleotide
cagagtgctgcgtctactaag

SEQ ID NO: 14537 - DNA, 21 bp, Artificial Sequence
  Description of Artificial Sequence: Synthetic oligonucleotide
agaaacgacagcaaaagccac

SEQ ID NO: 14538 - DNA, 21 bp, Artificial Sequence
  Description of Artificial Sequence: Synthetic oligonucleotide
agtacgcctcaggggtctggt

SEQ ID NO: 14539 - DNA, 21 bp, Artificial Sequence
  Description of Artificial Sequence: Synthetic oligonucleotide
gctactgctagtaaggttacg

SEQ ID NO: 14540 - DNA, 21 bp, Artificial Sequence
  Description of Artificial Sequence: Synthetic oligonucleotide
gaagccgtcgcccccaacaaa

SEQ ID NO: 14541 - DNA, 21 bp, Artificial Sequence
  Description of Artificial Sequence: Synthetic oligonucleotide
gtggattcttctaggacttcg

SEQ ID NO: 14542 - DNA, 21 bp, Artificial Sequence
  Description of Artificial Sequence: Synthetic oligonucleotide
ggcaacagcgccggcagcaaa

SEQ ID NO: 14543 - DNA, 21 bp, Artificial Sequence
  Description of Artificial Sequence: Synthetic oligonucleotide
aatcggggggagaagcctggt

SEQ ID NO: 14544 - DNA, 21 bp, Artificial Sequence
  Description of Artificial Sequence: Synthetic oligonucleotide
agtgtgttgaataaggggggt

SEQ ID NO: 14545 - DNA, 21 bp, Artificial Sequence
  Description of Artificial Sequence: Synthetic oligonucleotide
cagaataatactgcgactcag

SEQ ID NO: 14546 - DNA, 21 bp, Artificial Sequence
  Description of Artificial Sequence: Synthetic oligonucleotide
caggagaatgctgcgaacaag

SEQ ID NO: 14547 - DNA, 21 bp, Artificial Sequence
  Description of Artificial Sequence: Synthetic oligonucleotide
gctagtgtgtcgaggagttcg

SEQ ID NO: 14548 - DNA, 21 bp, Artificial Sequence
  Description of Artificial Sequence: Synthetic oligonucleotide
ggcgccggcgtcaaaaacctc

SEQ ID NO: 14549 - DNA, 21 bp, Artificial Sequence
  Description of Artificial Sequence: Synthetic oligonucleotide
agaggcgacagcaacaaactc

SEQ ID NO: 14550 - DNA, 21 bp, Artificial Sequence
  Description of Artificial Sequence: Synthetic oligonucleotide
agtagtaatagtgcggtgcgg

SEQ ID NO: 14551 - DNA, 21 bp, Artificial Sequence
  Description of Artificial Sequence: Synthetic oligonucleotide
tctcagtcgggtcagggtact

SEQ ID NO: 14552 - DNA, 21 bp, Artificial Sequence
  Description of Artificial Sequence: Synthetic oligonucleotide
agtgtggataggactcagggg

SEQ ID NO: 14553 - DNA, 21 bp, Artificial Sequence
  Description of Artificial Sequence: Synthetic oligonucleotide
attggttctagtactaatgcg

SEQ ID NO: 14554 - DNA, 21 bp, Artificial Sequence
  Description of Artificial Sequence: Synthetic oligonucleotide
gagaataataagtctcagatg

SEQ ID NO: 14555 - DNA, 21 bp, Artificial Sequence
  Description of Artificial Sequence: Synthetic oligonucleotide
gggggttctaagtctgcgtcg

SEQ ID NO: 14556 - DNA, 21 bp, Artificial Sequence
  Description of Artificial Sequence: Synthetic oligonucleotide
ctcggcacccaaccccccgtc

SEQ ID NO: 14557 - DNA, 21 bp, Artificial Sequence
  Description of Artificial Sequence: Synthetic oligonucleotide
agtttgcataagccgacgtct

SEQ ID NO: 14558 - DNA, 21 bp, Artificial Sequence
  Description of Artificial Sequence: Synthetic oligonucleotide
gggaagcagacttctgtgggt

SEQ ID NO: 14559 - DNA, 21 bp, Artificial Sequence
  Description of Artificial Sequence: Synthetic oligonucleotide
aggggtcagactacgcctggg

SEQ ID NO: 14560 - DNA, 21 bp, Artificial Sequence
  Description of Artificial Sequence: Synthetic oligonucleotide
agtacgggggagaatcggggg

SEQ ID NO: 14561 - DNA, 21 bp, Artificial Sequence
  Description of Artificial Sequence: Synthetic oligonucleotide
agcgccggcaaaagcaccacc

SEQ ID NO: 14562 - DNA, 21 bp, Artificial Sequence
  Description of Artificial Sequence: Synthetic oligonucleotide
agcggcggcaccgccatggtc

SEQ ID NO: 14563 - DNA, 21 bp, Artificial Sequence
  Description of Artificial Sequence: Synthetic oligonucleotide
caccacaacgcccccgcccaa

SEQ ID NO: 14564 - DNA, 21 bp, Artificial Sequence
  Description of Artificial Sequence: Synthetic oligonucleotide
acttcgggttctgataggctg

SEQ ID NO: 14565 - DNA, 21 bp, Artificial Sequence
  Description of Artificial Sequence: Synthetic oligonucleotide
agacccgacaaacaaagcatc

SEQ ID NO: 14566 - DNA, 21 bp, Artificial Sequence
  Description of Artificial Sequence: Synthetic oligonucleotide
aacaccacccaaaaaggcggc

SEQ ID NO: 14567 - DNA, 21 bp, Artificial Sequence
  Description of Artificial Sequence: Synthetic oligonucleotide
actcagatttctacgactggt

SEQ ID NO: 14568 - DNA, 21 bp, Artificial Sequence
  Description of Artificial Sequence: Synthetic oligonucleotide
atccccagcaaacccgccaac

SEQ ID NO: 14569 - DNA, 21 bp, Artificial Sequence
  Description of Artificial Sequence: Synthetic oligonucleotide
gacggcaacaaagtcctcggc

SEQ ID NO: 14570 - DNA, 21 bp, Artificial Sequence
  Description of Artificial Sequence: Synthetic oligonucleotide
gcccccggccaaaaacccctc

SEQ ID NO: 14571 - DNA, 21 bp, Artificial Sequence
  Description of Artificial Sequence: Synthetic oligonucleotide
taccaagccgccgacaccaaa

SEQ ID NO: 14572 - DNA, 21 bp, Artificial Sequence
  Description of Artificial Sequence: Synthetic oligonucleotide
ggtgagggtagtaagtcgcgg

SEQ ID NO: 14573 - DNA, 21 bp, Artificial Sequence
  Description of Artificial Sequence: Synthetic oligonucleotide
gacgccaaagtcaacggcaga

SEQ ID NO: 14574 - DNA, 21 bp, Artificial Sequence
  Description of Artificial Sequence: Synthetic oligonucleotide
gatggtgctaataggagtagt

SEQ ID NO: 14575 - DNA, 21 bp, Artificial Sequence
  Description of Artificial Sequence: Synthetic oligonucleotide
tcttcgcagcagggtcctgcg

SEQ ID NO: 14576 - DNA, 21 bp, Artificial Sequence
  Description of Artificial Sequence: Synthetic oligonucleotide
caaagaagcaaagacagcgcc

SEQ ID NO: 14577 - DNA, 21 bp, Artificial Sequence
  Description of Artificial Sequence: Synthetic oligonucleotide
aatcgggttacgaagtctgag

SEQ ID NO: 14578 - DNA, 21 bp, Artificial Sequence
  Description of Artificial Sequence: Synthetic oligonucleotide
gatcagcgtggtagtgtttcg

SEQ ID NO: 14579 - DNA, 21 bp, Artificial Sequence
  Description of Artificial Sequence: Synthetic oligonucleotide
ggtcaggttccgaagactggg

SEQ ID NO: 14580 - DNA, 21 bp, Artificial Sequence
  Description of Artificial Sequence: Synthetic oligonucleotide
tcgggtagttctaagggtcat

SEQ ID NO: 14581 - DNA, 21 bp, Artificial Sequence
  Description of Artificial Sequence: Synthetic oligonucleotide
ctgcagcagaagtctcatggg

SEQ ID NO: 14582 - DNA, 21 bp, Artificial Sequence
  Description of Artificial Sequence: Synthetic oligonucleotide
gacagcggcgccaacagagtc

SEQ ID NO: 14583 - DNA, 21 bp, Artificial Sequence
  Description of Artificial Sequence: Synthetic oligonucleotide
gcgcagggtaataaggcgcat

SEQ ID NO: 14584 - DNA, 21 bp, Artificial Sequence
  Description of Artificial Sequence: Synthetic oligonucleotide
gctagtgataataagccttct

SEQ ID NO: 14585 - DNA, 21 bp, Artificial Sequence
  Description of Artificial Sequence: Synthetic oligonucleotide
tctcaggcgcatagttcggcg

SEQ ID NO: 14586 - DNA, 21 bp, Artificial Sequence
  Description of Artificial Sequence: Synthetic oligonucleotide
aattcgtcgaagactagttcg

SEQ ID NO: 14587 - DNA, 21 bp, Artificial Sequence
  Description of Artificial Sequence: Synthetic oligonucleotide
acttctgagggtacgcatagg

SEQ ID NO: 14588 - DNA, 21 bp, Artificial Sequence
  Description of Artificial Sequence: Synthetic oligonucleotide
gatgggcctaagcctgggtct

SEQ ID NO: 14589 - DNA, 21 bp, Artificial Sequence
  Description of Artificial Sequence: Synthetic oligonucleotide
gggaggtctcagacgtctgtg

SEQ ID NO: 14590 - DNA, 21 bp, Artificial Sequence
  Description of Artificial Sequence: Synthetic oligonucleotide
acccaagaaggcaaacaaagc

SEQ ID NO: 14591 - DNA, 21 bp, Artificial Sequence
  Description of Artificial Sequence: Synthetic oligonucleotide
gaactcagcagccccagaaac

SEQ ID NO: 14592 - DNA, 21 bp, Artificial Sequence
  Description of Artificial Sequence: Synthetic oligonucleotide
gccagcagcagcaaaaccagc

SEQ ID NO: 14593 - DNA, 21 bp, Artificial Sequence
  Description of Artificial Sequence: Synthetic oligonucleotide
gcgggtactacgaagaatagt

SEQ ID NO: 14594 - DNA, 21 bp, Artificial Sequence
  Description of Artificial Sequence: Synthetic oligonucleotide
ggcgtcgccaaagtcggcggc

SEQ ID NO: 14595 - DNA, 21 bp, Artificial Sequence
  Description of Artificial Sequence: Synthetic oligonucleotide
agtacgaatactaaggctttg

SEQ ID NO: 14596 - DNA, 21 bp, Artificial Sequence
  Description of Artificial Sequence: Synthetic oligonucleotide
gagcatacggggaagcagatg

SEQ ID NO: 14597 - DNA, 21 bp, Artificial Sequence
  Description of Artificial Sequence: Synthetic oligonucleotide
caaaccggcagcaacaacaaa

SEQ ID NO: 14598 - DNA, 21 bp, Artificial Sequence
  Description of Artificial Sequence: Synthetic oligonucleotide
ctccaaaacaaaagcagcctc

SEQ ID NO: 14599 - DNA, 21 bp, Artificial Sequence
  Description of Artificial Sequence: Synthetic oligonucleotide
tctccttcgacgaatgggcgt

SEQ ID NO: 14600 - DNA, 21 bp, Artificial Sequence
  Description of Artificial Sequence: Synthetic oligonucleotide
aattcggtgcctgggagtact

SEQ ID NO: 14601 - DNA, 21 bp, Artificial Sequence
  Description of Artificial Sequence: Synthetic oligonucleotide
accaccgtcaaacccaacctc

SEQ ID NO: 14602 - DNA, 21 bp, Artificial Sequence
  Description of Artificial Sequence: Synthetic oligonucleotide
ggcgacacccccagcagaaaa

SEQ ID NO: 14603 - DNA, 21 bp, Artificial Sequence
  Description of Artificial Sequence: Synthetic oligonucleotide
accaccaccaaagccagcgcc

SEQ ID NO: 14604 - DNA, 21 bp, Artificial Sequence
  Description of Artificial Sequence: Synthetic oligonucleotide
gctggtatgggtaaggcttct

SEQ ID NO: 14605 - DNA, 21 bp, Artificial Sequence
  Description of Artificial Sequence: Synthetic oligonucleotide
ctgtctgggcagtctagtact

SEQ ID NO: 14606 - DNA, 21 bp, Artificial Sequence
  Description of Artificial Sequence: Synthetic oligonucleotide
aggggttcgagtagttcgacg

SEQ ID NO: 14607 - DNA, 21 bp, Artificial Sequence
  Description of Artificial Sequence: Synthetic oligonucleotide
tcgggttcgaaggctctggag

SEQ ID NO: 14608 - DNA, 21 bp, Artificial Sequence
  Description of Artificial Sequence: Synthetic oligonucleotide
ggccccagcaccaaaagcctc

SEQ ID NO: 14609 - DNA, 21 bp, Artificial Sequence
  Description of Artificial Sequence: Synthetic oligonucleotide
ggcaccagcaccgccctcaaa

SEQ ID NO: 14610 - DNA, 21 bp, Artificial Sequence
  Description of Artificial Sequence: Synthetic oligonucleotide
ctccccagcaccaacggcagc

SEQ ID NO: 14611 - DNA, 21 bp, Artificial Sequence
  Description of Artificial Sequence: Synthetic oligonucleotide
aataggcaggataagccgagt

SEQ ID NO: 14612 - DNA, 21 bp, Artificial Sequence
  Description of Artificial Sequence: Synthetic oligonucleotide
agaagcggcgaaagacccagc

SEQ ID NO: 14613 - DNA, 21 bp, Artificial Sequence
  Description of Artificial Sequence: Synthetic oligonucleotide
gctcagcatcctaagcagcag

SEQ ID NO: 14614 - DNA, 21 bp, Artificial Sequence
  Description of Artificial Sequence: Synthetic oligonucleotide
ggcagcgacagaaacagcggc

SEQ ID NO: 14615 - DNA, 21 bp, Artificial Sequence
  Description of Artificial Sequence: Synthetic oligonucleotide
tcgcagactgctgctcctacg

SEQ ID NO: 14616 - DNA, 21 bp, Artificial Sequence
  Description of Artificial Sequence: Synthetic oligonucleotide
agcgtcagcgacagaaacaaa

SEQ ID NO: 14617 - DNA, 21 bp, Artificial Sequence
  Description of Artificial Sequence: Synthetic oligonucleotide
gggccgacgcagaaggctaat

SEQ ID NO: 14618 - DNA, 21 bp, Artificial Sequence
  Description of Artificial Sequence: Synthetic oligonucleotide
ggtggggcgtcttcgaatacg

SEQ ID NO: 14619 - DNA, 21 bp, Artificial Sequence
  Description of Artificial Sequence: Synthetic oligonucleotide
agcagcaaagccaaaagcgac

SEQ ID NO: 14620 - DNA, 21 bp, Artificial Sequence
  Description of Artificial Sequence: Synthetic oligonucleotide
tctactaatagggcgacgggt

SEQ ID NO: 14621 - DNA, 21 bp, Artificial Sequence
  Description of Artificial Sequence: Synthetic oligonucleotide
aggacggggactggggctact

SEQ ID NO: 14622 - DNA, 21 bp, Artificial Sequence
  Description of Artificial Sequence: Synthetic oligonucleotide
agaagcagcacccccacccaa

SEQ ID NO: 14623 - DNA, 21 bp, Artificial Sequence
  Description of Artificial Sequence: Synthetic oligonucleotide
agcaccgccagcaaacaagcc

SEQ ID NO: 14624 - DNA, 21 bp, Artificial Sequence
  Description of Artificial Sequence: Synthetic oligonucleotide
actggtgctggtcctaatctg

SEQ ID NO: 14625 - DNA, 21 bp, Artificial Sequence
  Description of Artificial Sequence: Synthetic oligonucleotide
gccagcaccagccccgccacc

SEQ ID NO: 14626 - DNA, 21 bp, Artificial Sequence
  Description of Artificial Sequence: Synthetic oligonucleotide
gttccgagttcttcgcctaag

SEQ ID NO: 14627 - DNA, 21 bp, Artificial Sequence
  Description of Artificial Sequence: Synthetic oligonucleotide
gtccccaccagcaaagccgtc

SEQ ID NO: 14628 - DNA, 21 bp, Artificial Sequence
  Description of Artificial Sequence: Synthetic oligonucleotide
aaaggcgccagcaacgtcagc

SEQ ID NO: 14629 - DNA, 21 bp, Artificial Sequence
  Description of Artificial Sequence: Synthetic oligonucleotide
aatggtgctgataagcagcgg

SEQ ID NO: 14630 - DNA, 21 bp, Artificial Sequence
  Description of Artificial Sequence: Synthetic oligonucleotide
acccaaagccaaagagccagc

SEQ ID NO: 14631 - DNA, 21 bp, Artificial Sequence
  Description of Artificial Sequence: Synthetic oligonucleotide
acccacggcgcccccaacgcc

SEQ ID NO: 14632 - DNA, 21 bp, Artificial Sequence
  Description of Artificial Sequence: Synthetic oligonucleotide
agaaccggcgacagcggcggc

SEQ ID NO: 14633 - DNA, 21 bp, Artificial Sequence
  Description of Artificial Sequence: Synthetic oligonucleotide
agaggcgaaagcaaattcacc

SEQ ID NO: 14634 - DNA, 21 bp, Artificial Sequence
  Description of Artificial Sequence: Synthetic oligonucleotide
agtcagaattctaagcaggtt

SEQ ID NO: 14635 - DNA, 21 bp, Artificial Sequence
  Description of Artificial Sequence: Synthetic oligonucleotide
atgcctgggaagacgtctagt

SEQ ID NO: 14636 - DNA, 21 bp, Artificial Sequence
  Description of Artificial Sequence: Synthetic oligonucleotide
atggcgtctaaggataatcgg

SEQ ID NO: 14637 - DNA, 21 bp, Artificial Sequence
  Description of Artificial Sequence: Synthetic oligonucleotide
ctcaccgaaaaaagcagcaaa

SEQ ID NO: 14638 - DNA, 21 bp, Artificial Sequence
  Description of Artificial Sequence: Synthetic oligonucleotide
gacagcggcaaaagcagcaga

SEQ ID NO: 14639 - DNA, 21 bp, Artificial Sequence
  Description of Artificial Sequence: Synthetic oligonucleotide
gacggcagcaacggccacaga

SEQ ID NO: 14640 - DNA, 21 bp, Artificial Sequence
  Description of Artificial Sequence: Synthetic oligonucleotide
gcgggtgttagggatatgact

SEQ ID NO: 14641 - DNA, 21 bp, Artificial Sequence
  Description of Artificial Sequence: Synthetic oligonucleotide
ggtctgccgaatggtcagaag

SEQ ID NO: 14642 - DNA, 21 bp, Artificial Sequence
  Description of Artificial Sequence: Synthetic oligonucleotide
gtcggcagcagagaccaagtc

SEQ ID NO: 14643 - DNA, 21 bp, Artificial Sequence
  Description of Artificial Sequence: Synthetic oligonucleotide
gtttcgaagcctgcgatggtg

SEQ ID NO: 14644 - DNA, 21 bp, Artificial Sequence
  Description of Artificial Sequence: Synthetic oligonucleotide
gtttctacggctaaggcgcag

SEQ ID NO: 14645 - DNA, 21 bp, Artificial Sequence
  Description of Artificial Sequence: Synthetic oligonucleotide
tctagggcgactcagactgtt

SEQ ID NO: 14646 - DNA, 21 bp, Artificial Sequence
  Description of Artificial Sequence: Synthetic oligonucleotide
caacccaacagcaaacccgtc

SEQ ID NO: 14647 - DNA, 21 bp, Artificial Sequence
  Description of Artificial Sequence: Synthetic oligonucleotide
agcggcaaaggccaactcaac

SEQ ID NO: 14648 - DNA, 21 bp, Artificial Sequence
  Description of Artificial Sequence: Synthetic oligonucleotide
ggggcggctagtgggcaggtt

SEQ ID NO: 14649 - DNA, 21 bp, Artificial Sequence
  Description of Artificial Sequence: Synthetic oligonucleotide
agtcagatggctaattcgaag

SEQ ID NO: 14650 - DNA, 21 bp, Artificial Sequence
  Description of Artificial Sequence: Synthetic oligonucleotide
caaaccagaaccgccaaccaa

SEQ ID NO: 14651 - DNA, 21 bp, Artificial Sequence
  Description of Artificial Sequence: Synthetic oligonucleotide
gaaggcgccgacagacacaga

SEQ ID NO: 14652 - DNA, 21 bp, Artificial Sequence
  Description of Artificial Sequence: Synthetic oligonucleotide
gttcagaatgagcggtcgcgg

SEQ ID NO: 14653 - DNA, 21 bp, Artificial Sequence
  Description of Artificial Sequence: Synthetic oligonucleotide
tcgtcgaatagtacgcgtagt

SEQ ID NO: 14654 - DNA, 21 bp, Artificial Sequence
  Description of Artificial Sequence: Synthetic oligonucleotide
agcaacggcaacagcagagcc

SEQ ID NO: 14655 - DNA, 21 bp, Artificial Sequence
  Description of Artificial Sequence: Synthetic oligonucleotide
agcgtcagcaaaagcaccaac

SEQ ID NO: 14656 - DNA, 21 bp, Artificial Sequence
  Description of Artificial Sequence: Synthetic oligonucleotide
ggcatcggcaaaaacggcgcc

SEQ ID NO: 14657 - DNA, 21 bp, Artificial Sequence
  Description of Artificial Sequence: Synthetic oligonucleotide
gccgaaagcagaccccccctc

SEQ ID NO: 14658 - DNA, 21 bp, Artificial Sequence
  Description of Artificial Sequence: Synthetic oligonucleotide
acgaataatactcgtcctgag

SEQ ID NO: 14659 - DNA, 21 bp, Artificial Sequence
  Description of Artificial Sequence: Synthetic oligonucleotide
gtcgtcgccaaaagcagcagc

SEQ ID NO: 14660 - DNA, 21 bp, Artificial Sequence
  Description of Artificial Sequence: Synthetic oligonucleotide
cagggtgcggggtctatggct

SEQ ID NO: 14661 - DNA, 21 bp, Artificial Sequence
  Description of Artificial Sequence: Synthetic oligonucleotide
actggggttgagaagcttcat

SEQ ID NO: 14662 - DNA, 21 bp, Artificial Sequence
  Description of Artificial Sequence: Synthetic oligonucleotide
ctcagcgacaaacccgccaga

SEQ ID NO: 14663 - DNA, 21 bp, Artificial Sequence
  Description of Artificial Sequence: Synthetic oligonucleotide
gagcggtctccgtctgctact

SEQ ID NO: 14664 - DNA, 21 bp, Artificial Sequence
  Description of Artificial Sequence: Synthetic oligonucleotide
attacggcgagtccgactatt

SEQ ID NO: 14665 - DNA, 21 bp, Artificial Sequence
  Description of Artificial Sequence: Synthetic oligonucleotide
ggtttgaataaggaggttcgt

SEQ ID NO: 14666 - DNA, 21 bp, Artificial Sequence
  Description of Artificial Sequence: Synthetic oligonucleotide
catggggatcggacgaattcg

SEQ ID NO: 14667 - DNA, 21 bp, Artificial Sequence
  Description of Artificial Sequence: Synthetic oligonucleotide
ctcggcgacagacaaatgcac

SEQ ID NO: 14668 - DNA, 21 bp, Artificial Sequence
  Description of Artificial Sequence: Synthetic oligonucleotide
caaagcatccacaaaagcgaa

SEQ ID NO: 14669 - DNA, 21 bp, Artificial Sequence
  Description of Artificial Sequence: Synthetic oligonucleotide
agcaccagcagccaaaaaacc

SEQ ID NO: 14670 - DNA, 21 bp, Artificial Sequence
  Description of Artificial Sequence: Synthetic oligonucleotide
gatcgggcggtgcagaatttg

SEQ ID NO: 14671 - DNA, 21 bp, Artificial Sequence
  Description of Artificial Sequence: Synthetic oligonucleotide
accagcggcaccagcatcctc

SEQ ID NO: 14672 - DNA, 21 bp, Artificial Sequence
  Description of Artificial Sequence: Synthetic oligonucleotide
caacaaggcgccagccaagcc

SEQ ID NO: 14673 - DNA, 21 bp, Artificial Sequence
  Description of Artificial Sequence: Synthetic oligonucleotide
ctcggcggcgccagcgtcaaa

SEQ ID NO: 14674 - DNA, 21 bp, Artificial Sequence
  Description of Artificial Sequence: Synthetic oligonucleotide
actaagagtactccgtcggtg

SEQ ID NO: 14675 - DNA, 21 bp, Artificial Sequence
  Description of Artificial Sequence: Synthetic oligonucleotide
gccctcaccagcaaaagccaa

SEQ ID NO: 14676 - DNA, 21 bp, Artificial Sequence
  Description of Artificial Sequence: Synthetic oligonucleotide
aaaagcagcggcgaccaaacc

SEQ ID NO: 14677 - DNA, 21 bp, Artificial Sequence
  Description of Artificial Sequence: Synthetic oligonucleotide
cacagcacccccaccaacacc

SEQ ID NO: 14678 - DNA, 21 bp, Artificial Sequence
  Description of Artificial Sequence: Synthetic oligonucleotide
cttcagacttctaagcctcag

SEQ ID NO: 14679 - DNA, 21 bp, Artificial Sequence
  Description of Artificial Sequence: Synthetic oligonucleotide
agagccagcccccccagcagc

SEQ ID NO: 14680 - DNA, 21 bp, Artificial Sequence
  Description of Artificial Sequence: Synthetic oligonucleotide
acgccggctaaggctcagctg

SEQ ID NO: 14681 - DNA, 21 bp, Artificial Sequence
  Description of Artificial Sequence: Synthetic oligonucleotide
tcgtctgatcggtctaatgtg

SEQ ID NO: 14682 - DNA, 21 bp, Artificial Sequence
  Description of Artificial Sequence: Synthetic oligonucleotide
accggcaacagcagcgtcatc

SEQ ID NO: 14683 - DNA, 21 bp, Artificial Sequence
  Description of Artificial Sequence: Synthetic oligonucleotide
cttagtggtaataaggctatt

SEQ ID NO: 14684 - DNA, 21 bp, Artificial Sequence
  Description of Artificial Sequence: Synthetic oligonucleotide
aatggggcttctcggactact

SEQ ID NO: 14685 - DNA, 21 bp, Artificial Sequence
  Description of Artificial Sequence: Synthetic oligonucleotide
gaaagcaccgccacccccaga

SEQ ID NO: 14686 - DNA, 21 bp, Artificial Sequence
  Description of Artificial Sequence: Synthetic oligonucleotide
aaaagcagcggcagccccctc

SEQ ID NO: 14687 - DNA, 21 bp, Artificial Sequence
  Description of Artificial Sequence: Synthetic oligonucleotide
caggggggtgcgtctaatcgt

SEQ ID NO: 14688 - DNA, 21 bp, Artificial Sequence
  Description of Artificial Sequence: Synthetic oligonucleotide
catgttaagccgactagtgtg

SEQ ID NO: 14689 - DNA, 21 bp, Artificial Sequence
  Description of Artificial Sequence: Synthetic oligonucleotide
ggtgttaattctggtggtcat

SEQ ID NO: 14690 - DNA, 21 bp, Artificial Sequence
  Description of Artificial Sequence: Synthetic oligonucleotide
acccccagcgccaaaggcaac

SEQ ID NO: 14691 - DNA, 21 bp, Artificial Sequence
  Description of Artificial Sequence: Synthetic oligonucleotide
aaacaaggcagcagcagcgtc

SEQ ID NO: 14692 - DNA, 21 bp, Artificial Sequence
  Description of Artificial Sequence: Synthetic oligonucleotide
actaagcagtcgtctattgcg

SEQ ID NO: 14693 - DNA, 21 bp, Artificial Sequence
  Description of Artificial Sequence: Synthetic oligonucleotide
agcagagcccaaggcaccgcc

SEQ ID NO: 14694 - DNA, 21 bp, Artificial Sequence
  Description of Artificial Sequence: Synthetic oligonucleotide
actggtcggaatgggaatcag

SEQ ID NO: 14695 - DNA, 21 bp, Artificial Sequence
  Description of Artificial Sequence: Synthetic oligonucleotide
ggttcgcctcagaagaatcag

SEQ ID NO: 14696 - DNA, 21 bp, Artificial Sequence
  Description of Artificial Sequence: Synthetic oligonucleotide
acccccagcaaagaaagaagc

SEQ ID NO: 14697 - DNA, 21 bp, Artificial Sequence
  Description of Artificial Sequence: Synthetic oligonucleotide
atcaccagccaaaaaagcgtc

SEQ ID NO: 14698 - DNA, 21 bp, Artificial Sequence
  Description of Artificial Sequence: Synthetic oligonucleotide
attcagactaaggatcagctt

SEQ ID NO: 14699 - DNA, 21 bp, Artificial Sequence
  Description of Artificial Sequence: Synthetic oligonucleotide
tatgggtctgatagtaatcgt

SEQ ID NO: 14700 - DNA, 21 bp, Artificial Sequence
  Description of Artificial Sequence: Synthetic oligonucleotide
ggtgggtcgcctcggggtact

SEQ ID NO: 14701 - DNA, 21 bp, Artificial Sequence
  Description of Artificial Sequence: Synthetic oligonucleotide
cttacgaaggcgtcttctgtt

SEQ ID NO: 14702 - DNA, 21 bp, Artificial Sequence
  Description of Artificial Sequence: Synthetic oligonucleotide
agttcttctcagaagccgatg

SEQ ID NO: 14703 - DNA, 21 bp, Artificial Sequence
  Description of Artificial Sequence: Synthetic oligonucleotide
gacagccaacaaagaggcagc

SEQ ID NO: 14704 - DNA, 21 bp, Artificial Sequence
  Description of Artificial Sequence: Synthetic oligonucleotide
tcgactgtgaaggctcatagt

SEQ ID NO: 14705 - DNA, 21 bp, Artificial Sequence
  Description of Artificial Sequence: Synthetic oligonucleotide
aagtcgcagtcgccttctacg

SEQ ID NO: 14706 - DNA, 21 bp, Artificial Sequence
  Description of Artificial Sequence: Synthetic oligonucleotide
atcagcaccagccccggcaaa

SEQ ID NO: 14707 - DNA, 21 bp, Artificial Sequence
  Description of Artificial Sequence: Synthetic oligonucleotide
gggtcgggtcagaggcctgat

SEQ ID NO: 14708 - DNA, 21 bp, Artificial Sequence
  Description of Artificial Sequence: Synthetic oligonucleotide
accgtcagcaaaagcaacagc

SEQ ID NO: 14709 - DNA, 21 bp, Artificial Sequence
  Description of Artificial Sequence: Synthetic oligonucleotide
cacagcggcggcagcagcgtc

SEQ ID NO: 14710 - DNA, 21 bp, Artificial Sequence
  Description of Artificial Sequence: Synthetic oligonucleotide
ggcagcaccaaacccctcctc

SEQ ID NO: 14711 - DNA, 21 bp, Artificial Sequence
  Description of Artificial Sequence: Synthetic oligonucleotide
cacaccaccaaaagcgccacc

SEQ ID NO: 14712 - DNA, 21 bp, Artificial Sequence
  Description of Artificial Sequence: Synthetic oligonucleotide
agcagcagcaaaggcaacagc

SEQ ID NO: 14713 - DNA, 21 bp, Artificial Sequence
  Description of Artificial Sequence: Synthetic oligonucleotide
tctctggcgaagggtaataat

SEQ ID NO: 14714 - DNA, 21 bp, Artificial Sequence
  Description of Artificial Sequence: Synthetic oligonucleotide
gcccaaggcaaacccggcccc

SEQ ID NO: 14715 - DNA, 21 bp, Artificial Sequence
  Description of Artificial Sequence: Synthetic oligonucleotide
accggcggcaacaaaagcacc

SEQ ID NO: 14716 - DNA, 21 bp, Artificial Sequence
  Description of Artificial Sequence: Synthetic oligonucleotide
atgggtgataatcgggctagt

SEQ ID NO: 14717 - DNA, 21 bp, Artificial Sequence
  Description of Artificial Sequence: Synthetic oligonucleotide
gagcgtactgtttctccgacg

SEQ ID NO: 14718 - DNA, 21 bp, Artificial Sequence
  Description of Artificial Sequence: Synthetic oligonucleotide
tcgccgattcaggctagtaag

SEQ ID NO: 14719 - DNA, 21 bp, Artificial Sequence
  Description of Artificial Sequence: Synthetic oligonucleotide
actggtacgaatgctgtgatg

SEQ ID NO: 14720 - DNA, 21 bp, Artificial Sequence
  Description of Artificial Sequence: Synthetic oligonucleotide
catactaatacgaaggtgggg

SEQ ID NO: 14721 - DNA, 21 bp, Artificial Sequence
  Description of Artificial Sequence: Synthetic oligonucleotide
aagggtcagggtccggcggtg

SEQ ID NO: 14722 - DNA, 21 bp, Artificial Sequence
  Description of Artificial Sequence: Synthetic oligonucleotide
aattcggatcgttctcatgtg

SEQ ID NO: 14723 - DNA, 21 bp, Artificial Sequence
  Description of Artificial Sequence: Synthetic oligonucleotide
accaccagcagcaaacaagaa

SEQ ID NO: 14724 - DNA, 21 bp, Artificial Sequence
  Description of Artificial Sequence: Synthetic oligonucleotide
ctccaaaccaaaagccaaacc

SEQ ID NO: 14725 - DNA, 21 bp, Artificial Sequence
  Description of Artificial Sequence: Synthetic oligonucleotide
gatgctgggggtaatagtgct

SEQ ID NO: 14726 - DNA, 21 bp, Artificial Sequence
  Description of Artificial Sequence: Synthetic oligonucleotide
aagggttcgaataatggtcag

SEQ ID NO: 14727 - DNA, 21 bp, Artificial Sequence
  Description of Artificial Sequence: Synthetic oligonucleotide
ggcctcggcaaaagcgccctc

SEQ ID NO: 14728 - DNA, 21 bp, Artificial Sequence
  Description of Artificial Sequence: Synthetic oligonucleotide
tcgcagggtgcgccgacgaag

SEQ ID NO: 14729 - DNA, 21 bp, Artificial Sequence
  Description of Artificial Sequence: Synthetic oligonucleotide
accaccagcgacaaaatcgtc

SEQ ID NO: 14730 - DNA, 21 bp, Artificial Sequence
  Description of Artificial Sequence: Synthetic oligonucleotide
catagtagtcagtctcagagt

SEQ ID NO: 14731 - DNA, 21 bp, Artificial Sequence
  Description of Artificial Sequence: Synthetic oligonucleotide
gaagccggcagacccaacctc

SEQ ID NO: 14732 - DNA, 21 bp, Artificial Sequence
  Description of Artificial Sequence: Synthetic oligonucleotide
ggcgccgacagaaaagcccaa

SEQ ID NO: 14733 - DNA, 21 bp, Artificial Sequence
  Description of Artificial Sequence: Synthetic oligonucleotide
tacggcaaaagcaaccaaatc

SEQ ID NO: 14734 - DNA, 21 bp, Artificial Sequence
  Description of Artificial Sequence: Synthetic oligonucleotide
tgtactaatggggcgaataag

SEQ ID NO: 14735 - DNA, 21 bp, Artificial Sequence
  Description of Artificial Sequence: Synthetic oligonucleotide
caaagcagccaagccatgacc

SEQ ID NO: 14736 - DNA, 21 bp, Artificial Sequence
  Description of Artificial Sequence: Synthetic oligonucleotide
cacaccaccagccccaacaac

SEQ ID NO: 14737 - DNA, 21 bp, Artificial Sequence
  Description of Artificial Sequence: Synthetic oligonucleotide
tctgggacgtcttctcattct

SEQ ID NO: 14738 - DNA, 21 bp, Artificial Sequence
  Description of Artificial Sequence: Synthetic oligonucleotide
agcagaaacaacggcagcggc

SEQ ID NO: 14739 - DNA, 21 bp, Artificial Sequence
  Description of Artificial Sequence: Synthetic oligonucleotide
actctgaatactgctgcgggg

SEQ ID NO: 14740 - DNA, 21 bp, Artificial Sequence
  Description of Artificial Sequence: Synthetic oligonucleotide
gaaagacaaagcaccagcagc

SEQ ID NO: 14741 - DNA, 21 bp, Artificial Sequence
  Description of Artificial Sequence: Synthetic oligonucleotide
ggcagcggcgccccccaaacc

SEQ ID NO: 14742 - DNA, 21 bp, Artificial Sequence
  Description of Artificial Sequence: Synthetic oligonucleotide
gagcagaatactgttaatcgt

SEQ ID NO: 14743 - DNA, 21 bp, Artificial Sequence
  Description of Artificial Sequence: Synthetic oligonucleotide
aaaaccgccacccccagcctc

SEQ ID NO: 14744 - DNA, 21 bp, Artificial Sequence
  Description of Artificial Sequence: Synthetic oligonucleotide
agcgaaaaagcccaaccccac

SEQ ID NO: 14745 - DNA, 21 bp, Artificial Sequence
  Description of Artificial Sequence: Synthetic oligonucleotide
aatggtcatacttcgactctg

SEQ ID NO: 14746 - DNA, 21 bp, Artificial Sequence
  Description of Artificial Sequence: Synthetic oligonucleotide
agcaccaccagcgaacccaga

SEQ ID NO: 14747 - DNA, 21 bp, Artificial Sequence
  Description of Artificial Sequence: Synthetic oligonucleotide
tcggggactagtccgcatctg

SEQ ID NO: 14748 - DNA, 21 bp, Artificial Sequence
  Description of Artificial Sequence: Synthetic oligonucleotide
actccttctaagggtgcgact

SEQ ID NO: 14749 - DNA, 21 bp, Artificial Sequence
  Description of Artificial Sequence: Synthetic oligonucleotide
gggcaggagaataaggttact

SEQ ID NO: 14750 - DNA, 21 bp, Artificial Sequence
  Description of Artificial Sequence: Synthetic oligonucleotide
ggtacgtcgcagctttctaag

SEQ ID NO: 14751 - DNA, 21 bp, Artificial Sequence
  Description of Artificial Sequence: Synthetic oligonucleotide
caaagcgtcaaaccccccgtc

SEQ ID NO: 14752 - DNA, 21 bp, Artificial Sequence
  Description of Artificial Sequence: Synthetic oligonucleotide
gacaacggcagacccagccaa

SEQ ID NO: 14753 - DNA, 21 bp, Artificial Sequence
  Description of Artificial Sequence: Synthetic oligonucleotide
gcttcgggtaagcctacttct

SEQ ID NO: 14754 - DNA, 21 bp, Artificial Sequence
  Description of Artificial Sequence: Synthetic oligonucleotide
tgtaataattctggtaagggg

SEQ ID NO: 14755 - DNA, 21 bp, Artificial Sequence
  Description of Artificial Sequence: Synthetic oligonucleotide
ttcaccgaacccggccaaaaa

SEQ ID NO: 14756 - DNA, 21 bp, Artificial Sequence
  Description of Artificial Sequence: Synthetic oligonucleotide
agcggcgccagcaccggcagc

SEQ ID NO: 14757 - DNA, 21 bp, Artificial Sequence
  Description of Artificial Sequence: Synthetic oligonucleotide
gcgtcgcagacgagtaataag

SEQ ID NO: 14758 - DNA, 21 bp, Artificial Sequence
  Description of Artificial Sequence: Synthetic oligonucleotide
tctagtgcgtctaaggggaat

SEQ ID NO: 14759 - DNA, 21 bp, Artificial Sequence
  Description of Artificial Sequence: Synthetic oligonucleotide
tctacgtcgggtcggcatgag

SEQ ID NO: 14760 - DNA, 21 bp, Artificial Sequence
  Description of Artificial Sequence: Synthetic oligonucleotide
ctcggcgacagcagaaccatg

SEQ ID NO: 14761 - DNA, 21 bp, Artificial Sequence
  Description of Artificial Sequence: Synthetic oligonucleotide
gccgccacccccggcacccac

SEQ ID NO: 14762 - DNA, 21 bp, Artificial Sequence
  Description of Artificial Sequence: Synthetic oligonucleotide
agcggcaacagcagacaaagc

SEQ ID NO: 14763 - DNA, 21 bp, Artificial Sequence
  Description of Artificial Sequence: Synthetic oligonucleotide
agacaaggcaacgcccccagc

SEQ ID NO: 14764 - DNA, 21 bp, Artificial Sequence
  Description of Artificial Sequence: Synthetic oligonucleotide
agcacccaaagccccacccac

SEQ ID NO: 14765 - DNA, 21 bp, Artificial Sequence
  Description of Artificial Sequence: Synthetic oligonucleotide
caaggcggcagccaccaactc

SEQ ID NO: 14766 - DNA, 21 bp, Artificial Sequence
  Description of Artificial Sequence: Synthetic oligonucleotide
acccccagcaccgccggcggc

SEQ ID NO: 14767 - DNA, 21 bp, Artificial Sequence
  Description of Artificial Sequence: Synthetic oligonucleotide
actttggagcagaagagtgtg

SEQ ID NO: 14768 - DNA, 21 bp, Artificial Sequence
  Description of Artificial Sequence: Synthetic oligonucleotide
aatgttggtaattcgagtgtt

SEQ ID NO: 14769 - DNA, 21 bp, Artificial Sequence
  Description of Artificial Sequence: Synthetic oligonucleotide
atcaccagcaaagtcgccacc

SEQ ID NO: 14770 - DNA, 21 bp, Artificial Sequence
  Description of Artificial Sequence: Synthetic oligonucleotide
acgacgaatcggcctggtgat

SEQ ID NO: 14771 - DNA, 21 bp, Artificial Sequence
  Description of Artificial Sequence: Synthetic oligonucleotide
agtgctagtaatacgccgagg

SEQ ID NO: 14772 - DNA, 21 bp, Artificial Sequence
  Description of Artificial Sequence: Synthetic oligonucleotide
gacggcgccagaaccgccgtc

SEQ ID NO: 14773 - DNA, 21 bp, Artificial Sequence
  Description of Artificial Sequence: Synthetic oligonucleotide
gggagtcgggcgcctgctctt

SEQ ID NO: 14774 - DNA, 21 bp, Artificial Sequence
  Description of Artificial Sequence: Synthetic oligonucleotide
gacagcaacagcccccaaaga

SEQ ID NO: 14775 - DNA, 21 bp, Artificial Sequence
  Description of Artificial Sequence: Synthetic oligonucleotide
ggtagtaagtctacgatttct

SEQ ID NO: 14776 - DNA, 21 bp, Artificial Sequence
  Description of Artificial Sequence: Synthetic oligonucleotide
agtgggcctagtccgagttcg

SEQ ID NO: 14777 - DNA, 21 bp, Artificial Sequence
  Description of Artificial Sequence: Synthetic oligonucleotide
tctaaggggaattctgctgtg

SEQ ID NO: 14778 - DNA, 21 bp, Artificial Sequence
  Description of Artificial Sequence: Synthetic oligonucleotide
aacgtcagcaaaagcagcagc

SEQ ID NO: 14779 - DNA, 21 bp, Artificial Sequence
  Description of Artificial Sequence: Synthetic oligonucleotide
actgggcagggtaaggcttcg

SEQ ID NO: 14780 - DNA, 21 bp, Artificial Sequence
  Description of Artificial Sequence: Synthetic oligonucleotide
gggagggctgagagtcctcgt

SEQ ID NO: 14781 - DNA, 21 bp, Artificial Sequence
  Description of Artificial Sequence: Synthetic oligonucleotide
caagccgccaaaagcaccagc

SEQ ID NO: 14782 - DNA, 21 bp, Artificial Sequence
  Description of Artificial Sequence: Synthetic oligonucleotide
agccccatcaaaagcagcgcc

SEQ ID NO: 14783 - DNA, 21 bp, Artificial Sequence
  Description of Artificial Sequence: Synthetic oligonucleotide
aaccaagccgccagccacaaa

SEQ ID NO: 14784 - DNA, 21 bp, Artificial Sequence
  Description of Artificial Sequence: Synthetic oligonucleotide
actgcgactaattctcctagg

SEQ ID NO: 14785 - DNA, 21 bp, Artificial Sequence
  Description of Artificial Sequence: Synthetic oligonucleotide
aggggtacttcgacgcttgct

SEQ ID NO: 14786 - DNA, 21 bp, Artificial Sequence
  Description of Artificial Sequence: Synthetic oligonucleotide
cagccgacggagaagtctgtg

SEQ ID NO: 14787 - DNA, 21 bp, Artificial Sequence
  Description of Artificial Sequence: Synthetic oligonucleotide
gccggcatgggcaccaacacc

SEQ ID NO: 14788 - DNA, 21 bp, Artificial Sequence
  Description of Artificial Sequence: Synthetic oligonucleotide
gggcttgagcggaatttgggg

SEQ ID NO: 14789 - DNA, 21 bp, Artificial Sequence
  Description of Artificial Sequence: Synthetic oligonucleotide
tcgcttacggctccggcgaag

SEQ ID NO: 14790 - DNA, 21 bp, Artificial Sequence
  Description of Artificial Sequence: Synthetic oligonucleotide
actagtgagccttctgctaag

SEQ ID NO: 14791 - DNA, 21 bp, Artificial Sequence
  Description of Artificial Sequence: Synthetic oligonucleotide
caaagagaaagccccaccaga

SEQ ID NO: 14792 - DNA, 21 bp, Artificial Sequence
  Description of Artificial Sequence: Synthetic oligonucleotide
ctcagccccggcgccggcagc

SEQ ID NO: 14793 - DNA, 21 bp, Artificial Sequence
  Description of Artificial Sequence: Synthetic oligonucleotide
cttgctggtggttctacgtcg

SEQ ID NO: 14794 - DNA, 21 bp, Artificial Sequence
  Description of Artificial Sequence: Synthetic oligonucleotide
aatactggtgctgggcagctg

SEQ ID NO: 14795 - DNA, 21 bp, Artificial Sequence
  Description of Artificial Sequence: Synthetic oligonucleotide
acgtgtacgaaggaggggtgt

SEQ ID NO: 14796 - DNA, 21 bp, Artificial Sequence
  Description of Artificial Sequence: Synthetic oligonucleotide
gtcaccaccaacaaaaccgaa

SEQ ID NO: 14797 - DNA, 21 bp, Artificial Sequence
  Description of Artificial Sequence: Synthetic oligonucleotide
actttgtctaagagtgcggct

SEQ ID NO: 14798 - DNA, 21 bp, Artificial Sequence
  Description of Artificial Sequence: Synthetic oligonucleotide
aggggtgagcagtctactttt

SEQ ID NO: 14799 - DNA, 21 bp, Artificial Sequence
  Description of Artificial Sequence: Synthetic oligonucleotide
gctactactccgggtcatact

SEQ ID NO: 14800 - DNA, 21 bp, Artificial Sequence
  Description of Artificial Sequence: Synthetic oligonucleotide
catgcgtcttctcagtctaag

SEQ ID NO: 14801 - DNA, 21 bp, Artificial Sequence
  Description of Artificial Sequence: Synthetic oligonucleotide
aggagtcatgataaggcggcg

SEQ ID NO: 14802 - DNA, 21 bp, Artificial Sequence
  Description of Artificial Sequence: Synthetic oligonucleotide
cagaaggaggataggattgcg

SEQ ID NO: 14803 - DNA, 21 bp, Artificial Sequence
  Description of Artificial Sequence: Synthetic oligonucleotide
gttacgaatacgaagcctcag

SEQ ID NO: 14804 - DNA, 21 bp, Artificial Sequence
  Description of Artificial Sequence: Synthetic oligonucleotide
tctggtagtaataagttttcg

SEQ ID NO: 14805 - DNA, 21 bp, Artificial Sequence
  Description of Artificial Sequence: Synthetic oligonucleotide
gttgctaagtcgcctatgact

SEQ ID NO: 14806 - DNA, 21 bp, Artificial Sequence
  Description of Artificial Sequence: Synthetic oligonucleotide
aattcgtcgtctcctacgcat

SEQ ID NO: 14807 - DNA, 21 bp, Artificial Sequence
  Description of Artificial Sequence: Synthetic oligonucleotide
gacagcaccgccaaacccaga

SEQ ID NO: 14808 - DNA, 21 bp, Artificial Sequence
  Description of Artificial Sequence: Synthetic oligonucleotide
aacatcagcggcagcagcaaa

SEQ ID NO: 14809 - DNA, 21 bp, Artificial Sequence
  Description of Artificial Sequence: Synthetic oligonucleotide
acgggggggggtcagtctctt

SEQ ID NO: 14810 - DNA, 21 bp, Artificial Sequence
  Description of Artificial Sequence: Synthetic oligonucleotide
agagacggcggcagcagcaga

SEQ ID NO: 14811 - DNA, 21 bp, Artificial Sequence
  Description of Artificial Sequence: Synthetic oligonucleotide
gccggcaccggcaaactcatc

SEQ ID NO: 14812 - DNA, 21 bp, Artificial Sequence
  Description of Artificial Sequence: Synthetic oligonucleotide
atcagcaccgacaaaatgaaa

SEQ ID NO: 14813 - DNA, 21 bp, Artificial Sequence
  Description of Artificial Sequence: Synthetic oligonucleotide
atgagttcggggaagaatttg

SEQ ID NO: 14814 - DNA, 21 bp, Artificial Sequence
  Description of Artificial Sequence: Synthetic oligonucleotide
ggttctggtcttggtggtgtg

SEQ ID NO: 14815 - DNA, 21 bp, Artificial Sequence
  Description of Artificial Sequence: Synthetic oligonucleotide
ttcggcagcaccaaacacgaa

SEQ ID NO: 14816 - DNA, 21 bp, Artificial Sequence
  Description of Artificial Sequence: Synthetic oligonucleotide
agtgagaatagtaagcctggt

SEQ ID NO: 14817 - DNA, 21 bp, Artificial Sequence
  Description of Artificial Sequence: Synthetic oligonucleotide
gaaagaagcaccgccggcgtc

SEQ ID NO: 14818 - DNA, 21 bp, Artificial Sequence
  Description of Artificial Sequence: Synthetic oligonucleotide
accatcagcggcaacagagaa

SEQ ID NO: 14819 - DNA, 21 bp, Artificial Sequence
  Description of Artificial Sequence: Synthetic oligonucleotide
actgggaattcttctactatg

SEQ ID NO: 14820 - DNA, 21 bp, Artificial Sequence
  Description of Artificial Sequence: Synthetic oligonucleotide
atgggtggtcaggtgcctgcg

SEQ ID NO: 14821 - DNA, 21 bp, Artificial Sequence
  Description of Artificial Sequence: Synthetic oligonucleotide
caaagcctcaaacccgtcagc

SEQ ID NO: 14822 - DNA, 21 bp, Artificial Sequence
  Description of Artificial Sequence: Synthetic oligonucleotide
cagaatgattctcggactagt

SEQ ID NO: 14823 - DNA, 21 bp, Artificial Sequence
  Description of Artificial Sequence: Synthetic oligonucleotide
catgttaagacgagtccgggt

SEQ ID NO: 14824 - DNA, 21 bp, Artificial Sequence
  Description of Artificial Sequence: Synthetic oligonucleotide
ctcaccaacaaacccgtcagc

SEQ ID NO: 14825 - DNA, 21 bp, Artificial Sequence
  Description of Artificial Sequence: Synthetic oligonucleotide
gacagcggcaaacaaagcagc

SEQ ID NO: 14826 - DNA, 21 bp, Artificial Sequence
  Description of Artificial Sequence: Synthetic oligonucleotide
gagaggggtgatgggggtcgt

SEQ ID NO: 14827 - DNA, 21 bp, Artificial Sequence
  Description of Artificial Sequence: Synthetic oligonucleotide
ggcaacgccagcaaaggcggc

SEQ ID NO: 14828 - DNA, 21 bp, Artificial Sequence
  Description of Artificial Sequence: Synthetic oligonucleotide
gtggcgtcgggttcttctggt

SEQ ID NO: 14829 - DNA, 21 bp, Artificial Sequence
  Description of Artificial Sequence: Synthetic oligonucleotide
accggcatcggcacccccaaa

SEQ ID NO: 14830 - DNA, 21 bp, Artificial Sequence
  Description of Artificial Sequence: Synthetic oligonucleotide
tcgcgggctccttcgagtgcg

SEQ ID NO: 14831 - DNA, 21 bp, Artificial Sequence
  Description of Artificial Sequence: Synthetic oligonucleotide
actagtagggggactcaggcg

SEQ ID NO: 14832 - DNA, 21 bp, Artificial Sequence
  Description of Artificial Sequence: Synthetic oligonucleotide
aagcgggagaatactgcggtt

SEQ ID NO: 14833 - DNA, 21 bp, Artificial Sequence
  Description of Artificial Sequence: Synthetic oligonucleotide
gctggtacttcttctatttcg

SEQ ID NO: 14834 - DNA, 21 bp, Artificial Sequence
  Description of Artificial Sequence: Synthetic oligonucleotide
agcaccagcagaagcaacacc

SEQ ID NO: 14835 - DNA, 21 bp, Artificial Sequence
  Description of Artificial Sequence: Synthetic oligonucleotide
accagcgccgtcaaaaccaac

SEQ ID NO: 14836 - DNA, 21 bp, Artificial Sequence
  Description of Artificial Sequence: Synthetic oligonucleotide
caaagaagccccgaccaaaaa

SEQ ID NO: 14837 - DNA, 21 bp, Artificial Sequence
  Description of Artificial Sequence: Synthetic oligonucleotide
caaatcggcggcaccggcagc

SEQ ID NO: 14838 - DNA, 21 bp, Artificial Sequence
  Description of Artificial Sequence: Synthetic oligonucleotide
cgggagggtactcataattcg

SEQ ID NO: 14839 - DNA, 21 bp, Artificial Sequence
  Description of Artificial Sequence: Synthetic oligonucleotide
caaagcagccccaaagtcagc

SEQ ID NO: 14840 - DNA, 21 bp, Artificial Sequence
  Description of Artificial Sequence: Synthetic oligonucleotide
gtccaaggcaaacccagccaa

SEQ ID NO: 14841 - DNA, 21 bp, Artificial Sequence
  Description of Artificial Sequence: Synthetic oligonucleotide
aacagcagcaacaacggcagc

SEQ ID NO: 14842 - DNA, 21 bp, Artificial Sequence
  Description of Artificial Sequence: Synthetic oligonucleotide
gtgcagtcgaagggttcgatg

SEQ ID NO: 14843 - DNA, 21 bp, Artificial Sequence
  Description of Artificial Sequence: Synthetic oligonucleotide
accaacgacagcagaagccac

SEQ ID NO: 14844 - DNA, 21 bp, Artificial Sequence
  Description of Artificial Sequence: Synthetic oligonucleotide
ctcagcaccaaaagcaacgtc

SEQ ID NO: 14845 - DNA, 21 bp, Artificial Sequence
  Description of Artificial Sequence: Synthetic oligonucleotide
gcccaaaacaccgtcggcaga

SEQ ID NO: 14846 - DNA, 21 bp, Artificial Sequence
  Description of Artificial Sequence: Synthetic oligonucleotide
gggatgaattcttcttctaag

SEQ ID NO: 14847 - DNA, 21 bp, Artificial Sequence
  Description of Artificial Sequence: Synthetic oligonucleotide
tctagtgttactaagtcggct

SEQ ID NO: 14848 - DNA, 21 bp, Artificial Sequence
  Description of Artificial Sequence: Synthetic oligonucleotide
tcgcatacgtcgaaggcttct

SEQ ID NO: 14849 - DNA, 21 bp, Artificial Sequence
  Description of Artificial Sequence: Synthetic oligonucleotide
ggtactacgtctccgacgact

SEQ ID NO: 14850 - DNA, 21 bp, Artificial Sequence
  Description of Artificial Sequence: Synthetic oligonucleotide
tctatggttagtgatagtaag

SEQ ID NO: 14851 - DNA, 21 bp, Artificial Sequence
  Description of Artificial Sequence: Synthetic oligonucleotide
gggactaagagtgctcttggg

SEQ ID NO: 14852 - DNA, 21 bp, Artificial Sequence
  Description of Artificial Sequence: Synthetic oligonucleotide
aagatggggtctgcttcttct

SEQ ID NO: 14853 - DNA, 21 bp, Artificial Sequence
  Description of Artificial Sequence: Synthetic oligonucleotide
atcaccagcggcaaacaagaa

SEQ ID NO: 14854 - DNA, 21 bp, Artificial Sequence
  Description of Artificial Sequence: Synthetic oligonucleotide
gacgccagcagagcccccagc

SEQ ID NO: 14855 - DNA, 21 bp, Artificial Sequence
  Description of Artificial Sequence: Synthetic oligonucleotide
ggtattaatactggtaatggg

SEQ ID NO: 14856 - DNA, 21 bp, Artificial Sequence
  Description of Artificial Sequence: Synthetic oligonucleotide
gtcagaaccggcacccccaac

SEQ ID NO: 14857 - DNA, 21 bp, Artificial Sequence
  Description of Artificial Sequence: Synthetic oligonucleotide
agcgtcggccaaaaacccctc

SEQ ID NO: 14858 - DNA, 21 bp, Artificial Sequence
  Description of Artificial Sequence: Synthetic oligonucleotide
agtcctgctcgggctgcggtg

SEQ ID NO: 14859 - DNA, 21 bp, Artificial Sequence
  Description of Artificial Sequence: Synthetic oligonucleotide
gccgtcggcagccccacccaa

SEQ ID NO: 14860 - DNA, 21 bp, Artificial Sequence
  Description of Artificial Sequence: Synthetic oligonucleotide
gaggctaaggttaagcctgat

SEQ ID NO: 14861 - DNA, 21 bp, Artificial Sequence
  Description of Artificial Sequence: Synthetic oligonucleotide
cacaccggcagcggccaagcc

SEQ ID NO: 14862 - DNA, 21 bp, Artificial Sequence
  Description of Artificial Sequence: Synthetic oligonucleotide
gcccccagcaaaagccacgaa

SEQ ID NO: 14863 - DNA, 21 bp, Artificial Sequence
  Description of Artificial Sequence: Synthetic oligonucleotide
ggcagcaacggcgccggcccc

SEQ ID NO: 14864 - DNA, 21 bp, Artificial Sequence
  Description of Artificial Sequence: Synthetic oligonucleotide
ggtcagactcttgggggtaag

SEQ ID NO: 14865 - DNA, 21 bp, Artificial Sequence
  Description of Artificial Sequence: Synthetic oligonucleotide
ctcagaaccgaacacacccaa

SEQ ID NO: 14866 - DNA, 21 bp, Artificial Sequence
  Description of Artificial Sequence: Synthetic oligonucleotide
actaagaatgcgtctgcggtt

SEQ ID NO: 14867 - DNA, 21 bp, Artificial Sequence
  Description of Artificial Sequence: Synthetic oligonucleotide
accagcggcggcagcttcatc

SEQ ID NO: 14868 - DNA, 21 bp, Artificial Sequence
  Description of Artificial Sequence: Synthetic oligonucleotide
atgagaagcgacagccaactc

SEQ ID NO: 14869 - DNA, 21 bp, Artificial Sequence
  Description of Artificial Sequence: Synthetic oligonucleotide
aacggcgaaagacaaacccac

SEQ ID NO: 14870 - DNA, 21 bp, Artificial Sequence
  Description of Artificial Sequence: Synthetic oligonucleotide
agcaccggcaaaatcaccacc

SEQ ID NO: 14871 - DNA, 21 bp, Artificial Sequence
  Description of Artificial Sequence: Synthetic oligonucleotide
agcagccaagccgtcggccaa

SEQ ID NO: 14872 - DNA, 21 bp, Artificial Sequence
  Description of Artificial Sequence: Synthetic oligonucleotide
cagcaggtgagtaagccggtt

SEQ ID NO: 14873 - DNA, 21 bp, Artificial Sequence
  Description of Artificial Sequence: Synthetic oligonucleotide
cacagcagcaacgccaccaga

SEQ ID NO: 14874 - DNA, 21 bp, Artificial Sequence
  Description of Artificial Sequence: Synthetic oligonucleotide
tcgagtcctgggacggttgtt

SEQ ID NO: 14875 - DNA, 21 bp, Artificial Sequence
  Description of Artificial Sequence: Synthetic oligonucleotide
aacgacagcgccgacagaaga

SEQ ID NO: 14876 - DNA, 21 bp, Artificial Sequence
  Description of Artificial Sequence: Synthetic oligonucleotide
ggcagagacaccagcagcagc

SEQ ID NO: 14877 - DNA, 21 bp, Artificial Sequence
  Description of Artificial Sequence: Synthetic oligonucleotide
cagcaggcgggtaaggttgct

SEQ ID NO: 14878 - DNA, 21 bp, Artificial Sequence
  Description of Artificial Sequence: Synthetic oligonucleotide
agcagcgaagccaaacaaagc

SEQ ID NO: 14879 - DNA, 21 bp, Artificial Sequence
  Description of Artificial Sequence: Synthetic oligonucleotide
caaaccggcaaaagcagctac

SEQ ID NO: 14880 - DNA, 21 bp, Artificial Sequence
  Description of Artificial Sequence: Synthetic oligonucleotide
caagccaccagcaccagactc

SEQ ID NO: 14881 - DNA, 21 bp, Artificial Sequence
  Description of Artificial Sequence: Synthetic oligonucleotide
gaaaaaaacaacgccctcagc

SEQ ID NO: 14882 - DNA, 21 bp, Artificial Sequence
  Description of Artificial Sequence: Synthetic oligonucleotide
gggaatgctagggataatact

SEQ ID NO: 14883 - DNA, 21 bp, Artificial Sequence
  Description of Artificial Sequence: Synthetic oligonucleotide
gggacgggggctcggactagt

SEQ ID NO: 14884 - DNA, 21 bp, Artificial Sequence
  Description of Artificial Sequence: Synthetic oligonucleotide
caaaccagcacccccctcgtc

SEQ ID NO: 14885 - DNA, 21 bp, Artificial Sequence
  Description of Artificial Sequence: Synthetic oligonucleotide
atgggtggtaagttgaatggt

SEQ ID NO: 14886 - DNA, 21 bp, Artificial Sequence
  Description of Artificial Sequence: Synthetic oligonucleotide
gggtctggggatatgcgttcg

SEQ ID NO: 14887 - DNA, 21 bp, Artificial Sequence
  Description of Artificial Sequence: Synthetic oligonucleotide
cgtgaggagagtaggagtctt

SEQ ID NO: 14888 - DNA, 21 bp, Artificial Sequence
  Description of Artificial Sequence: Synthetic oligonucleotide
cttagtgataagaaggtgctg

SEQ ID NO: 14889 - DNA, 21 bp, Artificial Sequence
  Description of Artificial Sequence: Synthetic oligonucleotide
gccaccaaaaccagccccgaa

SEQ ID NO: 14890 - DNA, 21 bp, Artificial Sequence
  Description of Artificial Sequence: Synthetic oligonucleotide
accagaagcaccggcaccgcc

SEQ ID NO: 14891 - DNA, 21 bp, Artificial Sequence
  Description of Artificial Sequence: Synthetic oligonucleotide
agcaccgccagagacgtcaac

SEQ ID NO: 14892 - DNA, 21 bp, Artificial Sequence
  Description of Artificial Sequence: Synthetic oligonucleotide
atgggcagcggcaaagccaac

SEQ ID NO: 14893 - DNA, 21 bp, Artificial Sequence
  Description of Artificial Sequence: Synthetic oligonucleotide
ggcggcagcggcgacagagtc

SEQ ID NO: 14894 - DNA, 21 bp, Artificial Sequence
  Description of Artificial Sequence: Synthetic oligonucleotide
tctaatgagcggtctcatgcg

SEQ ID NO: 14895 - DNA, 21 bp, Artificial Sequence
  Description of Artificial Sequence: Synthetic oligonucleotide
accagcagcagaagcacccaa

SEQ ID NO: 14896 - DNA, 21 bp, Artificial Sequence
  Description of Artificial Sequence: Synthetic oligonucleotide
aacggcaacaccgtcagcggc

SEQ ID NO: 14897 - DNA, 21 bp, Artificial Sequence
  Description of Artificial Sequence: Synthetic oligonucleotide
aacgccggcaaaagcgcctac

SEQ ID NO: 14898 - DNA, 21 bp, Artificial Sequence
  Description of Artificial Sequence: Synthetic oligonucleotide
gaggataattctaagtctgct

SEQ ID NO: 14899 - DNA, 21 bp, Artificial Sequence
  Description of Artificial Sequence: Synthetic oligonucleotide
gatgttatttcgaatcctaag

SEQ ID NO: 14900 - DNA, 21 bp, Artificial Sequence
  Description of Artificial Sequence: Synthetic oligonucleotide
gacggcatgagcaaacacgtc

SEQ ID NO: 14901 - DNA, 21 bp, Artificial Sequence
  Description of Artificial Sequence: Synthetic oligonucleotide
aacctcagcagcagcaacaaa

SEQ ID NO: 14902 - DNA, 21 bp, Artificial Sequence
  Description of Artificial Sequence: Synthetic oligonucleotide
gccggcggcagcgccttcaaa

SEQ ID NO: 14903 - DNA, 21 bp, Artificial Sequence
  Description of Artificial Sequence: Synthetic oligonucleotide
tcggataatgcgaagcctagg

SEQ ID NO: 14904 - DNA, 21 bp, Artificial Sequence
  Description of Artificial Sequence: Synthetic oligonucleotide
agcagaaccagccaaggcgtc

SEQ ID NO: 14905 - DNA, 21 bp, Artificial Sequence
  Description of Artificial Sequence: Synthetic oligonucleotide
agtgcggctacgtctgcgagt

SEQ ID NO: 14906 - DNA, 21 bp, Artificial Sequence
  Description of Artificial Sequence: Synthetic oligonucleotide
ctgtctgataagagtgctcgt

SEQ ID NO: 14907 - DNA, 21 bp, Artificial Sequence
  Description of Artificial Sequence: Synthetic oligonucleotide
ggtcggacggattcttctagg

SEQ ID NO: 14908 - DNA, 21 bp, Artificial Sequence
  Description of Artificial Sequence: Synthetic oligonucleotide
tataatgatgcggcttctagg

SEQ ID NO: 14909 - DNA, 21 bp, Artificial Sequence
  Description of Artificial Sequence: Synthetic oligonucleotide
gccggcgccaccagcatcgcc

SEQ ID NO: 14910 - DNA, 21 bp, Artificial Sequence
  Description of Artificial Sequence: Synthetic oligonucleotide
agtcatagttcttcttcgttg

SEQ ID NO: 14911 - DNA, 21 bp, Artificial Sequence
  Description of Artificial Sequence: Synthetic oligonucleotide
tcgggtcgtgagacgggtaag

SEQ ID NO: 14912 - DNA, 21 bp, Artificial Sequence
  Description of Artificial Sequence: Synthetic oligonucleotide
caaggcgcccacaccacccac

SEQ ID NO: 14913 - DNA, 21 bp, Artificial Sequence
  Description of Artificial Sequence: Synthetic oligonucleotide
agcggcagaagccaaagcaac

SEQ ID NO: 14914 - DNA, 21 bp, Artificial Sequence
  Description of Artificial Sequence: Synthetic oligonucleotide
caaggcagcaacaaagtcgaa

SEQ ID NO: 14915 - DNA, 21 bp, Artificial Sequence
  Description of Artificial Sequence: Synthetic oligonucleotide
gaaagcgccggccccggcaaa

SEQ ID NO: 14916 - DNA, 21 bp, Artificial Sequence
  Description of Artificial Sequence: Synthetic oligonucleotide
ggcgacagacaaacccccaaa

SEQ ID NO: 14917 - DNA, 21 bp, Artificial Sequence
  Description of Artificial Sequence: Synthetic oligonucleotide
accagcagcaccagccacagc

SEQ ID NO: 14918 - DNA, 21 bp, Artificial Sequence
  Description of Artificial Sequence: Synthetic oligonucleotide
acccaacccggcaaagccatg

SEQ ID NO: 14919 - DNA, 21 bp, Artificial Sequence
  Description of Artificial Sequence: Synthetic oligonucleotide
gcccaaagcggcacccacacc

SEQ ID NO: 14920 - DNA, 21 bp, Artificial Sequence
  Description of Artificial Sequence: Synthetic oligonucleotide
tcggcttctgataggaagtct

SEQ ID NO: 14921 - DNA, 21 bp, Artificial Sequence
  Description of Artificial Sequence: Synthetic oligonucleotide
tttgcgggtaaggttcaggct

SEQ ID NO: 14922 - DNA, 21 bp, Artificial Sequence
  Description of Artificial Sequence: Synthetic oligonucleotide
aatcatgagagtaaggagcgt

SEQ ID NO: 14923 - DNA, 21 bp, Artificial Sequence
  Description of Artificial Sequence: Synthetic oligonucleotide
agcgccggcagaaccgccgcc

SEQ ID NO: 14924 - DNA, 21 bp, Artificial Sequence
  Description of Artificial Sequence: Synthetic oligonucleotide
ggcatcaaaggccaacaaagc

SEQ ID NO: 14925 - DNA, 21 bp, Artificial Sequence
  Description of Artificial Sequence: Synthetic oligonucleotide
gtcgcccacgacaaagtcctc

SEQ ID NO: 14926 - DNA, 21 bp, Artificial Sequence
  Description of Artificial Sequence: Synthetic oligonucleotide
gcgagttcggggacgaggtct

SEQ ID NO: 14927 - DNA, 21 bp, Artificial Sequence
  Description of Artificial Sequence: Synthetic oligonucleotide
tcgggtagggataagttgatg

SEQ ID NO: 14928 - DNA, 21 bp, Artificial Sequence
  Description of Artificial Sequence: Synthetic oligonucleotide
gccggcgtcaaaagcaacatc

SEQ ID NO: 14929 - DNA, 21 bp, Artificial Sequence
  Description of Artificial Sequence: Synthetic oligonucleotide
catactagtaaggtttctgtt

SEQ ID NO: 14930 - DNA, 21 bp, Artificial Sequence
  Description of Artificial Sequence: Synthetic oligonucleotide
caaggcaacaaacccatcgtc

SEQ ID NO: 14931 - DNA, 21 bp, Artificial Sequence
  Description of Artificial Sequence: Synthetic oligonucleotide
ttggttacgaagacgcaggcg

SEQ ID NO: 14932 - DNA, 21 bp, Artificial Sequence
  Description of Artificial Sequence: Synthetic oligonucleotide
aacagaaccagcagcaccaac

SEQ ID NO: 14933 - DNA, 21 bp, Artificial Sequence
  Description of Artificial Sequence: Synthetic oligonucleotide
actcgtaatacggctgtgagt

SEQ ID NO: 14934 - DNA, 21 bp, Artificial Sequence
  Description of Artificial Sequence: Synthetic oligonucleotide
agccaagaaggcagaggcagc

SEQ ID NO: 14935 - DNA, 21 bp, Artificial Sequence
  Description of Artificial Sequence: Synthetic oligonucleotide
cagtctgctggttctacgtcg

SEQ ID NO: 14936 - DNA, 21 bp, Artificial Sequence
  Description of Artificial Sequence: Synthetic oligonucleotide
gaaggcagcagaagcatcacc

SEQ ID NO: 14937 - DNA, 21 bp, Artificial Sequence
  Description of Artificial Sequence: Synthetic oligonucleotide
gacagaagcaccaaacccgtc

SEQ ID NO: 14938 - DNA, 21 bp, Artificial Sequence
  Description of Artificial Sequence: Synthetic oligonucleotide
agcggcaaaggcaacgtcgcc

SEQ ID NO: 14939 - DNA, 21 bp, Artificial Sequence
  Description of Artificial Sequence: Synthetic oligonucleotide
aacagcgcccccaacggcaaa

SEQ ID NO: 14940 - DNA, 21 bp, Artificial Sequence
  Description of Artificial Sequence: Synthetic oligonucleotide
aaggctgatagttcgactaag

SEQ ID NO: 14941 - DNA, 21 bp, Artificial Sequence
  Description of Artificial Sequence: Synthetic oligonucleotide
accagcgtcggcaaaaccacc

SEQ ID NO: 14942 - DNA, 21 bp, Artificial Sequence
  Description of Artificial Sequence: Synthetic oligonucleotide
agccccagcaaaccccaagaa

SEQ ID NO: 14943 - DNA, 21 bp, Artificial Sequence
  Description of Artificial Sequence: Synthetic oligonucleotide
atgaccagcaaaagcgccgaa

SEQ ID NO: 14944 - DNA, 21 bp, Artificial Sequence
  Description of Artificial Sequence: Synthetic oligonucleotide
cacgacaaacccacccaaggc

SEQ ID NO: 14945 - DNA, 21 bp, Artificial Sequence
  Description of Artificial Sequence: Synthetic oligonucleotide
gaaaacagcaaaggcaacctc

SEQ ID NO: 14946 - DNA, 21 bp, Artificial Sequence
  Description of Artificial Sequence: Synthetic oligonucleotide
gacgtcagagacgtcaacaga

SEQ ID NO: 14947 - DNA, 21 bp, Artificial Sequence
  Description of Artificial Sequence: Synthetic oligonucleotide
gagcggggtcagcatcagact

SEQ ID NO: 14948 - DNA, 21 bp, Artificial Sequence
  Description of Artificial Sequence: Synthetic oligonucleotide
gccaacaaacaacccaccctc

SEQ ID NO: 14949 - DNA, 21 bp, Artificial Sequence
  Description of Artificial Sequence: Synthetic oligonucleotide
ggcgccagcaaaaccctcgtc

SEQ ID NO: 14950 - DNA, 21 bp, Artificial Sequence
  Description of Artificial Sequence: Synthetic oligonucleotide
ggggatggtaagtctcctaag

SEQ ID NO: 14951 - DNA, 21 bp, Artificial Sequence
  Description of Artificial Sequence: Synthetic oligonucleotide
gttgggcagaagtctagtagt

SEQ ID NO: 14952 - DNA, 21 bp, Artificial Sequence
  Description of Artificial Sequence: Synthetic oligonucleotide
accagcagcaccaacatgacc

SEQ ID NO: 14953 - DNA, 21 bp, Artificial Sequence
  Description of Artificial Sequence: Synthetic oligonucleotide
ctcaccaacaaagccaccacc

SEQ ID NO: 14954 - DNA, 21 bp, Artificial Sequence
  Description of Artificial Sequence: Synthetic oligonucleotide
gtccccgacagcaaaagcatg

SEQ ID NO: 14955 - DNA, 21 bp, Artificial Sequence
  Description of Artificial Sequence: Synthetic oligonucleotide
cagaatagtgcggctgtgact

SEQ ID NO: 14956 - DNA, 21 bp, Artificial Sequence
  Description of Artificial Sequence: Synthetic oligonucleotide
acccaagtcggccccagcaaa

SEQ ID NO: 14957 - DNA, 21 bp, Artificial Sequence
  Description of Artificial Sequence: Synthetic oligonucleotide
gtcggcctcaaacccagcgcc

SEQ ID NO: 14958 - DNA, 21 bp, Artificial Sequence
  Description of Artificial Sequence: Synthetic oligonucleotide
gttggttcgggggctcagaag

SEQ ID NO: 14959 - DNA, 21 bp, Artificial Sequence
  Description of Artificial Sequence: Synthetic oligonucleotide
catgggaatcctaatcctcgg

SEQ ID NO: 14960 - DNA, 21 bp, Artificial Sequence
  Description of Artificial Sequence: Synthetic oligonucleotide
ctgaatgggggtgcggctatg

SEQ ID NO: 14961 - DNA, 21 bp, Artificial Sequence
  Description of Artificial Sequence: Synthetic oligonucleotide
gtgtcgggttctactaattct

SEQ ID NO: 14962 - DNA, 21 bp, Artificial Sequence
  Description of Artificial Sequence: Synthetic oligonucleotide
gccagcgacagaagcccccaa

SEQ ID NO: 14963 - DNA, 21 bp, Artificial Sequence
  Description of Artificial Sequence: Synthetic oligonucleotide
tctaatccttcgcgtgaggcg

SEQ ID NO: 14964 - DNA, 21 bp, Artificial Sequence
  Description of Artificial Sequence: Synthetic oligonucleotide
accctcacccaaaaaagcggc

SEQ ID NO: 14965 - DNA, 21 bp, Artificial Sequence
  Description of Artificial Sequence: Synthetic oligonucleotide
gtcagcgaaaaaaacaccaga

SEQ ID NO: 14966 - DNA, 21 bp, Artificial Sequence
  Description of Artificial Sequence: Synthetic oligonucleotide
agtcgtggtaatggtaatgtt

SEQ ID NO: 14967 - DNA, 21 bp, Artificial Sequence
  Description of Artificial Sequence: Synthetic oligonucleotide
gccagcggcgacagccacaga

SEQ ID NO: 14968 - DNA, 21 bp, Artificial Sequence
  Description of Artificial Sequence: Synthetic oligonucleotide
atgggcggcaaacccggcaaa

SEQ ID NO: 14969 - DNA, 21 bp, Artificial Sequence
  Description of Artificial Sequence: Synthetic oligonucleotide
ggcaccagcaacagcgcccac

SEQ ID NO: 14970 - DNA, 21 bp, Artificial Sequence
  Description of Artificial Sequence: Synthetic oligonucleotide
ggcaaaaacaccgtcagcctc

SEQ ID NO: 14971 - DNA, 21 bp, Artificial Sequence
  Description of Artificial Sequence: Synthetic oligonucleotide
tcgggtaatgggaggtcgtct

SEQ ID NO: 14972 - DNA, 21 bp, Artificial Sequence
  Description of Artificial Sequence: Synthetic oligonucleotide
aacggcagcaccagcaccaga

SEQ ID NO: 14973 - DNA, 21 bp, Artificial Sequence
  Description of Artificial Sequence: Synthetic oligonucleotide
aagagtgataagtctgcgtcg

SEQ ID NO: 14974 - DNA, 21 bp, Artificial Sequence
  Description of Artificial Sequence: Synthetic oligonucleotide
gctacgtctaagacgatttct

SEQ ID NO: 14975 - DNA, 21 bp, Artificial Sequence
  Description of Artificial Sequence: Synthetic oligonucleotide
cgtcagagtggtactgcgggt

SEQ ID NO: 14976 - DNA, 21 bp, Artificial Sequence
  Description of Artificial Sequence: Synthetic oligonucleotide
accagaagcgtcggcaacacc

SEQ ID NO: 14977 - DNA, 21 bp, Artificial Sequence
  Description of Artificial Sequence: Synthetic oligonucleotide
caaagcacccaacccagccac

SEQ ID NO: 14978 - DNA, 21 bp, Artificial Sequence
  Description of Artificial Sequence: Synthetic oligonucleotide
catgggggttctggggctggt

SEQ ID NO: 14979 - DNA, 21 bp, Artificial Sequence
  Description of Artificial Sequence: Synthetic oligonucleotide
gccaaagccaccagcagcgtc

SEQ ID NO: 14980 - DNA, 21 bp, Artificial Sequence
  Description of Artificial Sequence: Synthetic oligonucleotide
accaccagcaacgtcaacctc

SEQ ID NO: 14981 - DNA, 21 bp, Artificial Sequence
  Description of Artificial Sequence: Synthetic oligonucleotide
tcggatgctaagcctgttact

SEQ ID NO: 14982 - DNA, 21 bp, Artificial Sequence
  Description of Artificial Sequence: Synthetic oligonucleotide
cttaattcgggtactattcgg

SEQ ID NO: 14983 - DNA, 21 bp, Artificial Sequence
  Description of Artificial Sequence: Synthetic oligonucleotide
tctggtgcggctgcgccggct

SEQ ID NO: 14984 - DNA, 21 bp, Artificial Sequence
  Description of Artificial Sequence: Synthetic oligonucleotide
agttcttcttctaagcagctg

SEQ ID NO: 14985 - DNA, 21 bp, Artificial Sequence
  Description of Artificial Sequence: Synthetic oligonucleotide
tctcgtaatcagtctaatgtt

SEQ ID NO: 14986 - DNA, 21 bp, Artificial Sequence
  Description of Artificial Sequence: Synthetic oligonucleotide
gcgacctcgagtagtgttaag

SEQ ID NO: 14987 - DNA, 21 bp, Artificial Sequence
  Description of Artificial Sequence: Synthetic oligonucleotide
accagaagcggcaccagcggc

SEQ ID NO: 14988 - DNA, 21 bp, Artificial Sequence
  Description of Artificial Sequence: Synthetic oligonucleotide
acgagtctgggtaagccgtct

SEQ ID NO: 14989 - DNA, 21 bp, Artificial Sequence
  Description of Artificial Sequence: Synthetic oligonucleotide
tcttctccgggtaagcctgtt

SEQ ID NO: 14990 - DNA, 21 bp, Artificial Sequence
  Description of Artificial Sequence: Synthetic oligonucleotide
agcagcagcggcgtcagaagc

SEQ ID NO: 14991 - DNA, 21 bp, Artificial Sequence
  Description of Artificial Sequence: Synthetic oligonucleotide
gtctcttcgaagtctgctcat

SEQ ID NO: 14992 - DNA, 21 bp, Artificial Sequence
  Description of Artificial Sequence: Synthetic oligonucleotide
actggtggtaaggataagggt

SEQ ID NO: 14993 - DNA, 21 bp, Artificial Sequence
  Description of Artificial Sequence: Synthetic oligonucleotide
ggcatcagcgccaaacccagc

SEQ ID NO: 14994 - DNA, 21 bp, Artificial Sequence
  Description of Artificial Sequence: Synthetic oligonucleotide
aacagcaacaccgccaccacc

SEQ ID NO: 14995 - DNA, 21 bp, Artificial Sequence
  Description of Artificial Sequence: Synthetic oligonucleotide
accagcggcgccggcgccccc

SEQ ID NO: 14996 - DNA, 21 bp, Artificial Sequence
  Description of Artificial Sequence: Synthetic oligonucleotide
agcgtcagcaacagccaagcc

SEQ ID NO: 14997 - DNA, 21 bp, Artificial Sequence
  Description of Artificial Sequence: Synthetic oligonucleotide
aatatgtcggataagaatggt

SEQ ID NO: 14998 - DNA, 21 bp, Artificial Sequence
  Description of Artificial Sequence: Synthetic oligonucleotide
cgtacttcggggcagactggg

SEQ ID NO: 14999 - DNA, 21 bp, Artificial Sequence
  Description of Artificial Sequence: Synthetic oligonucleotide
gacggcagaggccaaagcggc

SEQ ID NO: 15000 - DNA, 21 bp, Artificial Sequence
  Description of Artificial Sequence: Synthetic oligonucleotide
gcccaacacagcggcaccagc

SEQ ID NO: 15001 - DNA, 21 bp, Artificial Sequence
  Description of Artificial Sequence: Synthetic oligonucleotide
agtacgggtcataataaggag

SEQ ID NO: 15002 - DNA, 21 bp, Artificial Sequence
  Description of Artificial Sequence: Synthetic oligonucleotide
ggcgtcggcgtcacccccaaa

SEQ ID NO: 15003 - DNA, 21 bp, Artificial Sequence
  Description of Artificial Sequence: Synthetic oligonucleotide
acttctgatcggtcgagtatg

SEQ ID NO: 15004 - DNA, 21 bp, Artificial Sequence
  Description of Artificial Sequence: Synthetic oligonucleotide
agaggcaacggccaaagcgcc

SEQ ID NO: 15005 - DNA, 21 bp, Artificial Sequence
  Description of Artificial Sequence: Synthetic oligonucleotide
gccctcggcagcaccagcaaa

SEQ ID NO: 15006 - DNA, 21 bp, Artificial Sequence
  Description of Artificial Sequence: Synthetic oligonucleotide
ttttcgggtggtaaggggcct

SEQ ID NO: 15007 - DNA, 21 bp, Artificial Sequence
  Description of Artificial Sequence: Synthetic oligonucleotide
agcgtcagcgaaagacccagc

SEQ ID NO: 15008 - DNA, 21 bp, Artificial Sequence
  Description of Artificial Sequence: Synthetic oligonucleotide
ggcagcagagaacaccaagcc

SEQ ID NO: 15009 - DNA, 21 bp, Artificial Sequence
  Description of Artificial Sequence: Synthetic oligonucleotide
gggacgaattcgaagcataat

SEQ ID NO: 15010 - DNA, 21 bp, Artificial Sequence
  Description of Artificial Sequence: Synthetic oligonucleotide
ctcaccgccagccccagcaaa

SEQ ID NO: 15011 - DNA, 21 bp, Artificial Sequence
  Description of Artificial Sequence: Synthetic oligonucleotide
gatggtaagaataagccgatg

SEQ ID NO: 15012 - DNA, 21 bp, Artificial Sequence
  Description of Artificial Sequence: Synthetic oligonucleotide
gccgccacccaacccaccagc

SEQ ID NO: 15013 - DNA, 21 bp, Artificial Sequence
  Description of Artificial Sequence: Synthetic oligonucleotide
ggcggcaacagcaaaatggtc

SEQ ID NO: 15014 - DNA, 21 bp, Artificial Sequence
  Description of Artificial Sequence: Synthetic oligonucleotide
gccgtcaacaaaaacatcggc

SEQ ID NO: 15015 - DNA, 21 bp, Artificial Sequence
  Description of Artificial Sequence: Synthetic oligonucleotide
acccacgccgtcaaacccgcc

SEQ ID NO: 15016 - DNA, 21 bp, Artificial Sequence
  Description of Artificial Sequence: Synthetic oligonucleotide
cacaccagcgacagaagcagc

SEQ ID NO: 15017 - DNA, 21 bp, Artificial Sequence
  Description of Artificial Sequence: Synthetic oligonucleotide
ggttcttcgcctacgttgcgg

SEQ ID NO: 15018 - DNA, 21 bp, Artificial Sequence
  Description of Artificial Sequence: Synthetic oligonucleotide
ctccaacccggcaaaccccaa

SEQ ID NO: 15019 - DNA, 21 bp, Artificial Sequence
  Description of Artificial Sequence: Synthetic oligonucleotide
agcaccagcagacccgtcacc

SEQ ID NO: 15020 - DNA, 21 bp, Artificial Sequence
  Description of Artificial Sequence: Synthetic oligonucleotide
gctatgcgttcgccgacgtct

SEQ ID NO: 15021 - DNA, 21 bp, Artificial Sequence
  Description of Artificial Sequence: Synthetic oligonucleotide
aatgggtctagggattctagg

SEQ ID NO: 15022 - DNA, 21 bp, Artificial Sequence
  Description of Artificial Sequence: Synthetic oligonucleotide
agcagcgcccaaggcagcaaa

SEQ ID NO: 15023 - DNA, 21 bp, Artificial Sequence
  Description of Artificial Sequence: Synthetic oligonucleotide
agcgccaacagcgccaccaga

SEQ ID NO: 15024 - DNA, 21 bp, Artificial Sequence
  Description of Artificial Sequence: Synthetic oligonucleotide
agtaatgggggtcagcgtgct

SEQ ID NO: 15025 - DNA, 21 bp, Artificial Sequence
  Description of Artificial Sequence: Synthetic oligonucleotide
ggtagttcgagtaagggggtg

SEQ ID NO: 15026 - DNA, 21 bp, Artificial Sequence
  Description of Artificial Sequence: Synthetic oligonucleotide
gtcgtcagcaaaggcaacatg

SEQ ID NO: 15027 - DNA, 21 bp, Artificial Sequence
  Description of Artificial Sequence: Synthetic oligonucleotide
gataatggtaataagctttat

SEQ ID NO: 15028 - DNA, 21 bp, Artificial Sequence
  Description of Artificial Sequence: Synthetic oligonucleotide
gacagagcccaaaccgtcaga

SEQ ID NO: 15029 - DNA, 21 bp, Artificial Sequence
  Description of Artificial Sequence: Synthetic oligonucleotide
agccacaacagcagccacacc

SEQ ID NO: 15030 - DNA, 21 bp, Artificial Sequence
  Description of Artificial Sequence: Synthetic oligonucleotide
cacaaaaacagccaacaactc

SEQ ID NO: 15031 - DNA, 21 bp, Artificial Sequence
  Description of Artificial Sequence: Synthetic oligonucleotide
tctacgtcgaataaggcttct

SEQ ID NO: 15032 - DNA, 21 bp, Artificial Sequence
  Description of Artificial Sequence: Synthetic oligonucleotide
tctgctagtaataagcctcat

SEQ ID NO: 15033 - DNA, 21 bp, Artificial Sequence
  Description of Artificial Sequence: Synthetic oligonucleotide
gccgccaaaggcagccccccc

SEQ ID NO: 15034 - DNA, 21 bp, Artificial Sequence
  Description of Artificial Sequence: Synthetic oligonucleotide
gacaccggcagcggcagaggc

SEQ ID NO: 15035 - DNA, 21 bp, Artificial Sequence
  Description of Artificial Sequence: Synthetic oligonucleotide
caggctgggacggggattact

SEQ ID NO: 15036 - DNA, 21 bp, Artificial Sequence
  Description of Artificial Sequence: Synthetic oligonucleotide
cttggggtgagtagtcctggg

SEQ ID NO: 15037 - DNA, 21 bp, Artificial Sequence
  Description of Artificial Sequence: Synthetic oligonucleotide
gaacccgtcagaagccccacc

SEQ ID NO: 15038 - DNA, 21 bp, Artificial Sequence
  Description of Artificial Sequence: Synthetic oligonucleotide
acgcagactcagaagacgttt

SEQ ID NO: 15039 - DNA, 21 bp, Artificial Sequence
  Description of Artificial Sequence: Synthetic oligonucleotide
tctactaagtctactgcgagt

SEQ ID NO: 15040 - DNA, 21 bp, Artificial Sequence
  Description of Artificial Sequence: Synthetic oligonucleotide
ctcgtcaacagcaaaaacagc

SEQ ID NO: 15041 - DNA, 21 bp, Artificial Sequence
  Description of Artificial Sequence: Synthetic oligonucleotide
tctaggagtacgaaggcggag

SEQ ID NO: 15042 - DNA, 21 bp, Artificial Sequence
  Description of Artificial Sequence: Synthetic oligonucleotide
aacaacagcgtcaaacccatc

SEQ ID NO: 15043 - DNA, 21 bp, Artificial Sequence
  Description of Artificial Sequence: Synthetic oligonucleotide
aattctaataagtctccgtcg

SEQ ID NO: 15044 - DNA, 21 bp, Artificial Sequence
  Description of Artificial Sequence: Synthetic oligonucleotide
actggtgcgagtaagccggct

SEQ ID NO: 15045 - DNA, 21 bp, Artificial Sequence
  Description of Artificial Sequence: Synthetic oligonucleotide
tcgcctatgactccgcatgtt

SEQ ID NO: 15046 - DNA, 21 bp, Artificial Sequence
  Description of Artificial Sequence: Synthetic oligonucleotide
acccccgtccccagcggcggc

SEQ ID NO: 15047 - DNA, 21 bp, Artificial Sequence
  Description of Artificial Sequence: Synthetic oligonucleotide
accgcccaaagccccgtcggc

SEQ ID NO: 15048 - DNA, 21 bp, Artificial Sequence
  Description of Artificial Sequence: Synthetic oligonucleotide
accggcctcaaaggcgaaaaa

SEQ ID NO: 15049 - DNA, 21 bp, Artificial Sequence
  Description of Artificial Sequence: Synthetic oligonucleotide
agaagcaaaaccgacaccaac

SEQ ID NO: 15050 - DNA, 21 bp, Artificial Sequence
  Description of Artificial Sequence: Synthetic oligonucleotide
caggctacgtctaaggtggat

SEQ ID NO: 15051 - DNA, 21 bp, Artificial Sequence
  Description of Artificial Sequence: Synthetic oligonucleotide
cgttcggaggggaaggcgcag

SEQ ID NO: 15052 - DNA, 21 bp, Artificial Sequence
  Description of Artificial Sequence: Synthetic oligonucleotide
gaggcgtctaaggggattagt

SEQ ID NO: 15053 - DNA, 21 bp, Artificial Sequence
  Description of Artificial Sequence: Synthetic oligonucleotide
gatcgggcggatcgtactgtt

SEQ ID NO: 15054 - DNA, 21 bp, Artificial Sequence
  Description of Artificial Sequence: Synthetic oligonucleotide
gctactagtccgaataatcat

SEQ ID NO: 15055 - DNA, 21 bp, Artificial Sequence
  Description of Artificial Sequence: Synthetic oligonucleotide
accaccaacaacgacagacac

SEQ ID NO: 15056 - DNA, 21 bp, Artificial Sequence
  Description of Artificial Sequence: Synthetic oligonucleotide
agcaccaccgtcaaacccaac

SEQ ID NO: 15057 - DNA, 21 bp, Artificial Sequence
  Description of Artificial Sequence: Synthetic oligonucleotide
agaaacagcagccccaccacc

SEQ ID NO: 15058 - DNA, 21 bp, Artificial Sequence
  Description of Artificial Sequence: Synthetic oligonucleotide
tctccgtctcctactctggtg

SEQ ID NO: 15059 - DNA, 21 bp, Artificial Sequence
  Description of Artificial Sequence: Synthetic oligonucleotide
aatatggcgtctaatgcgaag

SEQ ID NO: 15060 - DNA, 21 bp, Artificial Sequence
  Description of Artificial Sequence: Synthetic oligonucleotide
accaaaaacagcaaaaccagc

SEQ ID NO: 15061 - DNA, 21 bp, Artificial Sequence
  Description of Artificial Sequence: Synthetic oligonucleotide
cattctggtcagaagacgccg

SEQ ID NO: 15062 - DNA, 21 bp, Artificial Sequence
  Description of Artificial Sequence: Synthetic oligonucleotide
ggcagccaagcccccgtcaga

SEQ ID NO: 15063 - DNA, 21 bp, Artificial Sequence
  Description of Artificial Sequence: Synthetic oligonucleotide
ggtgattcgcggcctattagt

SEQ ID NO: 15064 - DNA, 21 bp, Artificial Sequence
  Description of Artificial Sequence: Synthetic oligonucleotide
ctcaccaacaaagccgtcatc

SEQ ID NO: 15065 - DNA, 21 bp, Artificial Sequence
  Description of Artificial Sequence: Synthetic oligonucleotide
ggcgtcaacaaagtcaccagc

SEQ ID NO: 15066 - DNA, 21 bp, Artificial Sequence
  Description of Artificial Sequence: Synthetic oligonucleotide
gtcggcagcggcacccccctc

SEQ ID NO: 15067 - DNA, 21 bp, Artificial Sequence
  Description of Artificial Sequence: Synthetic oligonucleotide
agcggcggcaccaccgtcctc

SEQ ID NO: 15068 - DNA, 21 bp, Artificial Sequence
  Description of Artificial Sequence: Synthetic oligonucleotide
gaaagacccagcagcgccagc

SEQ ID NO: 15069 - DNA, 21 bp, Artificial Sequence
  Description of Artificial Sequence: Synthetic oligonucleotide
gatggtcgggaggcgattcgt

SEQ ID NO: 15070 - DNA, 21 bp, Artificial Sequence
  Description of Artificial Sequence: Synthetic oligonucleotide
agcacccaaggcgccgccacc

SEQ ID NO: 15071 - DNA, 21 bp, Artificial Sequence
  Description of Artificial Sequence: Synthetic oligonucleotide
agttctcatgggtcttctggt

SEQ ID NO: 15072 - DNA, 21 bp, Artificial Sequence
  Description of Artificial Sequence: Synthetic oligonucleotide
gtgggtacgtctaagtttcag

SEQ ID NO: 15073 - DNA, 21 bp, Artificial Sequence
  Description of Artificial Sequence: Synthetic oligonucleotide
cacggcagccccaaacccagc

SEQ ID NO: 15074 - DNA, 21 bp, Artificial Sequence
  Description of Artificial Sequence: Synthetic oligonucleotide
aagagtggtgcgggtaattct

SEQ ID NO: 15075 - DNA, 21 bp, Artificial Sequence
  Description of Artificial Sequence: Synthetic oligonucleotide
actaatgataatcctaagcat

SEQ ID NO: 15076 - DNA, 21 bp, Artificial Sequence
  Description of Artificial Sequence: Synthetic oligonucleotide
ctcggcagcggcaaccaacac

SEQ ID NO: 15077 - DNA, 21 bp, Artificial Sequence
  Description of Artificial Sequence: Synthetic oligonucleotide
gacggcagccacagcaccagc

SEQ ID NO: 15078 - DNA, 21 bp, Artificial Sequence
  Description of Artificial Sequence: Synthetic oligonucleotide
gggcaggctggtaaggttaag

SEQ ID NO: 15079 - DNA, 21 bp, Artificial Sequence
  Description of Artificial Sequence: Synthetic oligonucleotide
tctttgacgaagtctactgag

SEQ ID NO: 15080 - DNA, 21 bp, Artificial Sequence
  Description of Artificial Sequence: Synthetic oligonucleotide
acgactcatagtaagcagaat

SEQ ID NO: 15081 - DNA, 21 bp, Artificial Sequence
  Description of Artificial Sequence: Synthetic oligonucleotide
ggcaccaaagcccccagcagc

SEQ ID NO: 15082 - DNA, 21 bp, Artificial Sequence
  Description of Artificial Sequence: Synthetic oligonucleotide
aaccccgtcggccaaaaaagc

SEQ ID NO: 15083 - DNA, 21 bp, Artificial Sequence
  Description of Artificial Sequence: Synthetic oligonucleotide
agtgcgagtaatagtacggcg

SEQ ID NO: 15084 - DNA, 21 bp, Artificial Sequence
  Description of Artificial Sequence: Synthetic oligonucleotide
ctcggcagcaaagccaacgaa

SEQ ID NO: 15085 - DNA, 21 bp, Artificial Sequence
  Description of Artificial Sequence: Synthetic oligonucleotide
gctgcgacggggtctcagggt

SEQ ID NO: 15086 - DNA, 21 bp, Artificial Sequence
  Description of Artificial Sequence: Synthetic oligonucleotide
gggcctgataagtcgaatagg

SEQ ID NO: 15087 - DNA, 21 bp, Artificial Sequence
  Description of Artificial Sequence: Synthetic oligonucleotide
agttctggtagtcagaattcg

SEQ ID NO: 15088 - DNA, 21 bp, Artificial Sequence
  Description of Artificial Sequence: Synthetic oligonucleotide
catgggggttctagtaattct

SEQ ID NO: 15089 - DNA, 21 bp, Artificial Sequence
  Description of Artificial Sequence: Synthetic oligonucleotide
aacggtcctggacagaatcaa

SEQ ID NO: 15090 - DNA, 21 bp, Artificial Sequence
  Description of Artificial Sequence: Synthetic oligonucleotide
ggcaccgtcaccaaaaacgcc

SEQ ID NO: 15091 - DNA, 21 bp, Artificial Sequence
  Description of Artificial Sequence: Synthetic oligonucleotide
ggcagcaccagcgccaacacc

SEQ ID NO: 15092 - DNA, 21 bp, Artificial Sequence
  Description of Artificial Sequence: Synthetic oligonucleotide
tcgggtagtagtaaggttatt

SEQ ID NO: 15093 - DNA, 21 bp, Artificial Sequence
  Description of Artificial Sequence: Synthetic oligonucleotide
atcagaaccggcaaaaccgac

SEQ ID NO: 15094 - DNA, 21 bp, Artificial Sequence
  Description of Artificial Sequence: Synthetic oligonucleotide
catggggtggagaagcgtact

SEQ ID NO: 15095 - DNA, 21 bp, Artificial Sequence
  Description of Artificial Sequence: Synthetic oligonucleotide
acggagacggataaggcgcat

SEQ ID NO: 15096 - DNA, 21 bp, Artificial Sequence
  Description of Artificial Sequence: Synthetic oligonucleotide
gatcgtgctaatagtgctact

SEQ ID NO: 15097 - DNA, 21 bp, Artificial Sequence
  Description of Artificial Sequence: Synthetic oligonucleotide
aaccaaggcgacagaaacttc

SEQ ID NO: 15098 - DNA, 21 bp, Artificial Sequence
  Description of Artificial Sequence: Synthetic oligonucleotide
cggcaggatgctaagactgat

SEQ ID NO: 15099 - DNA, 21 bp, Artificial Sequence
  Description of Artificial Sequence: Synthetic oligonucleotide
agtcggagtactagtaattcc

SEQ ID NO: 15100 - DNA, 21 bp, Artificial Sequence
  Description of Artificial Sequence: Synthetic oligonucleotide
caaggcgtcaacaaagtcggc

SEQ ID NO: 15101 - DNA, 21 bp, Artificial Sequence
  Description of Artificial Sequence: Synthetic oligonucleotide
caggggacgacgaatcatcag

SEQ ID NO: 15102 - DNA, 21 bp, Artificial Sequence
  Description of Artificial Sequence: Synthetic oligonucleotide
cggcagcagacttcgatttcg

SEQ ID NO: 15103 - DNA, 21 bp, Artificial Sequence
  Description of Artificial Sequence: Synthetic oligonucleotide
gacggccaaggcaccaaaatg

SEQ ID NO: 15104 - DNA, 21 bp, Artificial Sequence
  Description of Artificial Sequence: Synthetic oligonucleotide
ggtactaatagtaagaatttg

SEQ ID NO: 15105 - DNA, 21 bp, Artificial Sequence
  Description of Artificial Sequence: Synthetic oligonucleotide
gtcgccgtcgcccccaccaaa

SEQ ID NO: 15106 - DNA, 21 bp, Artificial Sequence
  Description of Artificial Sequence: Synthetic oligonucleotide
tacagcggcaaaagcgtcgtc

SEQ ID NO: 15107 - DNA, 21 bp, Artificial Sequence
  Description of Artificial Sequence: Synthetic oligonucleotide
ttgccttcgcagtctccgcag

SEQ ID NO: 15108 - DNA, 21 bp, Artificial Sequence
  Description of Artificial Sequence: Synthetic oligonucleotide
ggcgacgccagcatgagaagc

SEQ ID NO: 15109 - DNA, 21 bp, Artificial Sequence
  Description of Artificial Sequence: Synthetic oligonucleotide
gtcggcaacagccaaaaactc

SEQ ID NO: 15110 - DNA, 21 bp, Artificial Sequence
  Description of Artificial Sequence: Synthetic oligonucleotide
tggggcaccgccaaacccgcc

SEQ ID NO: 15111 - DNA, 21 bp, Artificial Sequence
  Description of Artificial Sequence: Synthetic oligonucleotide
actcagtcggatagggctcgg

SEQ ID NO: 15112 - DNA, 21 bp, Artificial Sequence
  Description of Artificial Sequence: Synthetic oligonucleotide
gctccggtttctaagacggct

SEQ ID NO: 15113 - DNA, 21 bp, Artificial Sequence
  Description of Artificial Sequence: Synthetic oligonucleotide
gttgggaatcagaataatatt

SEQ ID NO: 15114 - DNA, 21 bp, Artificial Sequence
  Description of Artificial Sequence: Synthetic oligonucleotide
agaggcggcagcggcagcagc

SEQ ID NO: 15115 - DNA, 21 bp, Artificial Sequence
  Description of Artificial Sequence: Synthetic oligonucleotide
gacctcagcggcaaaagaagc

SEQ ID NO: 15116 - DNA, 21 bp, Artificial Sequence
  Description of Artificial Sequence: Synthetic oligonucleotide
gtcgccgtcggcgccgccaaa

SEQ ID NO: 15117 - DNA, 21 bp, Artificial Sequence
  Description of Artificial Sequence: Synthetic oligonucleotide
gtcggccaaagcaccagcaga

SEQ ID NO: 15118 - DNA, 21 bp, Artificial Sequence
  Description of Artificial Sequence: Synthetic oligonucleotide
ttggcggctggggcggggcat

SEQ ID NO: 15119 - DNA, 21 bp, Artificial Sequence
  Description of Artificial Sequence: Synthetic oligonucleotide
acgcaggctaagagtattggg

SEQ ID NO: 15120 - DNA, 21 bp, Artificial Sequence
  Description of Artificial Sequence: Synthetic oligonucleotide
agaaccgacaccaaaatcctc

SEQ ID NO: 15121 - DNA, 21 bp, Artificial Sequence
  Description of Artificial Sequence: Synthetic oligonucleotide
cttaatcataattcgcagggt

SEQ ID NO: 15122 - DNA, 21 bp, Artificial Sequence
  Description of Artificial Sequence: Synthetic oligonucleotide
ggcaccggcagcaccatgaga

SEQ ID NO: 15123 - DNA, 21 bp, Artificial Sequence
  Description of Artificial Sequence: Synthetic oligonucleotide
tctgcgtcttctgggcatagt

SEQ ID NO: 15124 - DNA, 21 bp, Artificial Sequence
  Description of Artificial Sequence: Synthetic oligonucleotide
accaccagcagcaccctcacc

SEQ ID NO: 15125 - DNA, 21 bp, Artificial Sequence
  Description of Artificial Sequence: Synthetic oligonucleotide
ggcaaccacagcggcagccac

SEQ ID NO: 15126 - DNA, 21 bp, Artificial Sequence
  Description of Artificial Sequence: Synthetic oligonucleotide
ggcagcagcagcaaacccgcc

SEQ ID NO: 15127 - DNA, 21 bp, Artificial Sequence
  Description of Artificial Sequence: Synthetic oligonucleotide
ggtgctactcctcctagtaag

SEQ ID NO: 15128 - DNA, 21 bp, Artificial Sequence
  Description of Artificial Sequence: Synthetic oligonucleotide
gttcctcagtctaagccggtt

SEQ ID NO: 15129 - DNA, 21 bp, Artificial Sequence
  Description of Artificial Sequence: Synthetic oligonucleotide
gtgcaggggaagtcgcagctt

SEQ ID NO: 15130 - DNA, 21 bp, Artificial Sequence
  Description of Artificial Sequence: Synthetic oligonucleotide
accggcgaaagaaccgccctc

SEQ ID NO: 15131 - DNA, 21 bp, Artificial Sequence
  Description of Artificial Sequence: Synthetic oligonucleotide
acgggttctggtaaggttgtg

SEQ ID NO: 15132 - DNA, 21 bp, Artificial Sequence
  Description of Artificial Sequence: Synthetic oligonucleotide
agcggcaccacccccatcaga

SEQ ID NO: 15133 - DNA, 21 bp, Artificial Sequence
  Description of Artificial Sequence: Synthetic oligonucleotide
tctcaggatagtcatcgttcg

SEQ ID NO: 15134 - DNA, 21 bp, Artificial Sequence
  Description of Artificial Sequence: Synthetic oligonucleotide
accaacacccaaagcaccctc

SEQ ID NO: 15135 - DNA, 21 bp, Artificial Sequence
  Description of Artificial Sequence: Synthetic oligonucleotide
accatgggcaccaaacccagc

SEQ ID NO: 15136 - DNA, 21 bp, Artificial Sequence
  Description of Artificial Sequence: Synthetic oligonucleotide
agacaaagcgaaaaaacccaa

SEQ ID NO: 15137 - DNA, 21 bp, Artificial Sequence
  Description of Artificial Sequence: Synthetic oligonucleotide
ggcacccaagccagacaaggc

SEQ ID NO: 15138 - DNA, 21 bp, Artificial Sequence
  Description of Artificial Sequence: Synthetic oligonucleotide
gttggtacggatgcttctagg

SEQ ID NO: 15139 - DNA, 21 bp, Artificial Sequence
  Description of Artificial Sequence: Synthetic oligonucleotide
ttggatgataagaaggctggg

SEQ ID NO: 15140 - DNA, 21 bp, Artificial Sequence
  Description of Artificial Sequence: Synthetic oligonucleotide
agcctccccaccgccaacaac

SEQ ID NO: 15141 - DNA, 21 bp, Artificial Sequence
  Description of Artificial Sequence: Synthetic oligonucleotide
accagcggcaaagccggcacc

SEQ ID NO: 15142 - DNA, 21 bp, Artificial Sequence
  Description of Artificial Sequence: Synthetic oligonucleotide
attcaggagactaggagtaat

SEQ ID NO: 15143 - DNA, 21 bp, Artificial Sequence
  Description of Artificial Sequence: Synthetic oligonucleotide
gctaggtctgataagttgcat

SEQ ID NO: 15144 - DNA, 21 bp, Artificial Sequence
  Description of Artificial Sequence: Synthetic oligonucleotide
caggggtcgcagacgcaggtt

SEQ ID NO: 15145 - DNA, 21 bp, Artificial Sequence
  Description of Artificial Sequence: Synthetic oligonucleotide
agcaccgacggcacccaaaga

SEQ ID NO: 15146 - DNA, 21 bp, Artificial Sequence
  Description of Artificial Sequence: Synthetic oligonucleotide
cagacggtgaagggtagtagt

SEQ ID NO: 15147 - DNA, 21 bp, Artificial Sequence
  Description of Artificial Sequence: Synthetic oligonucleotide
caaaaaaccgaccaccccgcc

SEQ ID NO: 15148 - DNA, 21 bp, Artificial Sequence
  Description of Artificial Sequence: Synthetic oligonucleotide
gacaccagacccaacaaagac

SEQ ID NO: 15149 - DNA, 21 bp, Artificial Sequence
  Description of Artificial Sequence: Synthetic oligonucleotide
gtcagaaacgacaaaaccgaa

SEQ ID NO: 15150 - DNA, 21 bp, Artificial Sequence
  Description of Artificial Sequence: Synthetic oligonucleotide
ggtactggtgatatgcggagg

SEQ ID NO: 15151 - DNA, 21 bp, Artificial Sequence
  Description of Artificial Sequence: Synthetic oligonucleotide
ctcggcgacaaaaaagtcgtc

SEQ ID NO: 15152 - DNA, 21 bp, Artificial Sequence
  Description of Artificial Sequence: Synthetic oligonucleotide
agtccgactggtaagactgtg

SEQ ID NO: 15153 - DNA, 21 bp, Artificial Sequence
  Description of Artificial Sequence: Synthetic oligonucleotide
ctccccggcaacagcaccaaa

SEQ ID NO: 15154 - DNA, 21 bp, Artificial Sequence
  Description of Artificial Sequence: Synthetic oligonucleotide
catggtaataagcctatggtg

SEQ ID NO: 15155 - DNA, 21 bp, Artificial Sequence
  Description of Artificial Sequence: Synthetic oligonucleotide
gggaagagtactaatatgcat

SEQ ID NO: 15156 - DNA, 21 bp, Artificial Sequence
  Description of Artificial Sequence: Synthetic oligonucleotide
gaaggcggcagcgtcggcaga

SEQ ID NO: 15157 - DNA, 21 bp, Artificial Sequence
  Description of Artificial Sequence: Synthetic oligonucleotide
aacatcagcacccccagaaac

SEQ ID NO: 15158 - DNA, 21 bp, Artificial Sequence
  Description of Artificial Sequence: Synthetic oligonucleotide
agcgccaacaacagcaccgtc

SEQ ID NO: 15159 - DNA, 21 bp, Artificial Sequence
  Description of Artificial Sequence: Synthetic oligonucleotide
agcgccggccaaggcctcaaa

SEQ ID NO: 15160 - DNA, 21 bp, Artificial Sequence
  Description of Artificial Sequence: Synthetic oligonucleotide
catggtactgctaagagtggt

SEQ ID NO: 15161 - DNA, 21 bp, Artificial Sequence
  Description of Artificial Sequence: Synthetic oligonucleotide
gttgctaataagagttcgggg

SEQ ID NO: 15162 - DNA, 21 bp, Artificial Sequence
  Description of Artificial Sequence: Synthetic oligonucleotide
acgtcggttcctcagcatggt

SEQ ID NO: 15163 - DNA, 21 bp, Artificial Sequence
  Description of Artificial Sequence: Synthetic oligonucleotide
ctcaccgccaaaacccccagc

SEQ ID NO: 15164 - DNA, 21 bp, Artificial Sequence
  Description of Artificial Sequence: Synthetic oligonucleotide
gaagaccacagacccaccgtc

SEQ ID NO: 15165 - DNA, 21 bp, Artificial Sequence
  Description of Artificial Sequence: Synthetic oligonucleotide
ggcaccgccgccagaaccgaa

SEQ ID NO: 15166 - DNA, 21 bp, Artificial Sequence
  Description of Artificial Sequence: Synthetic oligonucleotide
gggatgaatcctagggattcg

SEQ ID NO: 15167 - DNA, 21 bp, Artificial Sequence
  Description of Artificial Sequence: Synthetic oligonucleotide
gtttctgcgcctggtaatacg

SEQ ID NO: 15168 - DNA, 21 bp, Artificial Sequence
  Description of Artificial Sequence: Synthetic oligonucleotide
tcggcggataagacgcagaat

SEQ ID NO: 15169 - DNA, 21 bp, Artificial Sequence
  Description of Artificial Sequence: Synthetic oligonucleotide
accagcgccaacgtcagcagc

SEQ ID NO: 15170 - DNA, 21 bp, Artificial Sequence
  Description of Artificial Sequence: Synthetic oligonucleotide
tgcaccggcaaacccgacagc

SEQ ID NO: 15171 - DNA, 21 bp, Artificial Sequence
  Description of Artificial Sequence: Synthetic oligonucleotide
accagccacaccaccagcaac

SEQ ID NO: 15172 - DNA, 21 bp, Artificial Sequence
  Description of Artificial Sequence: Synthetic oligonucleotide
agcggcatgggcggcaccagc

SEQ ID NO: 15173 - DNA, 21 bp, Artificial Sequence
  Description of Artificial Sequence: Synthetic oligonucleotide
acgcgggagaagagtagtttg

SEQ ID NO: 15174 - DNA, 21 bp, Artificial Sequence
  Description of Artificial Sequence: Synthetic oligonucleotide
agcctcaccagccccgccagc

SEQ ID NO: 15175 - DNA, 21 bp, Artificial Sequence
  Description of Artificial Sequence: Synthetic oligonucleotide
agcggcacccacaaaggccaa

SEQ ID NO: 15176 - DNA, 21 bp, Artificial Sequence
  Description of Artificial Sequence: Synthetic oligonucleotide
atttctggtagtactccgacg

SEQ ID NO: 15177 - DNA, 21 bp, Artificial Sequence
  Description of Artificial Sequence: Synthetic oligonucleotide
cttcggtctaaggagactatt

SEQ ID NO: 15178 - DNA, 21 bp, Artificial Sequence
  Description of Artificial Sequence: Synthetic oligonucleotide
gacgtccccaacaaacacagc

SEQ ID NO: 15179 - DNA, 21 bp, Artificial Sequence
  Description of Artificial Sequence: Synthetic oligonucleotide
gtgaagactgatagggcttct

SEQ ID NO: 15180 - DNA, 21 bp, Artificial Sequence
  Description of Artificial Sequence: Synthetic oligonucleotide
gatgggacgaaggggaagtct

SEQ ID NO: 15181 - DNA, 21 bp, Artificial Sequence
  Description of Artificial Sequence: Synthetic oligonucleotide
gccagcaacggcagcaaacaa

SEQ ID NO: 15182 - DNA, 21 bp, Artificial Sequence
  Description of Artificial Sequence: Synthetic oligonucleotide
gccggcagcagcaaactcagc

SEQ ID NO: 15183 - DNA, 21 bp, Artificial Sequence
  Description of Artificial Sequence: Synthetic oligonucleotide
acgaagggggataagcatgat

SEQ ID NO: 15184 - DNA, 21 bp, Artificial Sequence
  Description of Artificial Sequence: Synthetic oligonucleotide
gatgggaataagaataagctt

SEQ ID NO: 15185 - DNA, 21 bp, Artificial Sequence
  Description of Artificial Sequence: Synthetic oligonucleotide
gcgcgtgggggggatcagccg

SEQ ID NO: 15186 - DNA, 21 bp, Artificial Sequence
  Description of Artificial Sequence: Synthetic oligonucleotide
actactgctgcgaattatcag

SEQ ID NO: 15187 - DNA, 21 bp, Artificial Sequence
  Description of Artificial Sequence: Synthetic oligonucleotide
agcggcgtcggcagcggcctc

SEQ ID NO: 15188 - DNA, 21 bp, Artificial Sequence
  Description of Artificial Sequence: Synthetic oligonucleotide
aattgtagtaagtcgaattgt

SEQ ID NO: 15189 - DNA, 21 bp, Artificial Sequence
  Description of Artificial Sequence: Synthetic oligonucleotide
agcagaaacggcagccccgtc

SEQ ID NO: 15190 - DNA, 21 bp, Artificial Sequence
  Description of Artificial Sequence: Synthetic oligonucleotide
agcgaaaaaaaaaacagcctc

SEQ ID NO: 15191 - DNA, 21 bp, Artificial Sequence
  Description of Artificial Sequence: Synthetic oligonucleotide
ggggcgacgtctgagaggcgt

SEQ ID NO: 15192 - DNA, 21 bp, Artificial Sequence
  Description of Artificial Sequence: Synthetic oligonucleotide
acgacggggaagcattcgcag

SEQ ID NO: 15193 - DNA, 21 bp, Artificial Sequence
  Description of Artificial Sequence: Synthetic oligonucleotide
aggcatggggagtctacgact

SEQ ID NO: 15194 - DNA, 21 bp, Artificial Sequence
  Description of Artificial Sequence: Synthetic oligonucleotide
aacaccaacaaacccatgagc

SEQ ID NO: 15195 - DNA, 21 bp, Artificial Sequence
  Description of Artificial Sequence: Synthetic oligonucleotide
atgggcgacaaacccaccaga

SEQ ID NO: 15196 - DNA, 21 bp, Artificial Sequence
  Description of Artificial Sequence: Synthetic oligonucleotide
tctaatcagacgccgacgagg

SEQ ID NO: 15197 - DNA, 21 bp, Artificial Sequence
  Description of Artificial Sequence: Synthetic oligonucleotide
atgtctggtcattctcaggct

SEQ ID NO: 15198 - DNA, 21 bp, Artificial Sequence
  Description of Artificial Sequence: Synthetic oligonucleotide
caaggcgtcgacagcagaagc

SEQ ID NO: 15199 - DNA, 21 bp, Artificial Sequence
  Description of Artificial Sequence: Synthetic oligonucleotide
agtggtggtagtagtagggtg

SEQ ID NO: 15200 - DNA, 21 bp, Artificial Sequence
  Description of Artificial Sequence: Synthetic oligonucleotide
acccccggcggccaccaagcc

SEQ ID NO: 15201 - DNA, 21 bp, Artificial Sequence
  Description of Artificial Sequence: Synthetic oligonucleotide
actggtcgtgattctattcag

SEQ ID NO: 15202 - DNA, 21 bp, Artificial Sequence
  Description of Artificial Sequence: Synthetic oligonucleotide
cgtgatggtacgcctcgtgat

SEQ ID NO: 15203 - DNA, 21 bp, Artificial Sequence
  Description of Artificial Sequence: Synthetic oligonucleotide
accgcccccgccgccggcagc

SEQ ID NO: 15204 - DNA, 21 bp, Artificial Sequence
  Description of Artificial Sequence: Synthetic oligonucleotide
actcttggggagcatagtcgt

SEQ ID NO: 15205 - DNA, 21 bp, Artificial Sequence
  Description of Artificial Sequence: Synthetic oligonucleotide
cagaataatgctcctgcgcat

SEQ ID NO: 15206 - DNA, 21 bp, Artificial Sequence
  Description of Artificial Sequence: Synthetic oligonucleotide
gaaggcagcagcagcctcacc

SEQ ID NO: 15207 - DNA, 21 bp, Artificial Sequence
  Description of Artificial Sequence: Synthetic oligonucleotide
tcgggtaagcctaatgagcgt

SEQ ID NO: 15208 - DNA, 21 bp, Artificial Sequence
  Description of Artificial Sequence: Synthetic oligonucleotide
aatcagtctacttctgctaag

SEQ ID NO: 15209 - DNA, 21 bp, Artificial Sequence
  Description of Artificial Sequence: Synthetic oligonucleotide
accggcaaaaacgaaaacctc

SEQ ID NO: 15210 - DNA, 21 bp, Artificial Sequence
  Description of Artificial Sequence: Synthetic oligonucleotide
gacagcgccagcagcagcaga

SEQ ID NO: 15211 - DNA, 21 bp, Artificial Sequence
  Description of Artificial Sequence: Synthetic oligonucleotide
aattcgacgcgtgaggcggct

SEQ ID NO: 15212 - DNA, 21 bp, Artificial Sequence
  Description of Artificial Sequence: Synthetic oligonucleotide
agtgctacgagtcggccggtt

SEQ ID NO: 15213 - DNA, 21 bp, Artificial Sequence
  Description of Artificial Sequence: Synthetic oligonucleotide
gctggtcagactgcttcgact

SEQ ID NO: 15214 - DNA, 21 bp, Artificial Sequence
  Description of Artificial Sequence: Synthetic oligonucleotide
tctcctgatcgttctagtagt

SEQ ID NO: 15215 - DNA, 21 bp, Artificial Sequence
  Description of Artificial Sequence: Synthetic oligonucleotide
aacgaagccagagccacccaa

SEQ ID NO: 15216 - DNA, 21 bp, Artificial Sequence
  Description of Artificial Sequence: Synthetic oligonucleotide
accgtcggcggcagaggcagc

SEQ ID NO: 15217 - DNA, 21 bp, Artificial Sequence
  Description of Artificial Sequence: Synthetic oligonucleotide
agcaccctccccccccaaaaa

SEQ ID NO: 15218 - DNA, 21 bp, Artificial Sequence
  Description of Artificial Sequence: Synthetic oligonucleotide
gaaaacaacagcggccccaga

SEQ ID NO: 15219 - DNA, 21 bp, Artificial Sequence
  Description of Artificial Sequence: Synthetic oligonucleotide
gccccccccagcagcggcaaa

SEQ ID NO: 15220 - DNA, 21 bp, Artificial Sequence
  Description of Artificial Sequence: Synthetic oligonucleotide
tcgagtaattctgcttcgtct

SEQ ID NO: 15221 - DNA, 21 bp, Artificial Sequence
  Description of Artificial Sequence: Synthetic oligonucleotide
agcatcgccaccgcccaaaaa

SEQ ID NO: 15222 - DNA, 21 bp, Artificial Sequence
  Description of Artificial Sequence: Synthetic oligonucleotide
gacaaatgcagcggctgcgcc

SEQ ID NO: 15223 - DNA, 21 bp, Artificial Sequence
  Description of Artificial Sequence: Synthetic oligonucleotide
aataataatgtgcctgtgcag

SEQ ID NO: 15224 - DNA, 21 bp, Artificial Sequence
  Description of Artificial Sequence: Synthetic oligonucleotide
agacaagacgtcagcaacggc

SEQ ID NO: 15225 - DNA, 21 bp, Artificial Sequence
  Description of Artificial Sequence: Synthetic oligonucleotide
agcagagaaaaaggcagcaac

SEQ ID NO: 15226 - DNA, 21 bp, Artificial Sequence
  Description of Artificial Sequence: Synthetic oligonucleotide
agtggtgttaattctagtggg

SEQ ID NO: 15227 - DNA, 21 bp, Artificial Sequence
  Description of Artificial Sequence: Synthetic oligonucleotide
gtcagcagcccccccaacaga

SEQ ID NO: 15228 - DNA, 21 bp, Artificial Sequence
  Description of Artificial Sequence: Synthetic oligonucleotide
ttcaccggcagcaacagcacc

SEQ ID NO: 15229 - DNA, 21 bp, Artificial Sequence
  Description of Artificial Sequence: Synthetic oligonucleotide
gccagcaccagcggcatgcac

SEQ ID NO: 15230 - DNA, 21 bp, Artificial Sequence
  Description of Artificial Sequence: Synthetic oligonucleotide
agcagaaccagcagcaacgtc

SEQ ID NO: 15231 - DNA, 21 bp, Artificial Sequence
  Description of Artificial Sequence: Synthetic oligonucleotide
cagactggttctgctacggct

SEQ ID NO: 15232 - DNA, 21 bp, Artificial Sequence
  Description of Artificial Sequence: Synthetic oligonucleotide
gaaagcgtcggcaaaagcgcc

SEQ ID NO: 15233 - DNA, 21 bp, Artificial Sequence
  Description of Artificial Sequence: Synthetic oligonucleotide
gacggcagccaaagacccaaa

SEQ ID NO: 15234 - DNA, 21 bp, Artificial Sequence
  Description of Artificial Sequence: Synthetic oligonucleotide
caaggcaacgaaggccacatc

SEQ ID NO: 15235 - DNA, 21 bp, Artificial Sequence
  Description of Artificial Sequence: Synthetic oligonucleotide
ctcgccctcggcggcaaaggc

SEQ ID NO: 15236 - DNA, 21 bp, Artificial Sequence
  Description of Artificial Sequence: Synthetic oligonucleotide
tctaattcgagtaagttgaat

SEQ ID NO: 15237 - DNA, 21 bp, Artificial Sequence
  Description of Artificial Sequence: Synthetic oligonucleotide
ctgtcgaatcagcctaaggat

SEQ ID NO: 15238 - DNA, 21 bp, Artificial Sequence
  Description of Artificial Sequence: Synthetic oligonucleotide
agcggcggcggccaagcccac

SEQ ID NO: 15239 - DNA, 21 bp, Artificial Sequence
  Description of Artificial Sequence: Synthetic oligonucleotide
agtgctaattctgggcattcg

SEQ ID NO: 15240 - DNA, 21 bp, Artificial Sequence
  Description of Artificial Sequence: Synthetic oligonucleotide
ggcagcgccaaaaccagcaac

SEQ ID NO: 15241 - DNA, 21 bp, Artificial Sequence
  Description of Artificial Sequence: Synthetic oligonucleotide
caaagcagcaaacccaacatc

SEQ ID NO: 15242 - DNA, 21 bp, Artificial Sequence
  Description of Artificial Sequence: Synthetic oligonucleotide
tcgggtgcgaatacgttgcat

SEQ ID NO: 15243 - DNA, 21 bp, Artificial Sequence
  Description of Artificial Sequence: Synthetic oligonucleotide
ggcagacaaaacagcgcccaa

SEQ ID NO: 15244 - DNA, 21 bp, Artificial Sequence
  Description of Artificial Sequence: Synthetic oligonucleotide
aaaggcgccgacagacaaagc

SEQ ID NO: 15245 - DNA, 21 bp, Artificial Sequence
  Description of Artificial Sequence: Synthetic oligonucleotide
accgacggcagcggcaacaaa

SEQ ID NO: 15246 - DNA, 21 bp, Artificial Sequence
  Description of Artificial Sequence: Synthetic oligonucleotide
accaaagacaaccacagcagc

SEQ ID NO: 15247 - DNA, 21 bp, Artificial Sequence
  Description of Artificial Sequence: Synthetic oligonucleotide
actgttagtaagtctactatg

SEQ ID NO: 15248 - DNA, 21 bp, Artificial Sequence
  Description of Artificial Sequence: Synthetic oligonucleotide
tctggtactcctcgtaatgct

SEQ ID NO: 15249 - DNA, 21 bp, Artificial Sequence
  Description of Artificial Sequence: Synthetic oligonucleotide
caaagcaccagccccagcctc

SEQ ID NO: 15250 - DNA, 21 bp, Artificial Sequence
  Description of Artificial Sequence: Synthetic oligonucleotide
catggtaacagtactcttcag

SEQ ID NO: 15251 - DNA, 21 bp, Artificial Sequence
  Description of Artificial Sequence: Synthetic oligonucleotide
ggcaccgccaaacaattcgcc

SEQ ID NO: 15252 - DNA, 21 bp, Artificial Sequence
  Description of Artificial Sequence: Synthetic oligonucleotide
aaccaaacccccgccctcggc

SEQ ID NO: 15253 - DNA, 21 bp, Artificial Sequence
  Description of Artificial Sequence: Synthetic oligonucleotide
accagaaccgacagcagcagc

SEQ ID NO: 15254 - DNA, 21 bp, Artificial Sequence
  Description of Artificial Sequence: Synthetic oligonucleotide
actagtagtaatgttcctggg

SEQ ID NO: 15255 - DNA, 21 bp, Artificial Sequence
  Description of Artificial Sequence: Synthetic oligonucleotide
agcatcgacagcgcccacaga

SEQ ID NO: 15256 - DNA, 21 bp, Artificial Sequence
  Description of Artificial Sequence: Synthetic oligonucleotide
agcggcagcaccaaaggcacc

SEQ ID NO: 15257 - DNA, 21 bp, Artificial Sequence
  Description of Artificial Sequence: Synthetic oligonucleotide
cacagcaacaccaccagcaac

SEQ ID NO: 15258 - DNA, 21 bp, Artificial Sequence
  Description of Artificial Sequence: Synthetic oligonucleotide
cagattaatagtaagtcgacg

SEQ ID NO: 15259 - DNA, 21 bp, Artificial Sequence
  Description of Artificial Sequence: Synthetic oligonucleotide
gaaaccgtcaaaaaaagcagc

SEQ ID NO: 15260 - DNA, 21 bp, Artificial Sequence
  Description of Artificial Sequence: Synthetic oligonucleotide
gacggcgtcaacaaaatgaga

SEQ ID NO: 15261 - DNA, 21 bp, Artificial Sequence
  Description of Artificial Sequence: Synthetic oligonucleotide
gccaacagcgtccccaacacc

SEQ ID NO: 15262 - DNA, 21 bp, Artificial Sequence
  Description of Artificial Sequence: Synthetic oligonucleotide
ggcagccaaagcggcaaagtc

SEQ ID NO: 15263 - DNA, 21 bp, Artificial Sequence
  Description of Artificial Sequence: Synthetic oligonucleotide
tctacttctcaggctgggaat

SEQ ID NO: 15264 - DNA, 21 bp, Artificial Sequence
  Description of Artificial Sequence: Synthetic oligonucleotide
tctcctggtaagggtttggtg

SEQ ID NO: 15265 - DNA, 21 bp, Artificial Sequence
  Description of Artificial Sequence: Synthetic oligonucleotide
ttcagaaccgaaagcgtcgcc

SEQ ID NO: 15266 - DNA, 21 bp, Artificial Sequence
  Description of Artificial Sequence: Synthetic oligonucleotide
gacagacaacacaccaacatc

SEQ ID NO: 15267 - DNA, 21 bp, Artificial Sequence
  Description of Artificial Sequence: Synthetic oligonucleotide
acccaagccaaagtcagcggc

SEQ ID NO: 15268 - DNA, 21 bp, Artificial Sequence
  Description of Artificial Sequence: Synthetic oligonucleotide
tcttcgggtcatggggcgagt

SEQ ID NO: 15269 - DNA, 21 bp, Artificial Sequence
  Description of Artificial Sequence: Synthetic oligonucleotide
aatggtagtactaagattact

SEQ ID NO: 15270 - DNA, 21 bp, Artificial Sequence
  Description of Artificial Sequence: Synthetic oligonucleotide
gaaggccaccccagaaccagc

SEQ ID NO: 15271 - DNA, 21 bp, Artificial Sequence
  Description of Artificial Sequence: Synthetic oligonucleotide
tcgccgagtacgaatcgggag

SEQ ID NO: 15272 - DNA, 21 bp, Artificial Sequence
  Description of Artificial Sequence: Synthetic oligonucleotide
aatactggtcgtgatcctcgt

SEQ ID NO: 15273 - DNA, 21 bp, Artificial Sequence
  Description of Artificial Sequence: Synthetic oligonucleotide
agcagcagcgccggcagcctc

SEQ ID NO: 15274 - DNA, 21 bp, Artificial Sequence
  Description of Artificial Sequence: Synthetic oligonucleotide
catacgagtaaggttgcgcat

SEQ ID NO: 15275 - DNA, 21 bp, Artificial Sequence
  Description of Artificial Sequence: Synthetic oligonucleotide
ctcaacccccacggcagcggc

SEQ ID NO: 15276 - DNA, 21 bp, Artificial Sequence
  Description of Artificial Sequence: Synthetic oligonucleotide
gtccccaacaacggccaaaaa

SEQ ID NO: 15277 - DNA, 21 bp, Artificial Sequence
  Description of Artificial Sequence: Synthetic oligonucleotide
gcccaacccgccggcaaaatc

SEQ ID NO: 15278 - DNA, 21 bp, Artificial Sequence
  Description of Artificial Sequence: Synthetic oligonucleotide
gggactaaggggtcgaatacg

SEQ ID NO: 15279 - DNA, 21 bp, Artificial Sequence
  Description of Artificial Sequence: Synthetic oligonucleotide
accaacggcccccaaaccaaa

SEQ ID NO: 15280 - DNA, 21 bp, Artificial Sequence
  Description of Artificial Sequence: Synthetic oligonucleotide
acgatttcggataagagtttg

SEQ ID NO: 15281 - DNA, 21 bp, Artificial Sequence
  Description of Artificial Sequence: Synthetic oligonucleotide
agtacgggggctgggggtcag

SEQ ID NO: 15282 - DNA, 21 bp, Artificial Sequence
  Description of Artificial Sequence: Synthetic oligonucleotide
agcgccggcaacaacaacaga

SEQ ID NO: 15283 - DNA, 21 bp, Artificial Sequence
  Description of Artificial Sequence: Synthetic oligonucleotide
gcccaaggcaaccccgccaaa

SEQ ID NO: 15284 - DNA, 21 bp, Artificial Sequence
  Description of Artificial Sequence: Synthetic oligonucleotide
gctattaatgagaaggcggtg

SEQ ID NO: 15285 - DNA, 21 bp, Artificial Sequence
  Description of Artificial Sequence: Synthetic oligonucleotide
atcggcagcaccacccaaagc

SEQ ID NO: 15286 - DNA, 21 bp, Artificial Sequence
  Description of Artificial Sequence: Synthetic oligonucleotide
gatgggcgggtttctcagggt

SEQ ID NO: 15287 - DNA, 21 bp, Artificial Sequence
  Description of Artificial Sequence: Synthetic oligonucleotide
gctacgggtgcgactcctcgg

SEQ ID NO: 15288 - DNA, 21 bp, Artificial Sequence
  Description of Artificial Sequence: Synthetic oligonucleotide
gtcagcagcaaaaaaaccgaa

SEQ ID NO: 15289 - DNA, 21 bp, Artificial Sequence
  Description of Artificial Sequence: Synthetic oligonucleotide
atggcgtctaagacttctcag

SEQ ID NO: 15290 - DNA, 21 bp, Artificial Sequence
  Description of Artificial Sequence: Synthetic oligonucleotide
gggaggcagcagcagtctggg

SEQ ID NO: 15291 - DNA, 21 bp, Artificial Sequence
  Description of Artificial Sequence: Synthetic oligonucleotide
actgcgaatgcttctcattct

SEQ ID NO: 15292 - DNA, 21 bp, Artificial Sequence
  Description of Artificial Sequence: Synthetic oligonucleotide
ggtggtgtgtcttcgaatact

SEQ ID NO: 15293 - DNA, 21 bp, Artificial Sequence
  Description of Artificial Sequence: Synthetic oligonucleotide
aacagccaaggcagcaccctc

SEQ ID NO: 15294 - DNA, 21 bp, Artificial Sequence
  Description of Artificial Sequence: Synthetic oligonucleotide
aacaccggcagcggcctcaaa

SEQ ID NO: 15295 - DNA, 21 bp, Artificial Sequence
  Description of Artificial Sequence: Synthetic oligonucleotide
cgttcggctagtcctcctgtt

SEQ ID NO: 15296 - DNA, 21 bp, Artificial Sequence
  Description of Artificial Sequence: Synthetic oligonucleotide
gaaagcggcgacagagtcaaa

SEQ ID NO: 15297 - DNA, 21 bp, Artificial Sequence
  Description of Artificial Sequence: Synthetic oligonucleotide
gctggtaatcagagtactggg

SEQ ID NO: 15298 - DNA, 21 bp, Artificial Sequence
  Description of Artificial Sequence: Synthetic oligonucleotide
tcgttgacgaagaatggtgct

SEQ ID NO: 15299 - DNA, 21 bp, Artificial Sequence
  Description of Artificial Sequence: Synthetic oligonucleotide
agtcctggtaagggggcgagt

SEQ ID NO: 15300 - DNA, 21 bp, Artificial Sequence
  Description of Artificial Sequence: Synthetic oligonucleotide
tctaatgtgaattcgatgaag

SEQ ID NO: 15301 - DNA, 21 bp, Artificial Sequence
  Description of Artificial Sequence: Synthetic oligonucleotide
aagcaggcgggggcgatggag

SEQ ID NO: 15302 - DNA, 21 bp, Artificial Sequence
  Description of Artificial Sequence: Synthetic oligonucleotide
cttagtagtggttctatgggt

SEQ ID NO: 15303 - DNA, 21 bp, Artificial Sequence
  Description of Artificial Sequence: Synthetic oligonucleotide
gccctcaacagcaaaaccaac

SEQ ID NO: 15304 - DNA, 21 bp, Artificial Sequence
  Description of Artificial Sequence: Synthetic oligonucleotide
ggcgtcgaaagcagacaaaaa

SEQ ID NO: 15305 - DNA, 21 bp, Artificial Sequence
  Description of Artificial Sequence: Synthetic oligonucleotide
accggcagaacccccgccgtc

SEQ ID NO: 15306 - DNA, 21 bp, Artificial Sequence
  Description of Artificial Sequence: Synthetic oligonucleotide
gattcgaataatgctaatcgt

SEQ ID NO: 15307 - DNA, 21 bp, Artificial Sequence
  Description of Artificial Sequence: Synthetic oligonucleotide
aaaagcaacagcgccatcacc

SEQ ID NO: 15308 - DNA, 21 bp, Artificial Sequence
  Description of Artificial Sequence: Synthetic oligonucleotide
atgactggtggtgcgggtagt

SEQ ID NO: 15309 - DNA, 21 bp, Artificial Sequence
  Description of Artificial Sequence: Synthetic oligonucleotide
tcggtggagcataagggtggt

SEQ ID NO: 15310 - DNA, 21 bp, Artificial Sequence
  Description of Artificial Sequence: Synthetic oligonucleotide
tctaatggtcgggcgaatgcg

SEQ ID NO: 15311 - DNA, 21 bp, Artificial Sequence
  Description of Artificial Sequence: Synthetic oligonucleotide
ggcaacagcagcagcaaaagc

SEQ ID NO: 15312 - DNA, 21 bp, Artificial Sequence
  Description of Artificial Sequence: Synthetic oligonucleotide
agccaaaccaccaaaaccagc

SEQ ID NO: 15313 - DNA, 21 bp, Artificial Sequence
  Description of Artificial Sequence: Synthetic oligonucleotide
ctcaccagccaaaaacccgcc

SEQ ID NO: 15314 - DNA, 21 bp, Artificial Sequence
  Description of Artificial Sequence: Synthetic oligonucleotide
gaaaccgaaagcagagccgcc

SEQ ID NO: 15315 - DNA, 21 bp, Artificial Sequence
  Description of Artificial Sequence: Synthetic oligonucleotide
ggcgtccccagcagcaccaaa

SEQ ID NO: 15316 - DNA, 21 bp, Artificial Sequence
  Description of Artificial Sequence: Synthetic oligonucleotide
cagggtccttctaagggttcg

SEQ ID NO: 15317 - DNA, 21 bp, Artificial Sequence
  Description of Artificial Sequence: Synthetic oligonucleotide
ctgagtgggtcttctaatttg

SEQ ID NO: 15318 - DNA, 21 bp, Artificial Sequence
  Description of Artificial Sequence: Synthetic oligonucleotide
gtcaccgacaccccccaccaa

SEQ ID NO: 15319 - DNA, 21 bp, Artificial Sequence
  Description of Artificial Sequence: Synthetic oligonucleotide
ttgactggttcgaattcgaag

SEQ ID NO: 15320 - DNA, 21 bp, Artificial Sequence
  Description of Artificial Sequence: Synthetic oligonucleotide
actatttcgagtacgccttcg

SEQ ID NO: 15321 - DNA, 21 bp, Artificial Sequence
  Description of Artificial Sequence: Synthetic oligonucleotide
aatcctggtggttcgaagctt

SEQ ID NO: 15322 - DNA, 21 bp, Artificial Sequence
  Description of Artificial Sequence: Synthetic oligonucleotide
acccaagaacacaaaagcacc

SEQ ID NO: 15323 - DNA, 21 bp, Artificial Sequence
  Description of Artificial Sequence: Synthetic oligonucleotide
gataaggttccgcatggtgtt

SEQ ID NO: 15324 - DNA, 21 bp, Artificial Sequence
  Description of Artificial Sequence: Synthetic oligonucleotide
gtggggagtcggccggataag

SEQ ID NO: 15325 - DNA, 21 bp, Artificial Sequence
  Description of Artificial Sequence: Synthetic oligonucleotide
ggtacggctggtggtcagagt

SEQ ID NO: 15326 - DNA, 21 bp, Artificial Sequence
  Description of Artificial Sequence: Synthetic oligonucleotide
cagtcggagcgtacgcctacg

SEQ ID NO: 15327 - DNA, 21 bp, Artificial Sequence
  Description of Artificial Sequence: Synthetic oligonucleotide
gccaacgccgcccccctcaaa

SEQ ID NO: 15328 - DNA, 21 bp, Artificial Sequence
  Description of Artificial Sequence: Synthetic oligonucleotide
aatcatagtacttcggcgcct

SEQ ID NO: 15329 - DNA, 21 bp, Artificial Sequence
  Description of Artificial Sequence: Synthetic oligonucleotide
acggtttctggtagtactaag

SEQ ID NO: 15330 - DNA, 21 bp, Artificial Sequence
  Description of Artificial Sequence: Synthetic oligonucleotide
gccagcagccccatcaacaaa

SEQ ID NO: 15331 - DNA, 21 bp, Artificial Sequence
  Description of Artificial Sequence: Synthetic oligonucleotide
gggacgtcgggtaagtcgatg

SEQ ID NO: 15332 - DNA, 21 bp, Artificial Sequence
  Description of Artificial Sequence: Synthetic oligonucleotide
ctcgccaacgtccccacccaa

SEQ ID NO: 15333 - DNA, 21 bp, Artificial Sequence
  Description of Artificial Sequence: Synthetic oligonucleotide
agtcaggctgctagtcctagg

SEQ ID NO: 15334 - DNA, 21 bp, Artificial Sequence
  Description of Artificial Sequence: Synthetic oligonucleotide
agtgttgataagaataatagg

SEQ ID NO: 15335 - DNA, 21 bp, Artificial Sequence
  Description of Artificial Sequence: Synthetic oligonucleotide
ggcagcgacagaaaaagcgaa

SEQ ID NO: 15336 - DNA, 21 bp, Artificial Sequence
  Description of Artificial Sequence: Synthetic oligonucleotide
accagcaccagcagacccaac

SEQ ID NO: 15337 - DNA, 21 bp, Artificial Sequence
  Description of Artificial Sequence: Synthetic oligonucleotide
caaggcagcggcaaaatgagc

SEQ ID NO: 15338 - DNA, 21 bp, Artificial Sequence
  Description of Artificial Sequence: Synthetic oligonucleotide
gacaccagaagcgccaaccaa

SEQ ID NO: 15339 - DNA, 21 bp, Artificial Sequence
  Description of Artificial Sequence: Synthetic oligonucleotide
aagactggtcagtcttctagt

SEQ ID NO: 15340 - DNA, 21 bp, Artificial Sequence
  Description of Artificial Sequence: Synthetic oligonucleotide
gggcgtgataagacggtttct

SEQ ID NO: 15341 - DNA, 21 bp, Artificial Sequence
  Description of Artificial Sequence: Synthetic oligonucleotide
ggtctgtctgagcataaggtg

SEQ ID NO: 15342 - DNA, 21 bp, Artificial Sequence
  Description of Artificial Sequence: Synthetic oligonucleotide
actacgaatactaaggatagg

SEQ ID NO: 15343 - DNA, 21 bp, Artificial Sequence
  Description of Artificial Sequence: Synthetic oligonucleotide
gagaggccgggtccggctaag

SEQ ID NO: 15344 - DNA, 21 bp, Artificial Sequence
  Description of Artificial Sequence: Synthetic oligonucleotide
ggggcggggccttcgcctacg

SEQ ID NO: 15345 - DNA, 21 bp, Artificial Sequence
  Description of Artificial Sequence: Synthetic oligonucleotide
gaaagagacggcaaaaacttc

SEQ ID NO: 15346 - DNA, 21 bp, Artificial Sequence
  Description of Artificial Sequence: Synthetic oligonucleotide
agcgccgacagagaaaacaga

SEQ ID NO: 15347 - DNA, 21 bp, Artificial Sequence
  Description of Artificial Sequence: Synthetic oligonucleotide
gacagcaacagaggcagcgcc

SEQ ID NO: 15348 - DNA, 21 bp, Artificial Sequence
  Description of Artificial Sequence: Synthetic oligonucleotide
gctttgaagaattctaatcag

SEQ ID NO: 15349 - DNA, 21 bp, Artificial Sequence
  Description of Artificial Sequence: Synthetic oligonucleotide
ctgaatagtggtaagcttagt

SEQ ID NO: 15350 - DNA, 21 bp, Artificial Sequence
  Description of Artificial Sequence: Synthetic oligonucleotide
ggccaacacaacgccaccacc

SEQ ID NO: 15351 - DNA, 21 bp, Artificial Sequence
  Description of Artificial Sequence: Synthetic oligonucleotide
ctcgtcggcagcaaaagcgaa

SEQ ID NO: 15352 - DNA, 21 bp, Artificial Sequence
  Description of Artificial Sequence: Synthetic oligonucleotide
gccaccgtcagcaaaaccgcc

SEQ ID NO: 15353 - DNA, 21 bp, Artificial Sequence
  Description of Artificial Sequence: Synthetic oligonucleotide
gctcggactgggtcttctact

SEQ ID NO: 15354 - DNA, 21 bp, Artificial Sequence
  Description of Artificial Sequence: Synthetic oligonucleotide
acccaacacaaagacaaaccc

SEQ ID NO: 15355 - DNA, 21 bp, Artificial Sequence
  Description of Artificial Sequence: Synthetic oligonucleotide
accccccacaccgccaacaaa

SEQ ID NO: 15356 - DNA, 21 bp, Artificial Sequence
  Description of Artificial Sequence: Synthetic oligonucleotide
agcggcaccaaagcccacgac

SEQ ID NO: 15357 - DNA, 21 bp, Artificial Sequence
  Description of Artificial Sequence: Synthetic oligonucleotide
agcggcagcaacagcagagac

SEQ ID NO: 15358 - DNA, 21 bp, Artificial Sequence
  Description of Artificial Sequence: Synthetic oligonucleotide
atgagggttgataagcagatt

SEQ ID NO: 15359 - DNA, 21 bp, Artificial Sequence
  Description of Artificial Sequence: Synthetic oligonucleotide
attcctcggcagcagccgggt

SEQ ID NO: 15360 - DNA, 21 bp, Artificial Sequence
  Description of Artificial Sequence: Synthetic oligonucleotide
tctccgtcgagtcagggtggg

SEQ ID NO: 15361 - DNA, 21 bp, Artificial Sequence
  Description of Artificial Sequence: Synthetic oligonucleotide
tctcctgggggtcgtgattct

SEQ ID NO: 15362 - DNA, 21 bp, Artificial Sequence
  Description of Artificial Sequence: Synthetic oligonucleotide
gctacggggtctggtagtcgg

SEQ ID NO: 15363 - DNA, 21 bp, Artificial Sequence
  Description of Artificial Sequence: Synthetic oligonucleotide
gggaggtcggatacgccttct

SEQ ID NO: 15364 - DNA, 21 bp, Artificial Sequence
  Description of Artificial Sequence: Synthetic oligonucleotide
agaggcagcagcaccagcacc

SEQ ID NO: 15365 - DNA, 21 bp, Artificial Sequence
  Description of Artificial Sequence: Synthetic oligonucleotide
ggcagactcagcagcgaaaaa

SEQ ID NO: 15366 - DNA, 21 bp, Artificial Sequence
  Description of Artificial Sequence: Synthetic oligonucleotide
gccgtcggcaccacccccagc

SEQ ID NO: 15367 - DNA, 21 bp, Artificial Sequence
  Description of Artificial Sequence: Synthetic oligonucleotide
gcccccagcatgagcggcaaa

SEQ ID NO: 15368 - DNA, 21 bp, Artificial Sequence
  Description of Artificial Sequence: Synthetic oligonucleotide
aacggcaacggccccggcaaa

SEQ ID NO: 15369 - DNA, 21 bp, Artificial Sequence
  Description of Artificial Sequence: Synthetic oligonucleotide
accagcgacgccagacccagc

SEQ ID NO: 15370 - DNA, 21 bp, Artificial Sequence
  Description of Artificial Sequence: Synthetic oligonucleotide
acccccgaaagagtcggcggc

SEQ ID NO: 15371 - DNA, 21 bp, Artificial Sequence
  Description of Artificial Sequence: Synthetic oligonucleotide
agttcggctacgaagagtatt

SEQ ID NO: 15372 - DNA, 21 bp, Artificial Sequence
  Description of Artificial Sequence: Synthetic oligonucleotide
gccggcaacagcgacaaaaga

SEQ ID NO: 15373 - DNA, 21 bp, Artificial Sequence
  Description of Artificial Sequence: Synthetic oligonucleotide
aatcctgtggctcggtcggag

SEQ ID NO: 15374 - DNA, 21 bp, Artificial Sequence
  Description of Artificial Sequence: Synthetic oligonucleotide
accagagacgccagcgtccac

SEQ ID NO: 15375 - DNA, 21 bp, Artificial Sequence
  Description of Artificial Sequence: Synthetic oligonucleotide
aatccgagtactccgaagggt

SEQ ID NO: 15376 - DNA, 21 bp, Artificial Sequence
  Description of Artificial Sequence: Synthetic oligonucleotide
actgggaaggggtcttcgggt

SEQ ID NO: 15377 - DNA, 21 bp, Artificial Sequence
  Description of Artificial Sequence: Synthetic oligonucleotide
cagggtgctactgggaatcgt

SEQ ID NO: 15378 - DNA, 21 bp, Artificial Sequence
  Description of Artificial Sequence: Synthetic oligonucleotide
tctgttagggagaagcctgcg

SEQ ID NO: 15379 - DNA, 21 bp, Artificial Sequence
  Description of Artificial Sequence: Synthetic oligonucleotide
accaccaaaaccaccgccagc

SEQ ID NO: 15380 - DNA, 21 bp, Artificial Sequence
  Description of Artificial Sequence: Synthetic oligonucleotide
accggcgacagaagcaacacc

SEQ ID NO: 15381 - DNA, 21 bp, Artificial Sequence
  Description of Artificial Sequence: Synthetic oligonucleotide
catgttgggagtaagagtggg

SEQ ID NO: 15382 - DNA, 21 bp, Artificial Sequence
  Description of Artificial Sequence: Synthetic oligonucleotide
gcgacgtctaagccgactact

SEQ ID NO: 15383 - DNA, 21 bp, Artificial Sequence
  Description of Artificial Sequence: Synthetic oligonucleotide
tatgctaatgggaaggttggt

SEQ ID NO: 15384 - DNA, 21 bp, Artificial Sequence
  Description of Artificial Sequence: Synthetic oligonucleotide
ctggcttcttcgcatagtact

SEQ ID NO: 15385 - DNA, 21 bp, Artificial Sequence
  Description of Artificial Sequence: Synthetic oligonucleotide
gcgggttctgatcatacgcgg

SEQ ID NO: 15386 - DNA, 21 bp, Artificial Sequence
  Description of Artificial Sequence: Synthetic oligonucleotide
gtccccgaaaaaggcaccctc

SEQ ID NO: 15387 - DNA, 21 bp, Artificial Sequence
  Description of Artificial Sequence: Synthetic oligonucleotide
agtgctggtgggggggcgtcg

SEQ ID NO: 15388 - DNA, 21 bp, Artificial Sequence
  Description of Artificial Sequence: Synthetic oligonucleotide
ggcaccgccgccagagacgtc

SEQ ID NO: 15389 - DNA, 21 bp, Artificial Sequence
  Description of Artificial Sequence: Synthetic oligonucleotide
caaggcagcgaaagaagcaga

SEQ ID NO: 15390 - DNA, 21 bp, Artificial Sequence
  Description of Artificial Sequence: Synthetic oligonucleotide
cagagtaaggcttctcaggtt

SEQ ID NO: 15391 - DNA, 21 bp, Artificial Sequence
  Description of Artificial Sequence: Synthetic oligonucleotide
cggcagggtgaggttcagtct

SEQ ID NO: 15392 - DNA, 21 bp, Artificial Sequence
  Description of Artificial Sequence: Synthetic oligonucleotide
gacagaagccccggcgcccaa

SEQ ID NO: 15393 - DNA, 21 bp, Artificial Sequence
  Description of Artificial Sequence: Synthetic oligonucleotide
ctcagcgccaccaaaaccccc

SEQ ID NO: 15394 - DNA, 21 bp, Artificial Sequence
  Description of Artificial Sequence: Synthetic oligonucleotide
aagcagggtagtggtctgtct

SEQ ID NO: 15395 - DNA, 21 bp, Artificial Sequence
  Description of Artificial Sequence: Synthetic oligonucleotide
aattctactcctactgttagg

SEQ ID NO: 15396 - DNA, 21 bp, Artificial Sequence
  Description of Artificial Sequence: Synthetic oligonucleotide
actacgggtaaggagaagaat

SEQ ID NO: 15397 - DNA, 21 bp, Artificial Sequence
  Description of Artificial Sequence: Synthetic oligonucleotide
acttcttctaagtcgcctact

SEQ ID NO: 15398 - DNA, 21 bp, Artificial Sequence
  Description of Artificial Sequence: Synthetic oligonucleotide
agacaaggccaagccaccgcc

SEQ ID NO: 15399 - DNA, 21 bp, Artificial Sequence
  Description of Artificial Sequence: Synthetic oligonucleotide
agcctcggccaacccggcagc

SEQ ID NO: 15400 - DNA, 21 bp, Artificial Sequence
  Description of Artificial Sequence: Synthetic oligonucleotide
agcgccggcgacagcagaaac

SEQ ID NO: 15401 - DNA, 21 bp, Artificial Sequence
  Description of Artificial Sequence: Synthetic oligonucleotide
cagcctagtgggggtaatact

SEQ ID NO: 15402 - DNA, 21 bp, Artificial Sequence
  Description of Artificial Sequence: Synthetic oligonucleotide
gatcctggtccttctagttct

SEQ ID NO: 15403 - DNA, 21 bp, Artificial Sequence
  Description of Artificial Sequence: Synthetic oligonucleotide
gccgccaccgaaaaaggcaga

SEQ ID NO: 15404 - DNA, 21 bp, Artificial Sequence
  Description of Artificial Sequence: Synthetic oligonucleotide
tcgtcggggacgttggggtcg

SEQ ID NO: 15405 - DNA, 21 bp, Artificial Sequence
  Description of Artificial Sequence: Synthetic oligonucleotide
tcgtctagtccgtcgcttaag

SEQ ID NO: 15406 - DNA, 21 bp, Artificial Sequence
  Description of Artificial Sequence: Synthetic oligonucleotide
ttcgaaggcagcggcgccaaa

SEQ ID NO: 15407 - DNA, 21 bp, Artificial Sequence
  Description of Artificial Sequence: Synthetic oligonucleotide
gacagcggcagacccaccacc

SEQ ID NO: 15408 - DNA, 21 bp, Artificial Sequence
  Description of Artificial Sequence: Synthetic oligonucleotide
catgcttctgcgtctcctact

SEQ ID NO: 15409 - DNA, 21 bp, Artificial Sequence
  Description of Artificial Sequence: Synthetic oligonucleotide
gatactcgtaaggcgtctgct

SEQ ID NO: 15410 - DNA, 21 bp, Artificial Sequence
  Description of Artificial Sequence: Synthetic oligonucleotide
agccaaggcgtcaaccccccc

SEQ ID NO: 15411 - DNA, 21 bp, Artificial Sequence
  Description of Artificial Sequence: Synthetic oligonucleotide
gtccaaaacagcggcggcaac

SEQ ID NO: 15412 - DNA, 21 bp, Artificial Sequence
  Description of Artificial Sequence: Synthetic oligonucleotide
tctcttccggatcataagacg

SEQ ID NO: 15413 - DNA, 21 bp, Artificial Sequence
  Description of Artificial Sequence: Synthetic oligonucleotide
gatactactaatgggaatgtg

SEQ ID NO: 15414 - DNA, 21 bp, Artificial Sequence
  Description of Artificial Sequence: Synthetic oligonucleotide
ggcaaaaaccaaagcagcatg

SEQ ID NO: 15415 - DNA, 21 bp, Artificial Sequence
  Description of Artificial Sequence: Synthetic oligonucleotide
agcagaagcaccagccccagc

SEQ ID NO: 15416 - DNA, 21 bp, Artificial Sequence
  Description of Artificial Sequence: Synthetic oligonucleotide
agcaacagcggcggcagcaaa

SEQ ID NO: 15417 - DNA, 21 bp, Artificial Sequence
  Description of Artificial Sequence: Synthetic oligonucleotide
gaggggcatacgaagatgctt

SEQ ID NO: 15418 - DNA, 21 bp, Artificial Sequence
  Description of Artificial Sequence: Synthetic oligonucleotide
gctgcgggtagtactgtgcat

SEQ ID NO: 15419 - DNA, 21 bp, Artificial Sequence
  Description of Artificial Sequence: Synthetic oligonucleotide
gtccaagccgccaacagccaa

SEQ ID NO: 15420 - DNA, 21 bp, Artificial Sequence
  Description of Artificial Sequence: Synthetic oligonucleotide
acggtgggtaaggggttgcag

SEQ ID NO: 15421 - DNA, 21 bp, Artificial Sequence
  Description of Artificial Sequence: Synthetic oligonucleotide
agcggcgccgtcaaacccaac

SEQ ID NO: 15422 - DNA, 21 bp, Artificial Sequence
  Description of Artificial Sequence: Synthetic oligonucleotide
gacagaacccccacccacacc

SEQ ID NO: 15423 - DNA, 21 bp, Artificial Sequence
  Description of Artificial Sequence: Synthetic oligonucleotide
ggtgggagtcgtgagcagtct

SEQ ID NO: 15424 - DNA, 21 bp, Artificial Sequence
  Description of Artificial Sequence: Synthetic oligonucleotide
gggaagacgggtactcatatg

SEQ ID NO: 15425 - DNA, 21 bp, Artificial Sequence
  Description of Artificial Sequence: Synthetic oligonucleotide
acgactagttcgagttcgatg

SEQ ID NO: 15426 - DNA, 21 bp, Artificial Sequence
  Description of Artificial Sequence: Synthetic oligonucleotide
agcagaagcacccaagccgaa

SEQ ID NO: 15427 - DNA, 21 bp, Artificial Sequence
  Description of Artificial Sequence: Synthetic oligonucleotide
cagacgagtgggaagcctatg

SEQ ID NO: 15428 - DNA, 21 bp, Artificial Sequence
  Description of Artificial Sequence: Synthetic oligonucleotide
tctggttctgggaatggttcg

SEQ ID NO: 15429 - DNA, 21 bp, Artificial Sequence
  Description of Artificial Sequence: Synthetic oligonucleotide
aacgccgtcaaaccctacagc

SEQ ID NO: 15430 - DNA, 21 bp, Artificial Sequence
  Description of Artificial Sequence: Synthetic oligonucleotide
agcagcggccaaagaaccagc

SEQ ID NO: 15431 - DNA, 21 bp, Artificial Sequence
  Description of Artificial Sequence: Synthetic oligonucleotide
gccggcaaccaccccgccacc

SEQ ID NO: 15432 - DNA, 21 bp, Artificial Sequence
  Description of Artificial Sequence: Synthetic oligonucleotide
cattctagggagtctcagcag

SEQ ID NO: 15433 - DNA, 21 bp, Artificial Sequence
  Description of Artificial Sequence: Synthetic oligonucleotide
tctcgtactgataggcctatt

SEQ ID NO: 15434 - DNA, 21 bp, Artificial Sequence
  Description of Artificial Sequence: Synthetic oligonucleotide
atgggcagcagcaaaaccacc

SEQ ID NO: 15435 - DNA, 21 bp, Artificial Sequence
  Description of Artificial Sequence: Synthetic oligonucleotide
cttcagactaattctacggct

SEQ ID NO: 15436 - DNA, 21 bp, Artificial Sequence
  Description of Artificial Sequence: Synthetic oligonucleotide
gattctccgccttctaagcat

SEQ ID NO: 15437 - DNA, 21 bp, Artificial Sequence
  Description of Artificial Sequence: Synthetic oligonucleotide
accggcgtcaccaaacccagc

SEQ ID NO: 15438 - DNA, 21 bp, Artificial Sequence
  Description of Artificial Sequence: Synthetic oligonucleotide
agcctcaccaacagcagaagc

SEQ ID NO: 15439 - DNA, 21 bp, Artificial Sequence
  Description of Artificial Sequence: Synthetic oligonucleotide
ggccccagcccccccaccacc

SEQ ID NO: 15440 - DNA, 21 bp, Artificial Sequence
  Description of Artificial Sequence: Synthetic oligonucleotide
aagagtggggctaatactgtt

SEQ ID NO: 15441 - DNA, 21 bp, Artificial Sequence
  Description of Artificial Sequence: Synthetic oligonucleotide
cgtaattctgaggggcctaag

SEQ ID NO: 15442 - DNA, 21 bp, Artificial Sequence
  Description of Artificial Sequence: Synthetic oligonucleotide
tctactaagagtgtgtcgact

SEQ ID NO: 15443 - DNA, 21 bp, Artificial Sequence
  Description of Artificial Sequence: Synthetic oligonucleotide
agcaaccacagccccaacgtc

SEQ ID NO: 15444 - DNA, 21 bp, Artificial Sequence
  Description of Artificial Sequence: Synthetic oligonucleotide
agcagcgtccaaaaacaacaa

SEQ ID NO: 15445 - DNA, 21 bp, Artificial Sequence
  Description of Artificial Sequence: Synthetic oligonucleotide
agcggcagaggcagcaacagc

SEQ ID NO: 15446 - DNA, 21 bp, Artificial Sequence
  Description of Artificial Sequence: Synthetic oligonucleotide
atggacaaccaaaaagccaga

SEQ ID NO: 15447 - DNA, 21 bp, Artificial Sequence
  Description of Artificial Sequence: Synthetic oligonucleotide
ctcgccagcggcagcagaagc

SEQ ID NO: 15448 - DNA, 21 bp, Artificial Sequence
  Description of Artificial Sequence: Synthetic oligonucleotide
gaccaaaacggcagcagactc

SEQ ID NO: 15449 - DNA, 21 bp, Artificial Sequence
  Description of Artificial Sequence: Synthetic oligonucleotide
gagacaactcgtcctactacg

SEQ ID NO: 15450 - DNA, 21 bp, Artificial Sequence
  Description of Artificial Sequence: Synthetic oligonucleotide
ggtagtttgggtacgggtaat

SEQ ID NO: 15451 - DNA, 21 bp, Artificial Sequence
  Description of Artificial Sequence: Synthetic oligonucleotide
actggtacgagtactgcgact

SEQ ID NO: 15452 - DNA, 21 bp, Artificial Sequence
  Description of Artificial Sequence: Synthetic oligonucleotide
aacagcggcagacccagcacc

SEQ ID NO: 15453 - DNA, 21 bp, Artificial Sequence
  Description of Artificial Sequence: Synthetic oligonucleotide
acgcagctgggtgcgccgaag

SEQ ID NO: 15454 - DNA, 21 bp, Artificial Sequence
  Description of Artificial Sequence: Synthetic oligonucleotide
cagcagcgtcagagtacgggt

SEQ ID NO: 15455 - DNA, 21 bp, Artificial Sequence
  Description of Artificial Sequence: Synthetic oligonucleotide
gccaccggcatccccagcacc

SEQ ID NO: 15456 - DNA, 21 bp, Artificial Sequence
  Description of Artificial Sequence: Synthetic oligonucleotide
gggcagtcgcagccttttaag

SEQ ID NO: 15457 - DNA, 21 bp, Artificial Sequence
  Description of Artificial Sequence: Synthetic oligonucleotide
gtcgccgccaaaggcagcagc

SEQ ID NO: 15458 - DNA, 21 bp, Artificial Sequence
  Description of Artificial Sequence: Synthetic oligonucleotide
gccgtcagcaaaagcaccatc

SEQ ID NO: 15459 - DNA, 21 bp, Artificial Sequence
  Description of Artificial Sequence: Synthetic oligonucleotide
atgagcagccaaggcggcagc

SEQ ID NO: 15460 - DNA, 21 bp, Artificial Sequence
  Description of Artificial Sequence: Synthetic oligonucleotide
cagcattcgggttcgagtact

SEQ ID NO: 15461 - DNA, 21 bp, Artificial Sequence
  Description of Artificial Sequence: Synthetic oligonucleotide
catactgatcttaagactacg

SEQ ID NO: 15462 - DNA, 21 bp, Artificial Sequence
  Description of Artificial Sequence: Synthetic oligonucleotide
gcggtggagggttcgaagaat

SEQ ID NO: 15463 - DNA, 21 bp, Artificial Sequence
  Description of Artificial Sequence: Synthetic oligonucleotide
gctcggtctgggaataatatt

SEQ ID NO: 15464 - DNA, 21 bp, Artificial Sequence
  Description of Artificial Sequence: Synthetic oligonucleotide
gggccgggggctccttcgaag

SEQ ID NO: 15465 - DNA, 21 bp, Artificial Sequence
  Description of Artificial Sequence: Synthetic oligonucleotide
tcggctgctgatccgaaggtg

SEQ ID NO: 15466 - DNA, 21 bp, Artificial Sequence
  Description of Artificial Sequence: Synthetic oligonucleotide
tctcatgggactgagaataag

SEQ ID NO: 15467 - DNA, 21 bp, Artificial Sequence
  Description of Artificial Sequence: Synthetic oligonucleotide
tctcctgttagtgggacgacg

SEQ ID NO: 15468 - DNA, 21 bp, Artificial Sequence
  Description of Artificial Sequence: Synthetic oligonucleotide
gtcaacaccagcaacaccacc

SEQ ID NO: 15469 - DNA, 21 bp, Artificial Sequence
  Description of Artificial Sequence: Synthetic oligonucleotide
agcagcaccagcggcgccggc

SEQ ID NO: 15470 - DNA, 21 bp, Artificial Sequence
  Description of Artificial Sequence: Synthetic oligonucleotide
ggcacccccagcaaagccggc

SEQ ID NO: 15471 - DNA, 21 bp, Artificial Sequence
  Description of Artificial Sequence: Synthetic oligonucleotide
gacaaaaccaccgccggccaa

SEQ ID NO: 15472 - DNA, 21 bp, Artificial Sequence
  Description of Artificial Sequence: Synthetic oligonucleotide
accaccggcggccacagcagc

SEQ ID NO: 15473 - DNA, 21 bp, Artificial Sequence
  Description of Artificial Sequence: Synthetic oligonucleotide
ggcgccagcaacagcaccggc

SEQ ID NO: 15474 - DNA, 21 bp, Artificial Sequence
  Description of Artificial Sequence: Synthetic oligonucleotide
gccatcaacggcaaagccggc

SEQ ID NO: 15475 - DNA, 21 bp, Artificial Sequence
  Description of Artificial Sequence: Synthetic oligonucleotide
gtcatcgacaccaaagccggc

SEQ ID NO: 15476 - DNA, 21 bp, Artificial Sequence
  Description of Artificial Sequence: Synthetic oligonucleotide
aacgccagcagcagcaccggc

SEQ ID NO: 15477 - DNA, 21 bp, Artificial Sequence
  Description of Artificial Sequence: Synthetic oligonucleotide
ggtacgagtagtccggctaat

SEQ ID NO: 15478 - DNA, 21 bp, Artificial Sequence
  Description of Artificial Sequence: Synthetic oligonucleotide
ggccccggcgacaccagaagc

SEQ ID NO: 15479 - DNA, 21 bp, Artificial Sequence
  Description of Artificial Sequence: Synthetic oligonucleotide
gggaatgggtcgtcggcgctg

SEQ ID NO: 15480 - DNA, 21 bp, Artificial Sequence
  Description of Artificial Sequence: Synthetic oligonucleotide
ggcagaagcggcggcaccggc

SEQ ID NO: 15481 - DNA, 21 bp, Artificial Sequence
  Description of Artificial Sequence: Synthetic oligonucleotide
agcaccggccccacccccgcc

SEQ ID NO: 15482 - DNA, 21 bp, Artificial Sequence
  Description of Artificial Sequence: Synthetic oligonucleotide
catggggggagggattctagt

SEQ ID NO: 15483 - DNA, 21 bp, Artificial Sequence
  Description of Artificial Sequence: Synthetic oligonucleotide
ggttctggtacgcctaatggg

SEQ ID NO: 15484 - DNA, 21 bp, Artificial Sequence
  Description of Artificial Sequence: Synthetic oligonucleotide
ggcaaagccggcagcaccggc

SEQ ID NO: 15485 - DNA, 21 bp, Artificial Sequence
  Description of Artificial Sequence: Synthetic oligonucleotide
cttagtgcgggtaagggtgag

SEQ ID NO: 15486 - DNA, 21 bp, Artificial Sequence
  Description of Artificial Sequence: Synthetic oligonucleotide
gtcggcatccccagcgccggc

SEQ ID NO: 15487 - DNA, 21 bp, Artificial Sequence
  Description of Artificial Sequence: Synthetic oligonucleotide
agtggtgggcagaaggataat

SEQ ID NO: 15488 - DNA, 21 bp, Artificial Sequence
  Description of Artificial Sequence: Synthetic oligonucleotide
gaaaccggcggcagccccaaa

SEQ ID NO: 15489 - DNA, 21 bp, Artificial Sequence
  Description of Artificial Sequence: Synthetic oligonucleotide
caaggccacaccaacgtcgcc

SEQ ID NO: 15490 - DNA, 21 bp, Artificial Sequence
  Description of Artificial Sequence: Synthetic oligonucleotide
tcgcatgggagtccggctagt

SEQ ID NO: 15491 - DNA, 21 bp, Artificial Sequence
  Description of Artificial Sequence: Synthetic oligonucleotide
agccaaaaaagcgtcgccggc

SEQ ID NO: 15492 - DNA, 21 bp, Artificial Sequence
  Description of Artificial Sequence: Synthetic oligonucleotide
gttggtcagtctgctgctcag

SEQ ID NO: 15493 - DNA, 21 bp, Artificial Sequence
  Description of Artificial Sequence: Synthetic oligonucleotide
gacggccaaagcagcaaaagc

SEQ ID NO: 15494 - DNA, 21 bp, Artificial Sequence
  Description of Artificial Sequence: Synthetic oligonucleotide
gcccaagccaaacccgccggc

SEQ ID NO: 15495 - DNA, 21 bp, Artificial Sequence
  Description of Artificial Sequence: Synthetic oligonucleotide
accggccacaacagcagcatg

SEQ ID NO: 15496 - DNA, 21 bp, Artificial Sequence
  Description of Artificial Sequence: Synthetic oligonucleotide
ggccaaagcaccagcagcggc

SEQ ID NO: 15497 - DNA, 21 bp, Artificial Sequence
  Description of Artificial Sequence: Synthetic oligonucleotide
accggcatcagcggcgccggc

SEQ ID NO: 15498 - DNA, 21 bp, Artificial Sequence
  Description of Artificial Sequence: Synthetic oligonucleotide
gtcagagacaccagcagcagc

SEQ ID NO: 15499 - DNA, 21 bp, Artificial Sequence
  Description of Artificial Sequence: Synthetic oligonucleotide
gtcagcagcaaaggcctcgcc

SEQ ID NO: 15500 - DNA, 21 bp, Artificial Sequence
  Description of Artificial Sequence: Synthetic oligonucleotide
gatggtcggtcgactagtgct

SEQ ID NO: 15501 - DNA, 21 bp, Artificial Sequence
  Description of Artificial Sequence: Synthetic oligonucleotide
agcagcaacaccggccacacc

SEQ ID NO: 15502 - DNA, 21 bp, Artificial Sequence
  Description of Artificial Sequence: Synthetic oligonucleotide
cagaataattctaagacggag

SEQ ID NO: 15503 - DNA, 21 bp, Artificial Sequence
  Description of Artificial Sequence: Synthetic oligonucleotide
caggaggggtcttcgtctaag

SEQ ID NO: 15504 - DNA, 21 bp, Artificial Sequence
  Description of Artificial Sequence: Synthetic oligonucleotide
aacaccaaaaccaccaccggc

SEQ ID NO: 15505 - DNA, 21 bp, Artificial Sequence
  Description of Artificial Sequence: Synthetic oligonucleotide
gccagcaacagcggcagcacc

SEQ ID NO: 15506 - DNA, 21 bp, Artificial Sequence
  Description of Artificial Sequence: Synthetic oligonucleotide
ctgggtggtgggaaggagtcg

SEQ ID NO: 15507 - DNA, 21 bp, Artificial Sequence
  Description of Artificial Sequence: Synthetic oligonucleotide
gggaatgggaagagtgatggt

SEQ ID NO: 15508 - DNA, 21 bp, Artificial Sequence
  Description of Artificial Sequence: Synthetic oligonucleotide
tcggaggctaatcagaagctt

SEQ ID NO: 15509 - DNA, 21 bp, Artificial Sequence
  Description of Artificial Sequence: Synthetic oligonucleotide
gccagcagccccagcggcggc

SEQ ID NO: 15510 - DNA, 21 bp, Artificial Sequence
  Description of Artificial Sequence: Synthetic oligonucleotide
gatacgggtaaggcgtcgatg

SEQ ID NO: 15511 - DNA, 21 bp, Artificial Sequence
  Description of Artificial Sequence: Synthetic oligonucleotide
gagacttcgaaggagagggct

SEQ ID NO: 15512 - DNA, 21 bp, Artificial Sequence
  Description of Artificial Sequence: Synthetic oligonucleotide
ggcggcggccacaaagaaagc

SEQ ID NO: 15513 - DNA, 21 bp, Artificial Sequence
  Description of Artificial Sequence: Synthetic oligonucleotide
gacaacggcaccaaagtcatc

SEQ ID NO: 15514 - DNA, 21 bp, Artificial Sequence
  Description of Artificial Sequence: Synthetic oligonucleotide
caggtggggaaggatagtcat

SEQ ID NO: 15515 - DNA, 21 bp, Artificial Sequence
  Description of Artificial Sequence: Synthetic oligonucleotide
accaccagcgccaccagcgtc

SEQ ID NO: 15516 - DNA, 21 bp, Artificial Sequence
  Description of Artificial Sequence: Synthetic oligonucleotide
caggctactggtgggacgcag

SEQ ID NO: 15517 - DNA, 21 bp, Artificial Sequence
  Description of Artificial Sequence: Synthetic oligonucleotide
gagtctgggaagggtagtttg

SEQ ID NO: 15518 - DNA, 21 bp, Artificial Sequence
  Description of Artificial Sequence: Synthetic oligonucleotide
gaaaacagcagcggccacgcc

SEQ ID NO: 15519 - DNA, 21 bp, Artificial Sequence
  Description of Artificial Sequence: Synthetic oligonucleotide
gacaccaaaaccagccccggc

SEQ ID NO: 15520 - DNA, 21 bp, Artificial Sequence
  Description of Artificial Sequence: Synthetic oligonucleotide
catggtaatactacgtctggt

SEQ ID NO: 15521 - DNA, 21 bp, Artificial Sequence
  Description of Artificial Sequence: Synthetic oligonucleotide
aacgtcggcgccaccagcacc

SEQ ID NO: 15522 - DNA, 21 bp, Artificial Sequence
  Description of Artificial Sequence: Synthetic oligonucleotide
aacggcaacggccaaagcaaa

SEQ ID NO: 15523 - DNA, 21 bp, Artificial Sequence
  Description of Artificial Sequence: Synthetic oligonucleotide
ggcctcagcggcagcgccggc

SEQ ID NO: 15524 - DNA, 21 bp, Artificial Sequence
  Description of Artificial Sequence: Synthetic oligonucleotide
acgaatgggagtaagccggat

SEQ ID NO: 15525 - DNA, 21 bp, Artificial Sequence
  Description of Artificial Sequence: Synthetic oligonucleotide
tatcctgaggcgaagggggct

SEQ ID NO: 15526 - DNA, 21 bp, Artificial Sequence
  Description of Artificial Sequence: Synthetic oligonucleotide
gggcagtcgtcggggggtggt

SEQ ID NO: 15527 - DNA, 21 bp, Artificial Sequence
  Description of Artificial Sequence: Synthetic oligonucleotide
gatatgaatggtgctggtaag

SEQ ID NO: 15528 - DNA, 21 bp, Artificial Sequence
  Description of Artificial Sequence: Synthetic oligonucleotide
ggtaatggtaataaggttatt

SEQ ID NO: 15529 - DNA, 21 bp, Artificial Sequence
  Description of Artificial Sequence: Synthetic oligonucleotide
acgtctgattctaagaatacg

SEQ ID NO: 15530 - DNA, 21 bp, Artificial Sequence
  Description of Artificial Sequence: Synthetic oligonucleotide
gcgggtaagggtacttcggag

SEQ ID NO: 15531 - DNA, 21 bp, Artificial Sequence
  Description of Artificial Sequence: Synthetic oligonucleotide
acgagtgaggatcgttcgaag

SEQ ID NO: 15532 - DNA, 21 bp, Artificial Sequence
  Description of Artificial Sequence: Synthetic oligonucleotide
gtccaaagcagcagcaccacc

SEQ ID NO: 15533 - DNA, 21 bp, Artificial Sequence
  Description of Artificial Sequence: Synthetic oligonucleotide
agcggcgtcagcgaaagaggc

SEQ ID NO: 15534 - DNA, 21 bp, Artificial Sequence
  Description of Artificial Sequence: Synthetic oligonucleotide
aaggagggttctaatggggtt

SEQ ID NO: 15535 - DNA, 21 bp, Artificial Sequence
  Description of Artificial Sequence: Synthetic oligonucleotide
gacagaggccaagaaagcaga

SEQ ID NO: 15536 - DNA, 21 bp, Artificial Sequence
  Description of Artificial Sequence: Synthetic oligonucleotide
gatggtgtgtctgataggaag

SEQ ID NO: 15537 - DNA, 21 bp, Artificial Sequence
  Description of Artificial Sequence: Synthetic oligonucleotide
accggccaaggcaccaacgtc

SEQ ID NO: 15538 - DNA, 21 bp, Artificial Sequence
  Description of Artificial Sequence: Synthetic oligonucleotide
gaaaacggcaccaaacccggc

SEQ ID NO: 15539 - DNA, 21 bp, Artificial Sequence
  Description of Artificial Sequence: Synthetic oligonucleotide
gaagccggccacggcaacggc

SEQ ID NO: 15540 - DNA, 21 bp, Artificial Sequence
  Description of Artificial Sequence: Synthetic oligonucleotide
gatgggtctgggaagattaac

SEQ ID NO: 15541 - DNA, 21 bp, Artificial Sequence
  Description of Artificial Sequence: Synthetic oligonucleotide
caaaacggcagcagccaaagc

SEQ ID NO: 15542 - DNA, 21 bp, Artificial Sequence
  Description of Artificial Sequence: Synthetic oligonucleotide
agcaacggcaaaaccagcgtc

SEQ ID NO: 15543 - DNA, 21 bp, Artificial Sequence
  Description of Artificial Sequence: Synthetic oligonucleotide
tcaagtgctggtaagggtgat

SEQ ID NO: 15544 - DNA, 21 bp, Artificial Sequence
  Description of Artificial Sequence: Synthetic oligonucleotide
caaagcaaaagcagccaaggc

SEQ ID NO: 15545 - DNA, 21 bp, Artificial Sequence
  Description of Artificial Sequence: Synthetic oligonucleotide
gatcctagtgataagccgagg

SEQ ID NO: 15546 - DNA, 21 bp, Artificial Sequence
  Description of Artificial Sequence: Synthetic oligonucleotide
ggttctagtgaggcgcggggt

SEQ ID NO: 15547 - DNA, 21 bp, Artificial Sequence
  Description of Artificial Sequence: Synthetic oligonucleotide
aatggtactaagcaggggact

SEQ ID NO: 15548 - DNA, 21 bp, Artificial Sequence
  Description of Artificial Sequence: Synthetic oligonucleotide
gaggggggtagttctgtgaat

SEQ ID NO: 15549 - DNA, 21 bp, Artificial Sequence
  Description of Artificial Sequence: Synthetic oligonucleotide
gggtcgggtaagggttcgggg

SEQ ID NO: 15550 - DNA, 21 bp, Artificial Sequence
  Description of Artificial Sequence: Synthetic oligonucleotide
gacgccaccaaagccggcctc

SEQ ID NO: 15551 - DNA, 21 bp, Artificial Sequence
  Description of Artificial Sequence: Synthetic oligonucleotide
caaaaaaccagcaacaccgaa

SEQ ID NO: 15552 - DNA, 21 bp, Artificial Sequence
  Description of Artificial Sequence: Synthetic oligonucleotide
cataatagtaaggatactgtt

SEQ ID NO: 15553 - DNA, 21 bp, Artificial Sequence
  Description of Artificial Sequence: Synthetic oligonucleotide
aacggcaccgacaaaaaacaa

SEQ ID NO: 15554 - DNA, 21 bp, Artificial Sequence
  Description of Artificial Sequence: Synthetic oligonucleotide
agcagcggcggcggcagcagc

SEQ ID NO: 15555 - DNA, 21 bp, Artificial Sequence
  Description of Artificial Sequence: Synthetic oligonucleotide
ggcaaccaaaccaccgccggc

SEQ ID NO: 15556 - DNA, 21 bp, Artificial Sequence
  Description of Artificial Sequence: Synthetic oligonucleotide
caggggtctacttcgcttagt

SEQ ID NO: 15557 - DNA, 21 bp, Artificial Sequence
  Description of Artificial Sequence: Synthetic oligonucleotide
ggccacagcaaccccagcagc

SEQ ID NO: 15558 - DNA, 21 bp, Artificial Sequence
  Description of Artificial Sequence: Synthetic oligonucleotide
aatgggacggggaatgcgagt

SEQ ID NO: 15559 - DNA, 21 bp, Artificial Sequence
  Description of Artificial Sequence: Synthetic oligonucleotide
ggcagccaagacagcaaaagc

SEQ ID NO: 15560 - DNA, 21 bp, Artificial Sequence
  Description of Artificial Sequence: Synthetic oligonucleotide
gccggcgacacccacaaaacc

SEQ ID NO: 15561 - DNA, 21 bp, Artificial Sequence
  Description of Artificial Sequence: Synthetic oligonucleotide
agtaatgtggggaagcaggat

SEQ ID NO: 15562 - DNA, 21 bp, Artificial Sequence
  Description of Artificial Sequence: Synthetic oligonucleotide
agtcggggggagcatagtcag

SEQ ID NO: 15563 - DNA, 21 bp, Artificial Sequence
  Description of Artificial Sequence: Synthetic oligonucleotide
gcgtcgggttcggggaatagt

SEQ ID NO: 15564 - DNA, 21 bp, Artificial Sequence
  Description of Artificial Sequence: Synthetic oligonucleotide
ctcggcagccaaagccccagc

SEQ ID NO: 15565 - DNA, 21 bp, Artificial Sequence
  Description of Artificial Sequence: Synthetic oligonucleotide
accggcctcaccagcagcgcc

SEQ ID NO: 15566 - DNA, 21 bp, Artificial Sequence
  Description of Artificial Sequence: Synthetic oligonucleotide
acgagttctggtaagggggat

SEQ ID NO: 15567 - DNA, 21 bp, Artificial Sequence
  Description of Artificial Sequence: Synthetic oligonucleotide
gcggatgggaagccttcttcg

SEQ ID NO: 15568 - DNA, 21 bp, Artificial Sequence
  Description of Artificial Sequence: Synthetic oligonucleotide
atgacgggttctagttctagt

SEQ ID NO: 15569 - DNA, 21 bp, Artificial Sequence
  Description of Artificial Sequence: Synthetic oligonucleotide
tcgaatggttctaagacggat

SEQ ID NO: 15570 - DNA, 21 bp, Artificial Sequence
  Description of Artificial Sequence: Synthetic oligonucleotide
gacagcagcagcaaagccctc

SEQ ID NO: 15571 - DNA, 21 bp, Artificial Sequence
  Description of Artificial Sequence: Synthetic oligonucleotide
agaagcgaaaaagtcgccggc

SEQ ID NO: 15572 - DNA, 21 bp, Artificial Sequence
  Description of Artificial Sequence: Synthetic oligonucleotide
caaatggaaagaaaagccggc

SEQ ID NO: 15573 - DNA, 21 bp, Artificial Sequence
  Description of Artificial Sequence: Synthetic oligonucleotide
gaaagcagcaccagacccggc

SEQ ID NO: 15574 - DNA, 21 bp, Artificial Sequence
  Description of Artificial Sequence: Synthetic oligonucleotide
ggcaacagccccagcaacacc

SEQ ID NO: 15575 - DNA, 21 bp, Artificial Sequence
  Description of Artificial Sequence: Synthetic oligonucleotide
tctctttcgaataagtctgag

SEQ ID NO: 15576 - DNA, 21 bp, Artificial Sequence
  Description of Artificial Sequence: Synthetic oligonucleotide
agtggtagtacgtcgccgact

SEQ ID NO: 15577 - DNA, 21 bp, Artificial Sequence
  Description of Artificial Sequence: Synthetic oligonucleotide
ggcatgggcaccagcggcacc

SEQ ID NO: 15578 - DNA, 21 bp, Artificial Sequence
  Description of Artificial Sequence: Synthetic oligonucleotide
gacgtcaacagcaacagcaga

SEQ ID NO: 15579 - DNA, 21 bp, Artificial Sequence
  Description of Artificial Sequence: Synthetic oligonucleotide
gcgacgtctgataaggcggct

SEQ ID NO: 15580 - DNA, 21 bp, Artificial Sequence
  Description of Artificial Sequence: Synthetic oligonucleotide
aatagtggttcggatcgtaat

SEQ ID NO: 15581 - DNA, 21 bp, Artificial Sequence
  Description of Artificial Sequence: Synthetic oligonucleotide
cagggggagtcgaagtttacg

SEQ ID NO: 15582 - DNA, 21 bp, Artificial Sequence
  Description of Artificial Sequence: Synthetic oligonucleotide
tctatgtcgaaggagtctact

SEQ ID NO: 15583 - DNA, 21 bp, Artificial Sequence
  Description of Artificial Sequence: Synthetic oligonucleotide
gggacgagtagtgatactaag

SEQ ID NO: 15584 - DNA, 21 bp, Artificial Sequence
  Description of Artificial Sequence: Synthetic oligonucleotide
aatcctggtaatagttcgggg

SEQ ID NO: 15585 - DNA, 21 bp, Artificial Sequence
  Description of Artificial Sequence: Synthetic oligonucleotide
agccacagcagcggcagcagc

SEQ ID NO: 15586 - DNA, 21 bp, Artificial Sequence
  Description of Artificial Sequence: Synthetic oligonucleotide
gaaagcggcaccaacagcaga

SEQ ID NO: 15587 - DNA, 21 bp, Artificial Sequence
  Description of Artificial Sequence: Synthetic oligonucleotide
gatacgagtcataagtctgag

SEQ ID NO: 15588 - DNA, 21 bp, Artificial Sequence
  Description of Artificial Sequence: Synthetic oligonucleotide
tctggggctcagcctgggaat

SEQ ID NO: 15589 - DNA, 21 bp, Artificial Sequence
  Description of Artificial Sequence: Synthetic oligonucleotide
accgacggccaaaccagcaga

SEQ ID NO: 15590 - DNA, 21 bp, Artificial Sequence
  Description of Artificial Sequence: Synthetic oligonucleotide
ggtcatagtgatgctcctcgg

SEQ ID NO: 15591 - DNA, 21 bp, Artificial Sequence
  Description of Artificial Sequence: Synthetic oligonucleotide
gacagcgccggcacccccaga

SEQ ID NO: 15592 - DNA, 21 bp, Artificial Sequence
  Description of Artificial Sequence: Synthetic oligonucleotide
gtcggcaccagcaccagcaaa

SEQ ID NO: 15593 - DNA, 21 bp, Artificial Sequence
  Description of Artificial Sequence: Synthetic oligonucleotide
gtggggcagggtgcgcagagt

SEQ ID NO: 15594 - DNA, 21 bp, Artificial Sequence
  Description of Artificial Sequence: Synthetic oligonucleotide
gaaggcaccaaacaaggcacc

SEQ ID NO: 15595 - DNA, 21 bp, Artificial Sequence
  Description of Artificial Sequence: Synthetic oligonucleotide
aacatccccagcggcaccggc

SEQ ID NO: 15596 - DNA, 21 bp, Artificial Sequence
  Description of Artificial Sequence: Synthetic oligonucleotide
aatccggggcagactatttct

SEQ ID NO: 15597 - DNA, 21 bp, Artificial Sequence
  Description of Artificial Sequence: Synthetic oligonucleotide
accagcggcaccggccaaccc

SEQ ID NO: 15598 - DNA, 21 bp, Artificial Sequence
  Description of Artificial Sequence: Synthetic oligonucleotide
agcaccaacgtcagccccggc

SEQ ID NO: 15599 - DNA, 21 bp, Artificial Sequence
  Description of Artificial Sequence: Synthetic oligonucleotide
agcggcatcggccacaccgac

SEQ ID NO: 15600 - DNA, 21 bp, Artificial Sequence
  Description of Artificial Sequence: Synthetic oligonucleotide
caagtcggcaacaaacccggc

SEQ ID NO: 15601 - DNA, 21 bp, Artificial Sequence
  Description of Artificial Sequence: Synthetic oligonucleotide
gaaggcaccagaacccccggc

SEQ ID NO: 15602 - DNA, 21 bp, Artificial Sequence
  Description of Artificial Sequence: Synthetic oligonucleotide
tctacgtctagtcagcctttg

SEQ ID NO: 15603 - DNA, 21 bp, Artificial Sequence
  Description of Artificial Sequence: Synthetic oligonucleotide
gattcgagtacgaagtctatt

SEQ ID NO: 15604 - DNA, 21 bp, Artificial Sequence
  Description of Artificial Sequence: Synthetic oligonucleotide
gcccaaagcagcaccagcgtc

SEQ ID NO: 15605 - DNA, 21 bp, Artificial Sequence
  Description of Artificial Sequence: Synthetic oligonucleotide
actggtggtgggaaggatggt

SEQ ID NO: 15606 - DNA, 21 bp, Artificial Sequence
  Description of Artificial Sequence: Synthetic oligonucleotide
ggcatcagcgaaaaagccagc

SEQ ID NO: 15607 - DNA, 21 bp, Artificial Sequence
  Description of Artificial Sequence: Synthetic oligonucleotide
agcggcaacaccggcagcagc

SEQ ID NO: 15608 - DNA, 21 bp, Artificial Sequence
  Description of Artificial Sequence: Synthetic oligonucleotide
gaacccgtcagcgccggcaaa

SEQ ID NO: 15609 - DNA, 21 bp, Artificial Sequence
  Description of Artificial Sequence: Synthetic oligonucleotide
gggagttctgaggcgcagaag

SEQ ID NO: 15610 - DNA, 21 bp, Artificial Sequence
  Description of Artificial Sequence: Synthetic oligonucleotide
ggtttgaatggtggtaagtcg

SEQ ID NO: 15611 - DNA, 21 bp, Artificial Sequence
  Description of Artificial Sequence: Synthetic oligonucleotide
aacagcagcagcagcgtcgcc

SEQ ID NO: 15612 - DNA, 21 bp, Artificial Sequence
  Description of Artificial Sequence: Synthetic oligonucleotide
aacggcgccggccaaaaccaa

SEQ ID NO: 15613 - DNA, 21 bp, Artificial Sequence
  Description of Artificial Sequence: Synthetic oligonucleotide
gatggtaataatcagaagacg

SEQ ID NO: 15614 - DNA, 21 bp, Artificial Sequence
  Description of Artificial Sequence: Synthetic oligonucleotide
gagagtaggccttcttctgct

SEQ ID NO: 15615 - DNA, 21 bp, Artificial Sequence
  Description of Artificial Sequence: Synthetic oligonucleotide
gttcaggggacgtctagtact

SEQ ID NO: 15616 - DNA, 21 bp, Artificial Sequence
  Description of Artificial Sequence: Synthetic oligonucleotide
ggcagcagcagccccagccaa

SEQ ID NO: 15617 - DNA, 21 bp, Artificial Sequence
  Description of Artificial Sequence: Synthetic oligonucleotide
tcgaactcgactccgagtgtg

SEQ ID NO: 15618 - DNA, 21 bp, Artificial Sequence
  Description of Artificial Sequence: Synthetic oligonucleotide
ggtagttctgataaggctcgg

SEQ ID NO: 15619 - DNA, 21 bp, Artificial Sequence
  Description of Artificial Sequence: Synthetic oligonucleotide
gggaaggttgaggggaataag

SEQ ID NO: 15620 - DNA, 21 bp, Artificial Sequence
  Description of Artificial Sequence: Synthetic oligonucleotide
acgatgagtacgaagtcggag

SEQ ID NO: 15621 - DNA, 21 bp, Artificial Sequence
  Description of Artificial Sequence: Synthetic oligonucleotide
ggggtgggtcagaatccgcag

SEQ ID NO: 15622 - DNA, 21 bp, Artificial Sequence
  Description of Artificial Sequence: Synthetic oligonucleotide
gggacggttgggaagccgatg

SEQ ID NO: 15623 - DNA, 21 bp, Artificial Sequence
  Description of Artificial Sequence: Synthetic oligonucleotide
caagtcagcgacaaaaaccaa

SEQ ID NO: 15624 - DNA, 21 bp, Artificial Sequence
  Description of Artificial Sequence: Synthetic oligonucleotide
caaggcgcccaaagcagcgtc

SEQ ID NO: 15625 - DNA, 21 bp, Artificial Sequence
  Description of Artificial Sequence: Synthetic oligonucleotide
gaagccaacaaagtcgccgtc

SEQ ID NO: 15626 - DNA, 21 bp, Artificial Sequence
  Description of Artificial Sequence: Synthetic oligonucleotide
aacaccaaagaaagcagcggc

SEQ ID NO: 15627 - DNA, 21 bp, Artificial Sequence
  Description of Artificial Sequence: Synthetic oligonucleotide
agcggcggccaaagcgtcagc

SEQ ID NO: 15628 - DNA, 21 bp, Artificial Sequence
  Description of Artificial Sequence: Synthetic oligonucleotide
caccaagaaagcagacccggc

SEQ ID NO: 15629 - DNA, 21 bp, Artificial Sequence
  Description of Artificial Sequence: Synthetic oligonucleotide
accaccagcgacaaaagcatc

SEQ ID NO: 15630 - DNA, 21 bp, Artificial Sequence
  Description of Artificial Sequence: Synthetic oligonucleotide
acgacggatagtaagtctcag

SEQ ID NO: 15631 - DNA, 21 bp, Artificial Sequence
  Description of Artificial Sequence: Synthetic oligonucleotide
aacgccggcggccacgccagc

SEQ ID NO: 15632 - DNA, 21 bp, Artificial Sequence
  Description of Artificial Sequence: Synthetic oligonucleotide
ggtccggcgacgaataatggt

SEQ ID NO: 15633 - DNA, 21 bp, Artificial Sequence
  Description of Artificial Sequence: Synthetic oligonucleotide
gtcggcaaaaccagcaacgtc

SEQ ID NO: 15634 - DNA, 21 bp, Artificial Sequence
  Description of Artificial Sequence: Synthetic oligonucleotide
agcgaaagcagaagcgtcagc

SEQ ID NO: 15635 - DNA, 21 bp, Artificial Sequence
  Description of Artificial Sequence: Synthetic oligonucleotide
accagcgccagcaaaagcgac

SEQ ID NO: 15636 - DNA, 21 bp, Artificial Sequence
  Description of Artificial Sequence: Synthetic oligonucleotide
acgtcgtcgtctggtaatatg

SEQ ID NO: 15637 - DNA, 21 bp, Artificial Sequence
  Description of Artificial Sequence: Synthetic oligonucleotide
atgaacagcggcagcaccacc

SEQ ID NO: 15638 - DNA, 21 bp, Artificial Sequence
  Description of Artificial Sequence: Synthetic oligonucleotide
gggccgactcagccgaataat

SEQ ID NO: 15639 - DNA, 21 bp, Artificial Sequence
  Description of Artificial Sequence: Synthetic oligonucleotide
accaaagcccaaggcgccggc

SEQ ID NO: 15640 - DNA, 21 bp, Artificial Sequence
  Description of Artificial Sequence: Synthetic oligonucleotide
agcgtcaaccacgaagccggc

SEQ ID NO: 15641 - DNA, 21 bp, Artificial Sequence
  Description of Artificial Sequence: Synthetic oligonucleotide
accggcaccgccagcatcacc

SEQ ID NO: 15642 - DNA, 21 bp, Artificial Sequence
  Description of Artificial Sequence: Synthetic oligonucleotide
actggggggacgcataattct

SEQ ID NO: 15643 - DNA, 21 bp, Artificial Sequence
  Description of Artificial Sequence: Synthetic oligonucleotide
aatcagggttctagttcttct

SEQ ID NO: 15644 - DNA, 21 bp, Artificial Sequence
  Description of Artificial Sequence: Synthetic oligonucleotide
gacggcgtcagcagcaacaga

SEQ ID NO: 15645 - DNA, 21 bp, Artificial Sequence
  Description of Artificial Sequence: Synthetic oligonucleotide
atgaccagcaccggcagcacc

SEQ ID NO: 15646 - DNA, 21 bp, Artificial Sequence
  Description of Artificial Sequence: Synthetic oligonucleotide
ggcaccgccaccggcaaccaa

SEQ ID NO: 15647 - DNA, 21 bp, Artificial Sequence
  Description of Artificial Sequence: Synthetic oligonucleotide
gagaaaagtacgaagccgaat

SEQ ID NO: 15648 - DNA, 21 bp, Artificial Sequence
  Description of Artificial Sequence: Synthetic oligonucleotide
ggcggcagcggcgaaaaaacc

SEQ ID NO: 15649 - DNA, 21 bp, Artificial Sequence
  Description of Artificial Sequence: Synthetic oligonucleotide
aatgttcagtcttctaatgtt

SEQ ID NO: 15650 - DNA, 21 bp, Artificial Sequence
  Description of Artificial Sequence: Synthetic oligonucleotide
gggagtggttctcatagtggt

SEQ ID NO: 15651 - DNA, 21 bp, Artificial Sequence
  Description of Artificial Sequence: Synthetic oligonucleotide
aacagcggcaacagcggcaaa

SEQ ID NO: 15652 - DNA, 21 bp, Artificial Sequence
  Description of Artificial Sequence: Synthetic oligonucleotide
agcagcagcaacggcagcaaa

SEQ ID NO: 15653 - DNA, 21 bp, Artificial Sequence
  Description of Artificial Sequence: Synthetic oligonucleotide
cagggggctagttctggttcg

SEQ ID NO: 15654 - DNA, 21 bp, Artificial Sequence
  Description of Artificial Sequence: Synthetic oligonucleotide
tctggtacggagaatgtgagg

SEQ ID NO: 15655 - DNA, 21 bp, Artificial Sequence
  Description of Artificial Sequence: Synthetic oligonucleotide
ggtacgagtaatgggccgtct

SEQ ID NO: 15656 - DNA, 21 bp, Artificial Sequence
  Description of Artificial Sequence: Synthetic oligonucleotide
aacgccagccccagccccggc

SEQ ID NO: 15657 - DNA, 21 bp, Artificial Sequence
  Description of Artificial Sequence: Synthetic oligonucleotide
caaggcaacggcaaccaaggc

SEQ ID NO: 15658 - DNA, 21 bp, Artificial Sequence
  Description of Artificial Sequence: Synthetic oligonucleotide
cacggcaccaacagcgccggc

SEQ ID NO: 15659 - DNA, 21 bp, Artificial Sequence
  Description of Artificial Sequence: Synthetic oligonucleotide
gcgacttcgtcgactagtatt

SEQ ID NO: 15660 - DNA, 21 bp, Artificial Sequence
  Description of Artificial Sequence: Synthetic oligonucleotide
tctaatggtagtacgcattcg

SEQ ID NO: 15661 - DNA, 21 bp, Artificial Sequence
  Description of Artificial Sequence: Synthetic oligonucleotide
ggtaataagtctactccgtcg

SEQ ID NO: 15662 - DNA, 21 bp, Artificial Sequence
  Description of Artificial Sequence: Synthetic oligonucleotide
ctccaaaccagcagccccggc

SEQ ID NO: 15663 - DNA, 21 bp, Artificial Sequence
  Description of Artificial Sequence: Synthetic oligonucleotide
ggtccgaataattctgggtct

SEQ ID NO: 15664 - DNA, 21 bp, Artificial Sequence
  Description of Artificial Sequence: Synthetic oligonucleotide
agagccaacggcgccaacagc

SEQ ID NO: 15665 - DNA, 21 bp, Artificial Sequence
  Description of Artificial Sequence: Synthetic oligonucleotide
actgcttctggtgagcgggcg

SEQ ID NO: 15666 - DNA, 21 bp, Artificial Sequence
  Description of Artificial Sequence: Synthetic oligonucleotide
aacagcaccagcagccccggc

SEQ ID NO: 15667 - DNA, 21 bp, Artificial Sequence
  Description of Artificial Sequence: Synthetic oligonucleotide
cagggggattcgcataagggg

SEQ ID NO: 15668 - DNA, 21 bp, Artificial Sequence
  Description of Artificial Sequence: Synthetic oligonucleotide
gatagtactgcggtgcctaag

SEQ ID NO: 15669 - DNA, 21 bp, Artificial Sequence
  Description of Artificial Sequence: Synthetic oligonucleotide
accagcaacagcaaaaccctc

SEQ ID NO: 15670 - DNA, 21 bp, Artificial Sequence
  Description of Artificial Sequence: Synthetic oligonucleotide
gaaagaaccgaaaacagcaga

SEQ ID NO: 15671 - DNA, 21 bp, Artificial Sequence
  Description of Artificial Sequence: Synthetic oligonucleotide
gggagtcagcagagtactggg

SEQ ID NO: 15672 - DNA, 21 bp, Artificial Sequence
  Description of Artificial Sequence: Synthetic oligonucleotide
cacggcggccaaagcaccagc

SEQ ID NO: 15673 - DNA, 21 bp, Artificial Sequence
  Description of Artificial Sequence: Synthetic oligonucleotide
ggtgggggtaatccggctcgg

SEQ ID NO: 15674 - DNA, 21 bp, Artificial Sequence
  Description of Artificial Sequence: Synthetic oligonucleotide
tctgcgactggtactaattcg

SEQ ID NO: 15675 - DNA, 21 bp, Artificial Sequence
  Description of Artificial Sequence: Synthetic oligonucleotide
agcggcggccaagccggcatg

SEQ ID NO: 15676 - DNA, 21 bp, Artificial Sequence
  Description of Artificial Sequence: Synthetic oligonucleotide
ggcaacgccagcggccaagcc

SEQ ID NO: 15677 - DNA, 21 bp, Artificial Sequence
  Description of Artificial Sequence: Synthetic oligonucleotide
aacgtcggcaacaacgcccaa

SEQ ID NO: 15678 - DNA, 21 bp, Artificial Sequence
  Description of Artificial Sequence: Synthetic oligonucleotide
ggggtgggttcttcttcgcag

SEQ ID NO: 15679 - DNA, 21 bp, Artificial Sequence
  Description of Artificial Sequence: Synthetic oligonucleotide
tctagtggttcgactccttct

SEQ ID NO: 15680 - DNA, 21 bp, Artificial Sequence
  Description of Artificial Sequence: Synthetic oligonucleotide
aacaccagccaaagcagcggc

SEQ ID NO: 15681 - DNA, 21 bp, Artificial Sequence
  Description of Artificial Sequence: Synthetic oligonucleotide
ctcagcggcaaagaaaacgtc

SEQ ID NO: 15682 - DNA, 21 bp, Artificial Sequence
  Description of Artificial Sequence: Synthetic oligonucleotide
ggcggcaaagaaagccacgcc

SEQ ID NO: 15683 - DNA, 21 bp, Artificial Sequence
  Description of Artificial Sequence: Synthetic oligonucleotide
atgggcggcggcagcagcacc

SEQ ID NO: 15684 - DNA, 21 bp, Artificial Sequence
  Description of Artificial Sequence: Synthetic oligonucleotide
accggcgtcaccacccaaggc

SEQ ID NO: 15685 - DNA, 21 bp, Artificial Sequence
  Description of Artificial Sequence: Synthetic oligonucleotide
agcggcggcagcggcaccatg

SEQ ID NO: 15686 - DNA, 21 bp, Artificial Sequence
  Description of Artificial Sequence: Synthetic oligonucleotide
gttgctgagaaggcgtctagt

SEQ ID NO: 15687 - DNA, 21 bp, Artificial Sequence
  Description of Artificial Sequence: Synthetic oligonucleotide
gatagtgcgggtaagtctagt

SEQ ID NO: 15688 - DNA, 21 bp, Artificial Sequence
  Description of Artificial Sequence: Synthetic oligonucleotide
agcaccgcccaacccaccggc

SEQ ID NO: 15689 - DNA, 21 bp, Artificial Sequence
  Description of Artificial Sequence: Synthetic oligonucleotide
agcaccggccacggcaacgtc

SEQ ID NO: 15690 - DNA, 21 bp, Artificial Sequence
  Description of Artificial Sequence: Synthetic oligonucleotide
agcgccagccaaagcgccggc

SEQ ID NO: 15691 - DNA, 21 bp, Artificial Sequence
  Description of Artificial Sequence: Synthetic oligonucleotide
ctcaccgaaggcaaagccaac

SEQ ID NO: 15692 - DNA, 21 bp, Artificial Sequence
  Description of Artificial Sequence: Synthetic oligonucleotide
ctcggcgccgacaaaatccaa

SEQ ID NO: 15693 - DNA, 21 bp, Artificial Sequence
  Description of Artificial Sequence: Synthetic oligonucleotide
ggtgctggttctagtagtacg

SEQ ID NO: 15694 - DNA, 21 bp, Artificial Sequence
  Description of Artificial Sequence: Synthetic oligonucleotide
gaaggcggcaacaaagtcatg

SEQ ID NO: 15695 - DNA, 21 bp, Artificial Sequence
  Description of Artificial Sequence: Synthetic oligonucleotide
agcagccaaaaaagcgaaggc

SEQ ID NO: 15696 - DNA, 21 bp, Artificial Sequence
  Description of Artificial Sequence: Synthetic oligonucleotide
gccagcagcaacggcaacgtc

SEQ ID NO: 15697 - DNA, 21 bp, Artificial Sequence
  Description of Artificial Sequence: Synthetic oligonucleotide
accagcaacagcgaaaacaga

SEQ ID NO: 15698 - DNA, 21 bp, Artificial Sequence
  Description of Artificial Sequence: Synthetic oligonucleotide
agcggcagcgaaagaagcacc

SEQ ID NO: 15699 - DNA, 21 bp, Artificial Sequence
  Description of Artificial Sequence: Synthetic oligonucleotide
gcgcaggcgaaggagactaat

SEQ ID NO: 15700 - DNA, 21 bp, Artificial Sequence
  Description of Artificial Sequence: Synthetic oligonucleotide
ctcgaaggcaaagccagcagc

SEQ ID NO: 15701 - DNA, 21 bp, Artificial Sequence
  Description of Artificial Sequence: Synthetic oligonucleotide
aacagcgccggcagcagcagc

SEQ ID NO: 15702 - DNA, 21 bp, Artificial Sequence
  Description of Artificial Sequence: Synthetic oligonucleotide
agcaccgccagccccagagaa

SEQ ID NO: 15703 - DNA, 21 bp, Artificial Sequence
  Description of Artificial Sequence: Synthetic oligonucleotide
gacggcaccaccagcaaagtc

SEQ ID NO: 15704 - DNA, 21 bp, Artificial Sequence
  Description of Artificial Sequence: Synthetic oligonucleotide
tcggataataagacgatgcag

SEQ ID NO: 15705 - DNA, 21 bp, Artificial Sequence
  Description of Artificial Sequence: Synthetic oligonucleotide
cacagcgcccccgtcgccggc

SEQ ID NO: 15706 - DNA, 21 bp, Artificial Sequence
  Description of Artificial Sequence: Synthetic oligonucleotide
gggacgggtgggaataatact

SEQ ID NO: 15707 - DNA, 21 bp, Artificial Sequence
  Description of Artificial Sequence: Synthetic oligonucleotide
cagggtgagactactcggacg

SEQ ID NO: 15708 - DNA, 21 bp, Artificial Sequence
  Description of Artificial Sequence: Synthetic oligonucleotide
ggcaacgcccccagcagcacc

SEQ ID NO: 15709 - DNA, 21 bp, Artificial Sequence
  Description of Artificial Sequence: Synthetic oligonucleotide
gtccaaggcagcgcccccggc

SEQ ID NO: 15710 - DNA, 21 bp, Artificial Sequence
  Description of Artificial Sequence: Synthetic oligonucleotide
ctcggcagcagcaaagacaac

SEQ ID NO: 15711 - DNA, 21 bp, Artificial Sequence
  Description of Artificial Sequence: Synthetic oligonucleotide
agtactgtggataaggggacg

SEQ ID NO: 15712 - DNA, 21 bp, Artificial Sequence
  Description of Artificial Sequence: Synthetic oligonucleotide
agttcgaaggcgtcgactgtt

SEQ ID NO: 15713 - DNA, 21 bp, Artificial Sequence
  Description of Artificial Sequence: Synthetic oligonucleotide
gacaacaccaacaaagccagc

SEQ ID NO: 15714 - DNA, 21 bp, Artificial Sequence
  Description of Artificial Sequence: Synthetic oligonucleotide
agcatcggcgaccccagaagc

SEQ ID NO: 15715 - DNA, 21 bp, Artificial Sequence
  Description of Artificial Sequence: Synthetic oligonucleotide
gaaaaaaacagcaccgtcatg

SEQ ID NO: 15716 - DNA, 21 bp, Artificial Sequence
  Description of Artificial Sequence: Synthetic oligonucleotide
agtgagagtcagaagggttcg

SEQ ID NO: 15717 - DNA, 21 bp, Artificial Sequence
  Description of Artificial Sequence: Synthetic oligonucleotide
accaaaaacggcgcccaagcc

SEQ ID NO: 15718 - DNA, 21 bp, Artificial Sequence
  Description of Artificial Sequence: Synthetic oligonucleotide
gatggttctccggttaataag

SEQ ID NO: 15719 - DNA, 21 bp, Artificial Sequence
  Description of Artificial Sequence: Synthetic oligonucleotide
agcaccaccggcgacagcaaa

SEQ ID NO: 15720 - DNA, 21 bp, Artificial Sequence
  Description of Artificial Sequence: Synthetic oligonucleotide
agccccggccaaaccagcagc

SEQ ID NO: 15721 - DNA, 21 bp, Artificial Sequence
  Description of Artificial Sequence: Synthetic oligonucleotide
caagccggcggcaaacccggc

SEQ ID NO: 15722 - DNA, 21 bp, Artificial Sequence
  Description of Artificial Sequence: Synthetic oligonucleotide
ggcagcagcaacaccgccggc

SEQ ID NO: 15723 - DNA, 21 bp, Artificial Sequence
  Description of Artificial Sequence: Synthetic oligonucleotide
ggtgatattaagaatggggct

SEQ ID NO: 15724 - DNA, 21 bp, Artificial Sequence
  Description of Artificial Sequence: Synthetic oligonucleotide
agcggcggcaacaccctcagc

SEQ ID NO: 15725 - DNA, 21 bp, Artificial Sequence
  Description of Artificial Sequence: Synthetic oligonucleotide
agcaacggcaacaccagaaac

SEQ ID NO: 15726 - DNA, 21 bp, Artificial Sequence
  Description of Artificial Sequence: Synthetic oligonucleotide
gaaaacagcaccagcaccaaa

SEQ ID NO: 15727 - DNA, 21 bp, Artificial Sequence
  Description of Artificial Sequence: Synthetic oligonucleotide
ggtggggctactccgcagggg

SEQ ID NO: 15728 - DNA, 21 bp, Artificial Sequence
  Description of Artificial Sequence: Synthetic oligonucleotide
agccccagcgaacccatcaaa

SEQ ID NO: 15729 - DNA, 21 bp, Artificial Sequence
  Description of Artificial Sequence: Synthetic oligonucleotide
accagcggcagcagcgccgcc

SEQ ID NO: 15730 - DNA, 21 bp, Artificial Sequence
  Description of Artificial Sequence: Synthetic oligonucleotide
gagagtaaggctgctagtagt

SEQ ID NO: 15731 - DNA, 21 bp, Artificial Sequence
  Description of Artificial Sequence: Synthetic oligonucleotide
gcttcgacggataagttggcg

SEQ ID NO: 15732 - DNA, 21 bp, Artificial Sequence
  Description of Artificial Sequence: Synthetic oligonucleotide
ctccaagaccacagcaaaggc

SEQ ID NO: 15733 - DNA, 21 bp, Artificial Sequence
  Description of Artificial Sequence: Synthetic oligonucleotide
tctggtactccgtcgactggt

SEQ ID NO: 15734 - DNA, 21 bp, Artificial Sequence
  Description of Artificial Sequence: Synthetic oligonucleotide
gagtcgggtaagggtattctg

SEQ ID NO: 15735 - DNA, 21 bp, Artificial Sequence
  Description of Artificial Sequence: Synthetic oligonucleotide
atcggcgccaacagcagcgcc

SEQ ID NO: 15736 - DNA, 21 bp, Artificial Sequence
  Description of Artificial Sequence: Synthetic oligonucleotide
ggccccggcagccccggcaaa

SEQ ID NO: 15737 - DNA, 21 bp, Artificial Sequence
  Description of Artificial Sequence: Synthetic oligonucleotide
accaccggcggcaacggccaa

SEQ ID NO: 15738 - DNA, 21 bp, Artificial Sequence
  Description of Artificial Sequence: Synthetic oligonucleotide
aacaacagcggcagcaacagc

SEQ ID NO: 15739 - DNA, 21 bp, Artificial Sequence
  Description of Artificial Sequence: Synthetic oligonucleotide
tacggcaccggcagcagcccc

SEQ ID NO: 15740 - DNA, 21 bp, Artificial Sequence
  Description of Artificial Sequence: Synthetic oligonucleotide
gattcgggttctcagaggggt

SEQ ID NO: 15741 - DNA, 21 bp, Artificial Sequence
  Description of Artificial Sequence: Synthetic oligonucleotide
accagcgtccccggcgccggc

SEQ ID NO: 15742 - DNA, 21 bp, Artificial Sequence
  Description of Artificial Sequence: Synthetic oligonucleotide
agccccagcgacaaacccgtc

SEQ ID NO: 15743 - DNA, 21 bp, Artificial Sequence
  Description of Artificial Sequence: Synthetic oligonucleotide
actaatgggtcgaattctaag

SEQ ID NO: 15744 - DNA, 21 bp, Artificial Sequence
  Description of Artificial Sequence: Synthetic oligonucleotide
aatgcttctggggcgcgtgat

SEQ ID NO: 15745 - DNA, 21 bp, Artificial Sequence
  Description of Artificial Sequence: Synthetic oligonucleotide
tctgtggggtcgagtgggagt

SEQ ID NO: 15746 - DNA, 21 bp, Artificial Sequence
  Description of Artificial Sequence: Synthetic oligonucleotide
cagggggggaataatggttct

SEQ ID NO: 15747 - DNA, 21 bp, Artificial Sequence
  Description of Artificial Sequence: Synthetic oligonucleotide
gagacgtctaagtcgccggtg

SEQ ID NO: 15748 - DNA, 21 bp, Artificial Sequence
  Description of Artificial Sequence: Synthetic oligonucleotide
ggtggtgttgggtcgtctaat

SEQ ID NO: 15749 - DNA, 21 bp, Artificial Sequence
  Description of Artificial Sequence: Synthetic oligonucleotide
accagcggcagcagcaccgcc

SEQ ID NO: 15750 - DNA, 21 bp, Artificial Sequence
  Description of Artificial Sequence: Synthetic oligonucleotide
accaccaacagcacccccagc

SEQ ID NO: 15751 - DNA, 21 bp, Artificial Sequence
  Description of Artificial Sequence: Synthetic oligonucleotide
aacaccgacaaacacgccggc

SEQ ID NO: 15752 - DNA, 21 bp, Artificial Sequence
  Description of Artificial Sequence: Synthetic oligonucleotide
ggcaccggcgccggcagcaac

SEQ ID NO: 15753 - DNA, 21 bp, Artificial Sequence
  Description of Artificial Sequence: Synthetic oligonucleotide
cagggtagtcctgcggcgtcg

SEQ ID NO: 15754 - DNA, 21 bp, Artificial Sequence
  Description of Artificial Sequence: Synthetic oligonucleotide
gagagtagtaatcggggtagt

SEQ ID NO: 15755 - DNA, 21 bp, Artificial Sequence
  Description of Artificial Sequence: Synthetic oligonucleotide
gggggtaaggcgactcagggt

SEQ ID NO: 15756 - DNA, 21 bp, Artificial Sequence
  Description of Artificial Sequence: Synthetic oligonucleotide
aacaccatccccaaacccggc

SEQ ID NO: 15757 - DNA, 21 bp, Artificial Sequence
  Description of Artificial Sequence: Synthetic oligonucleotide
agtgggtcggagcgtgcgtcg

SEQ ID NO: 15758 - DNA, 21 bp, Artificial Sequence
  Description of Artificial Sequence: Synthetic oligonucleotide
agcaacagcaaagacagcagc

SEQ ID NO: 15759 - DNA, 21 bp, Artificial Sequence
  Description of Artificial Sequence: Synthetic oligonucleotide
agcggcgtcagcacccacaac

SEQ ID NO: 15760 - DNA, 21 bp, Artificial Sequence
  Description of Artificial Sequence: Synthetic oligonucleotide
cacagcggcaccggcagcacc

SEQ ID NO: 15761 - DNA, 21 bp, Artificial Sequence
  Description of Artificial Sequence: Synthetic oligonucleotide
gagagtgggaaggctactact

SEQ ID NO: 15762 - DNA, 21 bp, Artificial Sequence
  Description of Artificial Sequence: Synthetic oligonucleotide
gggcatactgaggggaagacg

SEQ ID NO: 15763 - DNA, 21 bp, Artificial Sequence
  Description of Artificial Sequence: Synthetic oligonucleotide
ggcagcagcagcggcggcacc

SEQ ID NO: 15764 - DNA, 21 bp, Artificial Sequence
  Description of Artificial Sequence: Synthetic oligonucleotide
accagccccaaccccagcacc

SEQ ID NO: 15765 - DNA, 21 bp, Artificial Sequence
  Description of Artificial Sequence: Synthetic oligonucleotide
acggctggtgggtcgagtcag

SEQ ID NO: 15766 - DNA, 21 bp, Artificial Sequence
  Description of Artificial Sequence: Synthetic oligonucleotide
aacggcaacgccagcagcggc

SEQ ID NO: 15767 - DNA, 21 bp, Artificial Sequence
  Description of Artificial Sequence: Synthetic oligonucleotide
gggagtgggacgcctacgcat

SEQ ID NO: 15768 - DNA, 21 bp, Artificial Sequence
  Description of Artificial Sequence: Synthetic oligonucleotide
agccaaggcaccgacggcaaa

SEQ ID NO: 15769 - DNA, 21 bp, Artificial Sequence
  Description of Artificial Sequence: Synthetic oligonucleotide
agcggccaacccggcaacacc

SEQ ID NO: 15770 - DNA, 21 bp, Artificial Sequence
  Description of Artificial Sequence: Synthetic oligonucleotide
ggtgctgttaataataagagt

SEQ ID NO: 15771 - DNA, 21 bp, Artificial Sequence
  Description of Artificial Sequence: Synthetic oligonucleotide
agtagttctcatagtgctagt

SEQ ID NO: 15772 - DNA, 21 bp, Artificial Sequence
  Description of Artificial Sequence: Synthetic oligonucleotide
aataatgcgacggcgacttct

SEQ ID NO: 15773 - DNA, 21 bp, Artificial Sequence
  Description of Artificial Sequence: Synthetic oligonucleotide
agcagcaacgaaaaactcgcc

SEQ ID NO: 15774 - DNA, 21 bp, Artificial Sequence
  Description of Artificial Sequence: Synthetic oligonucleotide
ggtcattcggttaaggcggag

SEQ ID NO: 15775 - DNA, 21 bp, Artificial Sequence
  Description of Artificial Sequence: Synthetic oligonucleotide
tcgacgggtgctaatcctatc

SEQ ID NO: 15776 - DNA, 21 bp, Artificial Sequence
  Description of Artificial Sequence: Synthetic oligonucleotide
agtgatcagcagaagggtgct

SEQ ID NO: 15777 - DNA, 21 bp, Artificial Sequence
  Description of Artificial Sequence: Synthetic oligonucleotide
actgggactagtcagcctacg

SEQ ID NO: 15778 - DNA, 21 bp, Artificial Sequence
  Description of Artificial Sequence: Synthetic oligonucleotide
ggcgtcagcgccacccccacc

SEQ ID NO: 15779 - DNA, 21 bp, Artificial Sequence
  Description of Artificial Sequence: Synthetic oligonucleotide
caggggtctaatacggctact

SEQ ID NO: 15780 - DNA, 21 bp, Artificial Sequence
  Description of Artificial Sequence: Synthetic oligonucleotide
aacagcgccggcgccaccacc

SEQ ID NO: 15781 - DNA, 21 bp, Artificial Sequence
  Description of Artificial Sequence: Synthetic oligonucleotide
agcagcggcgaaggcatgaga

SEQ ID NO: 15782 - DNA, 21 bp, Artificial Sequence
  Description of Artificial Sequence: Synthetic oligonucleotide
agacaaacccccgccgccggc

SEQ ID NO: 15783 - DNA, 21 bp, Artificial Sequence
  Description of Artificial Sequence: Synthetic oligonucleotide
agcggcggcaccgccgccatc

SEQ ID NO: 15784 - DNA, 21 bp, Artificial Sequence
  Description of Artificial Sequence: Synthetic oligonucleotide
ctcaccggccaaaacaaccaa

SEQ ID NO: 15785 - DNA, 21 bp, Artificial Sequence
  Description of Artificial Sequence: Synthetic oligonucleotide
ctccaaagcgtcagccccggc

SEQ ID NO: 15786 - DNA, 21 bp, Artificial Sequence
  Description of Artificial Sequence: Synthetic oligonucleotide
gccggccaacaagccagccaa

SEQ ID NO: 15787 - DNA, 21 bp, Artificial Sequence
  Description of Artificial Sequence: Synthetic oligonucleotide
gggaggaatacgagtaatgct

SEQ ID NO: 15788 - DNA, 21 bp, Artificial Sequence
  Description of Artificial Sequence: Synthetic oligonucleotide
aacgacgccagcaaaggcaac

SEQ ID NO: 15789 - DNA, 21 bp, Artificial Sequence
  Description of Artificial Sequence: Synthetic oligonucleotide
accggcaccggcagccccgcc

SEQ ID NO: 15790 - DNA, 21 bp, Artificial Sequence
  Description of Artificial Sequence: Synthetic oligonucleotide
gggttgaattcttctgctaag

SEQ ID NO: 15791 - DNA, 21 bp, Artificial Sequence
  Description of Artificial Sequence: Synthetic oligonucleotide
ggcgtcaccagcagcccccac

SEQ ID NO: 15792 - DNA, 21 bp, Artificial Sequence
  Description of Artificial Sequence: Synthetic oligonucleotide
ggccaaggcaccggcctcagc

SEQ ID NO: 15793 - DNA, 21 bp, Artificial Sequence
  Description of Artificial Sequence: Synthetic oligonucleotide
ggcaccaccaaaaccagcgaa

SEQ ID NO: 15794 - DNA, 21 bp, Artificial Sequence
  Description of Artificial Sequence: Synthetic oligonucleotide
gacagcctcaaaggcaacggc

SEQ ID NO: 15795 - DNA, 21 bp, Artificial Sequence
  Description of Artificial Sequence: Synthetic oligonucleotide
gggatgactaattcggggggg

SEQ ID NO: 15796 - DNA, 21 bp, Artificial Sequence
  Description of Artificial Sequence: Synthetic oligonucleotide
agcgccaccaaagtcaacgaa

SEQ ID NO: 15797 - DNA, 21 bp, Artificial Sequence
  Description of Artificial Sequence: Synthetic oligonucleotide
ggttctgataaggcggctcct

SEQ ID NO: 15798 - DNA, 21 bp, Artificial Sequence
  Description of Artificial Sequence: Synthetic oligonucleotide
aatggtgggcctcagtctacg

SEQ ID NO: 15799 - DNA, 21 bp, Artificial Sequence
  Description of Artificial Sequence: Synthetic oligonucleotide
ggcaacggcaaagacggcaac

SEQ ID NO: 15800 - DNA, 21 bp, Artificial Sequence
  Description of Artificial Sequence: Synthetic oligonucleotide
ggtcaggcgacgtctgctaag

SEQ ID NO: 15801 - DNA, 21 bp, Artificial Sequence
  Description of Artificial Sequence: Synthetic oligonucleotide
ggtaatccgacggggggtagt

SEQ ID NO: 15802 - DNA, 21 bp, Artificial Sequence
  Description of Artificial Sequence: Synthetic oligonucleotide
gacaacaccaaaagcaaccaa

SEQ ID NO: 15803 - DNA, 21 bp, Artificial Sequence
  Description of Artificial Sequence: Synthetic oligonucleotide
gacgccgtcagcagccccaaa

SEQ ID NO: 15804 - DNA, 21 bp, Artificial Sequence
  Description of Artificial Sequence: Synthetic oligonucleotide
agtaagactgagaggagtgtg

SEQ ID NO: 15805 - DNA, 21 bp, Artificial Sequence
  Description of Artificial Sequence: Synthetic oligonucleotide
aacggcagcggcgccagcagc

SEQ ID NO: 15806 - DNA, 21 bp, Artificial Sequence
  Description of Artificial Sequence: Synthetic oligonucleotide
ggtactgcttcgggtagtggt

SEQ ID NO: 15807 - DNA, 21 bp, Artificial Sequence
  Description of Artificial Sequence: Synthetic oligonucleotide
tcgagtgggactagtactgtg

SEQ ID NO: 15808 - DNA, 21 bp, Artificial Sequence
  Description of Artificial Sequence: Synthetic oligonucleotide
aacagcagcggcccccccggc

SEQ ID NO: 15809 - DNA, 21 bp, Artificial Sequence
  Description of Artificial Sequence: Synthetic oligonucleotide
ctcaaaagccaaagcaccggc

SEQ ID NO: 15810 - DNA, 21 bp, Artificial Sequence
  Description of Artificial Sequence: Synthetic oligonucleotide
ctcggccaaaccggccaactc

SEQ ID NO: 15811 - DNA, 21 bp, Artificial Sequence
  Description of Artificial Sequence: Synthetic oligonucleotide
gaaagcaacagcagacccggc

SEQ ID NO: 15812 - DNA, 21 bp, Artificial Sequence
  Description of Artificial Sequence: Synthetic oligonucleotide
acgacgtcgggtcagcatggt

SEQ ID NO: 15813 - DNA, 21 bp, Artificial Sequence
  Description of Artificial Sequence: Synthetic oligonucleotide
cagggttcgcagaaggtttct

SEQ ID NO: 15814 - DNA, 21 bp, Artificial Sequence
  Description of Artificial Sequence: Synthetic oligonucleotide
agcgccagcgacctcaaaagc

SEQ ID NO: 15815 - DNA, 21 bp, Artificial Sequence
  Description of Artificial Sequence: Synthetic oligonucleotide
agcaccggcggcagcagccaa

SEQ ID NO: 15816 - DNA, 21 bp, Artificial Sequence
  Description of Artificial Sequence: Synthetic oligonucleotide
tctgctggtccgtcttctgcg

SEQ ID NO: 15817 - DNA, 21 bp, Artificial Sequence
  Description of Artificial Sequence: Synthetic oligonucleotide
agcggcggcaccagcagcgtc

SEQ ID NO: 15818 - DNA, 21 bp, Artificial Sequence
  Description of Artificial Sequence: Synthetic oligonucleotide
ggtagtgggcataagggtgag

SEQ ID NO: 15819 - DNA, 21 bp, Artificial Sequence
  Description of Artificial Sequence: Synthetic oligonucleotide
acgggtactacgcatacgacg

SEQ ID NO: 15820 - DNA, 21 bp, Artificial Sequence
  Description of Artificial Sequence: Synthetic oligonucleotide
attgcgacgaaggggaatgtt

SEQ ID NO: 15821 - DNA, 21 bp, Artificial Sequence
  Description of Artificial Sequence: Synthetic oligonucleotide
ctccaaagccccagaaccggc

SEQ ID NO: 15822 - DNA, 21 bp, Artificial Sequence
  Description of Artificial Sequence: Synthetic oligonucleotide
gccggccaaaacagcagcgtc

SEQ ID NO: 15823 - DNA, 21 bp, Artificial Sequence
  Description of Artificial Sequence: Synthetic oligonucleotide
gtccccagccacgccgccggc

SEQ ID NO: 15824 - DNA, 21 bp, Artificial Sequence
  Description of Artificial Sequence: Synthetic oligonucleotide
caagccagcagcggcgccagc

SEQ ID NO: 15825 - DNA, 21 bp, Artificial Sequence
  Description of Artificial Sequence: Synthetic oligonucleotide
agttcgtcgaataaggatgct

SEQ ID NO: 15826 - DNA, 21 bp, Artificial Sequence
  Description of Artificial Sequence: Synthetic oligonucleotide
caggggggtagtggtagttcg

SEQ ID NO: 15827 - DNA, 21 bp, Artificial Sequence
  Description of Artificial Sequence: Synthetic oligonucleotide
ggccccgccagccaaagcggc

SEQ ID NO: 15828 - DNA, 21 bp, Artificial Sequence
  Description of Artificial Sequence: Synthetic oligonucleotide
aaccccggcagcaccaccgcc

SEQ ID NO: 15829 - DNA, 21 bp, Artificial Sequence
  Description of Artificial Sequence: Synthetic oligonucleotide
atgaacagcaacagcaacagc

SEQ ID NO: 15830 - DNA, 21 bp, Artificial Sequence
  Description of Artificial Sequence: Synthetic oligonucleotide
ggtagtgataaggcgaagcag

SEQ ID NO: 15831 - DNA, 21 bp, Artificial Sequence
  Description of Artificial Sequence: Synthetic oligonucleotide
accggcagcagcagcgtcagc

SEQ ID NO: 15832 - DNA, 21 bp, Artificial Sequence
  Description of Artificial Sequence: Synthetic oligonucleotide
gacagagccacccccagcgtc

SEQ ID NO: 15833 - DNA, 21 bp, Artificial Sequence
  Description of Artificial Sequence: Synthetic oligonucleotide
tctgcgggttctcctggtaat

SEQ ID NO: 15834 - DNA, 21 bp, Artificial Sequence
  Description of Artificial Sequence: Synthetic oligonucleotide
agtcagactagttcgccgcag

SEQ ID NO: 15835 - DNA, 21 bp, Artificial Sequence
  Description of Artificial Sequence: Synthetic oligonucleotide
agcgccgaaggcaaaatgatg

SEQ ID NO: 15836 - DNA, 21 bp, Artificial Sequence
  Description of Artificial Sequence: Synthetic oligonucleotide
ggtcctaagagttctccggcg

SEQ ID NO: 15837 - DNA, 21 bp, Artificial Sequence
  Description of Artificial Sequence: Synthetic oligonucleotide
cagtcgcctggtcagactagt

SEQ ID NO: 15838 - DNA, 21 bp, Artificial Sequence
  Description of Artificial Sequence: Synthetic oligonucleotide
gtccaaggcgccggcagcagc

SEQ ID NO: 15839 - DNA, 21 bp, Artificial Sequence
  Description of Artificial Sequence: Synthetic oligonucleotide
ggccaaggcaccagcgacggc

SEQ ID NO: 15840 - DNA, 21 bp, Artificial Sequence
  Description of Artificial Sequence: Synthetic oligonucleotide
accagagaaggcagcagcggc

SEQ ID NO: 15841 - DNA, 21 bp, Artificial Sequence
  Description of Artificial Sequence: Synthetic oligonucleotide
cagaatagtgggactaataat

SEQ ID NO: 15842 - DNA, 21 bp, Artificial Sequence
  Description of Artificial Sequence: Synthetic oligonucleotide
aacggcggcaccggcagcaga

SEQ ID NO: 15843 - DNA, 21 bp, Artificial Sequence
  Description of Artificial Sequence: Synthetic oligonucleotide
aaccaaggcagcagcagcgtc

SEQ ID NO: 15844 - DNA, 21 bp, Artificial Sequence
  Description of Artificial Sequence: Synthetic oligonucleotide
aacggcgccggccaaaaacaa

SEQ ID NO: 15845 - DNA, 21 bp, Artificial Sequence
  Description of Artificial Sequence: Synthetic oligonucleotide
ctgagtgataagaagccgaat

SEQ ID NO: 15846 - DNA, 21 bp, Artificial Sequence
  Description of Artificial Sequence: Synthetic oligonucleotide
aatggggttaagtcgcagacg

SEQ ID NO: 15847 - DNA, 21 bp, Artificial Sequence
  Description of Artificial Sequence: Synthetic oligonucleotide
gttcagggtgggagttctacg

SEQ ID NO: 15848 - DNA, 21 bp, Artificial Sequence
  Description of Artificial Sequence: Synthetic oligonucleotide
tcttctggggctggtagtttg

SEQ ID NO: 15849 - DNA, 21 bp, Artificial Sequence
  Description of Artificial Sequence: Synthetic oligonucleotide
agcagcgaacacaaaggcagc

SEQ ID NO: 15850 - DNA, 21 bp, Artificial Sequence
  Description of Artificial Sequence: Synthetic oligonucleotide
agcagcaccaaacaacccggc

SEQ ID NO: 15851 - DNA, 21 bp, Artificial Sequence
  Description of Artificial Sequence: Synthetic oligonucleotide
agtggtcagggtagttcggtg

SEQ ID NO: 15852 - DNA, 21 bp, Artificial Sequence
  Description of Artificial Sequence: Synthetic oligonucleotide
atgggcgaaacccacgccggc

SEQ ID NO: 15853 - DNA, 21 bp, Artificial Sequence
  Description of Artificial Sequence: Synthetic oligonucleotide
agtactgcgagtgataaggcg

SEQ ID NO: 15854 - DNA, 21 bp, Artificial Sequence
  Description of Artificial Sequence: Synthetic oligonucleotide
acccacgccaaccccgccggc

SEQ ID NO: 15855 - DNA, 21 bp, Artificial Sequence
  Description of Artificial Sequence: Synthetic oligonucleotide
acgagtagtcagcagtcgggg

SEQ ID NO: 15856 - DNA, 21 bp, Artificial Sequence
  Description of Artificial Sequence: Synthetic oligonucleotide
agcgaccaacaaaccaccaaa

SEQ ID NO: 15857 - DNA, 21 bp, Artificial Sequence
  Description of Artificial Sequence: Synthetic oligonucleotide
gaaagcaccaccagacccggc

SEQ ID NO: 15858 - DNA, 21 bp, Artificial Sequence
  Description of Artificial Sequence: Synthetic oligonucleotide
gccagctacaaaggcgccggc

SEQ ID NO: 15859 - DNA, 21 bp, Artificial Sequence
  Description of Artificial Sequence: Synthetic oligonucleotide
ggccaacacgcccaagccggc

SEQ ID NO: 15860 - DNA, 21 bp, Artificial Sequence
  Description of Artificial Sequence: Synthetic oligonucleotide
ggcagcggcgcccccagcaac

SEQ ID NO: 15861 - DNA, 21 bp, Artificial Sequence
  Description of Artificial Sequence: Synthetic oligonucleotide
gatccgaagccgggttctacg

SEQ ID NO: 15862 - DNA, 21 bp, Artificial Sequence
  Description of Artificial Sequence: Synthetic oligonucleotide
gggggggatgcgaagagtgtg

SEQ ID NO: 15863 - DNA, 21 bp, Artificial Sequence
  Description of Artificial Sequence: Synthetic oligonucleotide
ggcgaccaaaaagccagcaac

SEQ ID NO: 15864 - DNA, 21 bp, Artificial Sequence
  Description of Artificial Sequence: Synthetic oligonucleotide
tacagagacagcgccagccac

SEQ ID NO: 15865 - DNA, 21 bp, Artificial Sequence
  Description of Artificial Sequence: Synthetic oligonucleotide
ggcagcggcagagacgccgtc

SEQ ID NO: 15866 - DNA, 21 bp, Artificial Sequence
  Description of Artificial Sequence: Synthetic oligonucleotide
agcaacggcagccaaggcagc

SEQ ID NO: 15867 - DNA, 21 bp, Artificial Sequence
  Description of Artificial Sequence: Synthetic oligonucleotide
tctcctggtagttcttcgggt

SEQ ID NO: 15868 - DNA, 21 bp, Artificial Sequence
  Description of Artificial Sequence: Synthetic oligonucleotide
gatggtcataagacgcttgtg

SEQ ID NO: 15869 - DNA, 21 bp, Artificial Sequence
  Description of Artificial Sequence: Synthetic oligonucleotide
gtggggacttcgcaggctact

SEQ ID NO: 15870 - DNA, 21 bp, Artificial Sequence
  Description of Artificial Sequence: Synthetic oligonucleotide
gccaccggcagcggcagcaac

SEQ ID NO: 15871 - DNA, 21 bp, Artificial Sequence
  Description of Artificial Sequence: Synthetic oligonucleotide
aacgccacccccaccaaccaa

SEQ ID NO: 15872 - DNA, 21 bp, Artificial Sequence
  Description of Artificial Sequence: Synthetic oligonucleotide
aacaccaccgcccccaccgtc

SEQ ID NO: 15873 - DNA, 21 bp, Artificial Sequence
  Description of Artificial Sequence: Synthetic oligonucleotide
gccgcccccgccagcgccggc

SEQ ID NO: 15874 - DNA, 21 bp, Artificial Sequence
  Description of Artificial Sequence: Synthetic oligonucleotide
gcgagtcagcctgctagtgct

SEQ ID NO: 15875 - DNA, 21 bp, Artificial Sequence
  Description of Artificial Sequence: Synthetic oligonucleotide
caaggcagcagcagcgtcgtc

SEQ ID NO: 15876 - DNA, 21 bp, Artificial Sequence
  Description of Artificial Sequence: Synthetic oligonucleotide
agtcagcataaggagcagccg

SEQ ID NO: 15877 - DNA, 21 bp, Artificial Sequence
  Description of Artificial Sequence: Synthetic oligonucleotide
actggtacgactgagaagcat

SEQ ID NO: 15878 - DNA, 21 bp, Artificial Sequence
  Description of Artificial Sequence: Synthetic oligonucleotide
gttaataagagtccggttact

SEQ ID NO: 15879 - DNA, 21 bp, Artificial Sequence
  Description of Artificial Sequence: Synthetic oligonucleotide
aaaggcggcagcaacagcgtc

SEQ ID NO: 15880 - DNA, 21 bp, Artificial Sequence
  Description of Artificial Sequence: Synthetic oligonucleotide
agcggcaccagcaccagccac

SEQ ID NO: 15881 - DNA, 21 bp, Artificial Sequence
  Description of Artificial Sequence: Synthetic oligonucleotide
agtagtgttggtgagcagaag

SEQ ID NO: 15882 - DNA, 21 bp, Artificial Sequence
  Description of Artificial Sequence: Synthetic oligonucleotide
gacaacagcagcaaagccgtc

SEQ ID NO: 15883 - DNA, 21 bp, Artificial Sequence
  Description of Artificial Sequence: Synthetic oligonucleotide
agtggtgggacgtctgctggg

SEQ ID NO: 15884 - DNA, 21 bp, Artificial Sequence
  Description of Artificial Sequence: Synthetic oligonucleotide
gccaacagcgaaaaaagcccc

SEQ ID NO: 15885 - DNA, 21 bp, Artificial Sequence
  Description of Artificial Sequence: Synthetic oligonucleotide
accaaaaacggcagccaagcc

SEQ ID NO: 15886 - DNA, 21 bp, Artificial Sequence
  Description of Artificial Sequence: Synthetic oligonucleotide
gatactactaagacgtcgggt

SEQ ID NO: 15887 - DNA, 21 bp, Artificial Sequence
  Description of Artificial Sequence: Synthetic oligonucleotide
agcagcggcgccagcagcagc

SEQ ID NO: 15888 - DNA, 21 bp, Artificial Sequence
  Description of Artificial Sequence: Synthetic oligonucleotide
gataagtcgccgaatagtggg

SEQ ID NO: 15889 - DNA, 21 bp, Artificial Sequence
  Description of Artificial Sequence: Synthetic oligonucleotide
gacggcaccaaaaaaaacgcc

SEQ ID NO: 15890 - DNA, 21 bp, Artificial Sequence
  Description of Artificial Sequence: Synthetic oligonucleotide
catggtaattctagtcagggt

SEQ ID NO: 15891 - DNA, 21 bp, Artificial Sequence
  Description of Artificial Sequence: Synthetic oligonucleotide
tcgagtaattcggggactcag

SEQ ID NO: 15892 - DNA, 21 bp, Artificial Sequence
  Description of Artificial Sequence: Synthetic oligonucleotide
ggtgcgggtgatcgtagtggg

SEQ ID NO: 15893 - DNA, 21 bp, Artificial Sequence
  Description of Artificial Sequence: Synthetic oligonucleotide
aaaagcaacaccagcgccgcc

SEQ ID NO: 15894 - DNA, 21 bp, Artificial Sequence
  Description of Artificial Sequence: Synthetic oligonucleotide
gaaagcgacggcaaaagccac

SEQ ID NO: 15895 - DNA, 21 bp, Artificial Sequence
  Description of Artificial Sequence: Synthetic oligonucleotide
gacgccagcagcaaaggcctc

SEQ ID NO: 15896 - DNA, 21 bp, Artificial Sequence
  Description of Artificial Sequence: Synthetic oligonucleotide
caaagcggcgacaaaagccac

SEQ ID NO: 15897 - DNA, 21 bp, Artificial Sequence
  Description of Artificial Sequence: Synthetic oligonucleotide
ctcaccggcgccagcaccagc

SEQ ID NO: 15898 - DNA, 21 bp, Artificial Sequence
  Description of Artificial Sequence: Synthetic oligonucleotide
gatgggagtagtagtccgggg

SEQ ID NO: 15899 - DNA, 21 bp, Artificial Sequence
  Description of Artificial Sequence: Synthetic oligonucleotide
actactactagtacgccggtt

SEQ ID NO: 15900 - DNA, 21 bp, Artificial Sequence
  Description of Artificial Sequence: Synthetic oligonucleotide
gacatcagcaaaagcaacatc

SEQ ID NO: 15901 - DNA, 21 bp, Artificial Sequence
  Description of Artificial Sequence: Synthetic oligonucleotide
ggggggagtccttctaatcag

SEQ ID NO: 15902 - DNA, 21 bp, Artificial Sequence
  Description of Artificial Sequence: Synthetic oligonucleotide
tcttctggggagggtaataag

SEQ ID NO: 15903 - DNA, 21 bp, Artificial Sequence
  Description of Artificial Sequence: Synthetic oligonucleotide
ggcagcaccggcagccaaggc

SEQ ID NO: 15904 - DNA, 21 bp, Artificial Sequence
  Description of Artificial Sequence: Synthetic oligonucleotide
tcggagagtagtaagtctgtt

SEQ ID NO: 15905 - DNA, 21 bp, Artificial Sequence
  Description of Artificial Sequence: Synthetic oligonucleotide
gataatggtactagttcgcgt

SEQ ID NO: 15906 - DNA, 21 bp, Artificial Sequence
  Description of Artificial Sequence: Synthetic oligonucleotide
ggcctcaaagaaagcaacaga

SEQ ID NO: 15907 - DNA, 21 bp, Artificial Sequence
  Description of Artificial Sequence: Synthetic oligonucleotide
accaacggcagcagcaccagc

SEQ ID NO: 15908 - DNA, 21 bp, Artificial Sequence
  Description of Artificial Sequence: Synthetic oligonucleotide
gtcgaccaaggcggcagcaaa

SEQ ID NO: 15909 - DNA, 21 bp, Artificial Sequence
  Description of Artificial Sequence: Synthetic oligonucleotide
caaaccgaaaaaggcagagaa

SEQ ID NO: 15910 - DNA, 21 bp, Artificial Sequence
  Description of Artificial Sequence: Synthetic oligonucleotide
ggcagcaaccccaacggcacc

SEQ ID NO: 15911 - DNA, 21 bp, Artificial Sequence
  Description of Artificial Sequence: Synthetic oligonucleotide
gatggtgctagtccttctaag

SEQ ID NO: 15912 - DNA, 21 bp, Artificial Sequence
  Description of Artificial Sequence: Synthetic oligonucleotide
aatggttctactagttcgtcg

SEQ ID NO: 15913 - DNA, 21 bp, Artificial Sequence
  Description of Artificial Sequence: Synthetic oligonucleotide
gaaaacaacaaaagcaccgcc

SEQ ID NO: 15914 - DNA, 21 bp, Artificial Sequence
  Description of Artificial Sequence: Synthetic oligonucleotide
gccagcggcagcaacccccac

SEQ ID NO: 15915 - DNA, 21 bp, Artificial Sequence
  Description of Artificial Sequence: Synthetic oligonucleotide
gatccggtggcgaagggtacg

SEQ ID NO: 15916 - DNA, 21 bp, Artificial Sequence
  Description of Artificial Sequence: Synthetic oligonucleotide
caaggcgtccccagcggcacc

SEQ ID NO: 15917 - DNA, 21 bp, Artificial Sequence
  Description of Artificial Sequence: Synthetic oligonucleotide
aacaccggcaacagcggcggc

SEQ ID NO: 15918 - DNA, 21 bp, Artificial Sequence
  Description of Artificial Sequence: Synthetic oligonucleotide
caaggcggcggcagcagcacc

SEQ ID NO: 15919 - DNA, 21 bp, Artificial Sequence
  Description of Artificial Sequence: Synthetic oligonucleotide
cacggcgtccccagcagcggc

SEQ ID NO: 15920 - DNA, 21 bp, Artificial Sequence
  Description of Artificial Sequence: Synthetic oligonucleotide
gaggctcatgctagtgttaag

SEQ ID NO: 15921 - DNA, 21 bp, Artificial Sequence
  Description of Artificial Sequence: Synthetic oligonucleotide
agcggcaacggcaaagacatg

SEQ ID NO: 15922 - DNA, 21 bp, Artificial Sequence
  Description of Artificial Sequence: Synthetic oligonucleotide
aacggcagcaacaaccccacc

SEQ ID NO: 15923 - DNA, 21 bp, Artificial Sequence
  Description of Artificial Sequence: Synthetic oligonucleotide
aatgttatgccggattctaag

SEQ ID NO: 15924 - DNA, 21 bp, Artificial Sequence
  Description of Artificial Sequence: Synthetic oligonucleotide
gtcggcgacagcagcagcaga

SEQ ID NO: 15925 - DNA, 21 bp, Artificial Sequence
  Description of Artificial Sequence: Synthetic oligonucleotide
agcagcggcagcagcagcgtc

SEQ ID NO: 15926 - DNA, 21 bp, Artificial Sequence
  Description of Artificial Sequence: Synthetic oligonucleotide
gccaccagcaacgacaccaaa

SEQ ID NO: 15927 - DNA, 21 bp, Artificial Sequence
  Description of Artificial Sequence: Synthetic oligonucleotide
caaaacggcaaaggcaacgcc

SEQ ID NO: 15928 - DNA, 21 bp, Artificial Sequence
  Description of Artificial Sequence: Synthetic oligonucleotide
gcccccagcagcgaaaacaaa

SEQ ID NO: 15929 - DNA, 21 bp, Artificial Sequence
  Description of Artificial Sequence: Synthetic oligonucleotide
aattcttcgcagtctccttct

SEQ ID NO: 15930 - DNA, 21 bp, Artificial Sequence
  Description of Artificial Sequence: Synthetic oligonucleotide
gacaacggcagcaacaacaga

SEQ ID NO: 15931 - DNA, 21 bp, Artificial Sequence
  Description of Artificial Sequence: Synthetic oligonucleotide
agtggggcgtcgggtgctggg

SEQ ID NO: 15932 - DNA, 21 bp, Artificial Sequence
  Description of Artificial Sequence: Synthetic oligonucleotide
gatccgctggctaataagcat

SEQ ID NO: 15933 - DNA, 21 bp, Artificial Sequence
  Description of Artificial Sequence: Synthetic oligonucleotide
agtggttctagtaataatgtt

SEQ ID NO: 15934 - DNA, 21 bp, Artificial Sequence
  Description of Artificial Sequence: Synthetic oligonucleotide
gggcatcagactgggagtggg

SEQ ID NO: 15935 - DNA, 21 bp, Artificial Sequence
  Description of Artificial Sequence: Synthetic oligonucleotide
gatgggaagtcgtcggtttct

SEQ ID NO: 15936 - DNA, 21 bp, Artificial Sequence
  Description of Artificial Sequence: Synthetic oligonucleotide
caaggcagcgacagacccgtc

SEQ ID NO: 15937 - DNA, 21 bp, Artificial Sequence
  Description of Artificial Sequence: Synthetic oligonucleotide
gtttcttcgcagaaggctggt

SEQ ID NO: 15938 - DNA, 21 bp, Artificial Sequence
  Description of Artificial Sequence: Synthetic oligonucleotide
gattctacgactaagacgggt

SEQ ID NO: 15939 - DNA, 21 bp, Artificial Sequence
  Description of Artificial Sequence: Synthetic oligonucleotide
ggccaaaccggcgcccccgtc

SEQ ID NO: 15940 - DNA, 21 bp, Artificial Sequence
  Description of Artificial Sequence: Synthetic oligonucleotide
agcaccgccgtcaccaccggc

SEQ ID NO: 15941 - DNA, 21 bp, Artificial Sequence
  Description of Artificial Sequence: Synthetic oligonucleotide
caagccaacaacagccccacc

SEQ ID NO: 15942 - DNA, 21 bp, Artificial Sequence
  Description of Artificial Sequence: Synthetic oligonucleotide
atgggcaacggcgccagcaac

SEQ ID NO: 15943 - DNA, 21 bp, Artificial Sequence
  Description of Artificial Sequence: Synthetic oligonucleotide
atgaataataaggagaatcat

SEQ ID NO: 15944 - DNA, 21 bp, Artificial Sequence
  Description of Artificial Sequence: Synthetic oligonucleotide
acgggtaataagtctaatgag

SEQ ID NO: 15945 - DNA, 21 bp, Artificial Sequence
  Description of Artificial Sequence: Synthetic oligonucleotide
gacctcagcaccaaaagcaga

SEQ ID NO: 15946 - DNA, 21 bp, Artificial Sequence
  Description of Artificial Sequence: Synthetic oligonucleotide
acgcctagtcaggataggcat

SEQ ID NO: 15947 - DNA, 21 bp, Artificial Sequence
  Description of Artificial Sequence: Synthetic oligonucleotide
gcccaagaaaaaagcagcaga

SEQ ID NO: 15948 - DNA, 21 bp, Artificial Sequence
  Description of Artificial Sequence: Synthetic oligonucleotide
gagcctagtaagtcgaatact

SEQ ID NO: 15949 - DNA, 21 bp, Artificial Sequence
  Description of Artificial Sequence: Synthetic oligonucleotide
accgacggcaccaaaagccaa

SEQ ID NO: 15950 - DNA, 21 bp, Artificial Sequence
  Description of Artificial Sequence: Synthetic oligonucleotide
ggccacgaaaaaggcaacaac

SEQ ID NO: 15951 - DNA, 21 bp, Artificial Sequence
  Description of Artificial Sequence: Synthetic oligonucleotide
acgagtggtgcggggagtttg

SEQ ID NO: 15952 - DNA, 21 bp, Artificial Sequence
  Description of Artificial Sequence: Synthetic oligonucleotide
gagggttctaagcagggggcg

SEQ ID NO: 15953 - DNA, 21 bp, Artificial Sequence
  Description of Artificial Sequence: Synthetic oligonucleotide
cagcctgataataaggggggt

SEQ ID NO: 15954 - DNA, 21 bp, Artificial Sequence
  Description of Artificial Sequence: Synthetic oligonucleotide
gagcgtcaggggtcgacgctg

SEQ ID NO: 15955 - DNA, 21 bp, Artificial Sequence
  Description of Artificial Sequence: Synthetic oligonucleotide
gaaggcagcaccggcagcaga

SEQ ID NO: 15956 - DNA, 21 bp, Artificial Sequence
  Description of Artificial Sequence: Synthetic oligonucleotide
gaaggcggcaccagcaccagc

SEQ ID NO: 15957 - DNA, 21 bp, Artificial Sequence
  Description of Artificial Sequence: Synthetic oligonucleotide
ggcggcgaaagcaacagactc

SEQ ID NO: 15958 - DNA, 21 bp, Artificial Sequence
  Description of Artificial Sequence: Synthetic oligonucleotide
ggtttggctggtaatgcgaag

SEQ ID NO: 15959 - DNA, 21 bp, Artificial Sequence
  Description of Artificial Sequence: Synthetic oligonucleotide
agcaccggccacgtcaacggc

SEQ ID NO: 15960 - DNA, 21 bp, Artificial Sequence
  Description of Artificial Sequence: Synthetic oligonucleotide
agcctcaacgccggcgccggc

SEQ ID NO: 15961 - DNA, 21 bp, Artificial Sequence
  Description of Artificial Sequence: Synthetic oligonucleotide
gcttctaatcagagtactcag

SEQ ID NO: 15962 - DNA, 21 bp, Artificial Sequence
  Description of Artificial Sequence: Synthetic oligonucleotide
gattcgcattcgaagactaat

SEQ ID NO: 15963 - DNA, 21 bp, Artificial Sequence
  Description of Artificial Sequence: Synthetic oligonucleotide
caggatggtacgaagacttcg

SEQ ID NO: 15964 - DNA, 21 bp, Artificial Sequence
  Description of Artificial Sequence: Synthetic oligonucleotide
gatcagtctaagcaggggtcg

SEQ ID NO: 15965 - DNA, 21 bp, Artificial Sequence
  Description of Artificial Sequence: Synthetic oligonucleotide
gtcggcagcaccacccccacc

SEQ ID NO: 15966 - DNA, 21 bp, Artificial Sequence
  Description of Artificial Sequence: Synthetic oligonucleotide
actcctggggggtctcaggcg

SEQ ID NO: 15967 - DNA, 21 bp, Artificial Sequence
  Description of Artificial Sequence: Synthetic oligonucleotide
agcggcggcaccgccagcgcc

SEQ ID NO: 15968 - DNA, 21 bp, Artificial Sequence
  Description of Artificial Sequence: Synthetic oligonucleotide
aatggtttggataagagtcag

SEQ ID NO: 15969 - DNA, 21 bp, Artificial Sequence
  Description of Artificial Sequence: Synthetic oligonucleotide
gctggggggggtagtaatacg

SEQ ID NO: 15970 - DNA, 21 bp, Artificial Sequence
  Description of Artificial Sequence: Synthetic oligonucleotide
gttaagggggctgctagttct

SEQ ID NO: 15971 - DNA, 21 bp, Artificial Sequence
  Description of Artificial Sequence: Synthetic oligonucleotide
gaccaaaccgacagaaaccaa

SEQ ID NO: 15972 - DNA, 21 bp, Artificial Sequence
  Description of Artificial Sequence: Synthetic oligonucleotide
tctcttagtcagtcgagtaaa

SEQ ID NO: 15973 - DNA, 21 bp, Artificial Sequence
  Description of Artificial Sequence: Synthetic oligonucleotide
atgggcaacgaaagagccaac

SEQ ID NO: 15974 - DNA, 21 bp, Artificial Sequence
  Description of Artificial Sequence: Synthetic oligonucleotide
cagagtggtgctgataagtct

SEQ ID NO: 15975 - DNA, 21 bp, Artificial Sequence
  Description of Artificial Sequence: Synthetic oligonucleotide
cacggcggccccaccagcatc

SEQ ID NO: 15976 - DNA, 21 bp, Artificial Sequence
  Description of Artificial Sequence: Synthetic oligonucleotide
gatggtaatagtgcgaatcat

SEQ ID NO: 15977 - DNA, 21 bp, Artificial Sequence
  Description of Artificial Sequence: Synthetic oligonucleotide
gattcgaatagtaagcttact

SEQ ID NO: 15978 - DNA, 21 bp, Artificial Sequence
  Description of Artificial Sequence: Synthetic oligonucleotide
gacaccccccaaagccaaaaa

SEQ ID NO: 15979 - DNA, 21 bp, Artificial Sequence
  Description of Artificial Sequence: Synthetic oligonucleotide
ggcgccgaaaccgacaaaaga

SEQ ID NO: 15980 - DNA, 21 bp, Artificial Sequence
  Description of Artificial Sequence: Synthetic oligonucleotide
caaagcgccgccagcaaccac

SEQ ID NO: 15981 - DNA, 21 bp, Artificial Sequence
  Description of Artificial Sequence: Synthetic oligonucleotide
agcaccaaagccaccaacgaa

SEQ ID NO: 15982 - DNA, 21 bp, Artificial Sequence
  Description of Artificial Sequence: Synthetic oligonucleotide
ggtcagtcgactgctccgaat

SEQ ID NO: 15983 - DNA, 21 bp, Artificial Sequence
  Description of Artificial Sequence: Synthetic oligonucleotide
agaaccggcaacgtcagcagc

SEQ ID NO: 15984 - DNA, 21 bp, Artificial Sequence
  Description of Artificial Sequence: Synthetic oligonucleotide
gatgggaagtcgggtgctggt

SEQ ID NO: 15985 - DNA, 21 bp, Artificial Sequence
  Description of Artificial Sequence: Synthetic oligonucleotide
gagcaggctaaggttaatgtg

SEQ ID NO: 15986 - DNA, 21 bp, Artificial Sequence
  Description of Artificial Sequence: Synthetic oligonucleotide
gacaacagaagcagcaacagc

SEQ ID NO: 15987 - DNA, 21 bp, Artificial Sequence
  Description of Artificial Sequence: Synthetic oligonucleotide
aacaccggcagcggcaccagc

SEQ ID NO: 15988 - DNA, 21 bp, Artificial Sequence
  Description of Artificial Sequence: Synthetic oligonucleotide
cagcaggagtcccataagttg

SEQ ID NO: 15989 - DNA, 21 bp, Artificial Sequence
  Description of Artificial Sequence: Synthetic oligonucleotide
gacagcaccaaaaccaccagc

SEQ ID NO: 15990 - DNA, 21 bp, Artificial Sequence
  Description of Artificial Sequence: Synthetic oligonucleotide
gcccccgtcagccccgtcaaa

SEQ ID NO: 15991 - DNA, 21 bp, Artificial Sequence
  Description of Artificial Sequence: Synthetic oligonucleotide
acgagtggtgttagtccggcg

SEQ ID NO: 15992 - DNA, 21 bp, Artificial Sequence
  Description of Artificial Sequence: Synthetic oligonucleotide
ggcagcgacaaactccacagc

SEQ ID NO: 15993 - DNA, 21 bp, Artificial Sequence
  Description of Artificial Sequence: Synthetic oligonucleotide
gatcagttgtcgaagtcgcag

SEQ ID NO: 15994 - DNA, 21 bp, Artificial Sequence
  Description of Artificial Sequence: Synthetic oligonucleotide
agccacagcgacaaaaccagc

SEQ ID NO: 15995 - DNA, 21 bp, Artificial Sequence
  Description of Artificial Sequence: Synthetic oligonucleotide
agcgtcgaaagcaaaagcacc

SEQ ID NO: 15996 - DNA, 21 bp, Artificial Sequence
  Description of Artificial Sequence: Synthetic oligonucleotide
gcgacgagtggtactcaggct

SEQ ID NO: 15997 - DNA, 21 bp, Artificial Sequence
  Description of Artificial Sequence: Synthetic oligonucleotide
gtcaacaccagcgccacccaa

SEQ ID NO: 15998 - DNA, 21 bp, Artificial Sequence
  Description of Artificial Sequence: Synthetic oligonucleotide
ggtaatgcggggggtcagaat

SEQ ID NO: 15999 - DNA, 21 bp, Artificial Sequence
  Description of Artificial Sequence: Synthetic oligonucleotide
agcgacggcaaaggcagcctc

SEQ ID NO: 16000 - DNA, 21 bp, Artificial Sequence
  Description of Artificial Sequence: Synthetic oligonucleotide
accggcaacgaaaacaacaga

SEQ ID NO: 16001 - DNA, 21 bp, Artificial Sequence
  Description of Artificial Sequence: Synthetic oligonucleotide
gccgccaacgaaagaagcagc

SEQ ID NO: 16002 - DNA, 21 bp, Artificial Sequence
  Description of Artificial Sequence: Synthetic oligonucleotide
atgcccagcaccaaagaaggc

SEQ ID NO: 16003 - DNA, 21 bp, Artificial Sequence
  Description of Artificial Sequence: Synthetic oligonucleotide
cagcaggggtcgagtgggagt

SEQ ID NO: 16004 - DNA, 21 bp, Artificial Sequence
  Description of Artificial Sequence: Synthetic oligonucleotide
agcctcaacagccccaaaaac

SEQ ID NO: 16005 - DNA, 21 bp, Artificial Sequence
  Description of Artificial Sequence: Synthetic oligonucleotide
caaaccggcaccggcggcgcc

SEQ ID NO: 16006 - DNA, 21 bp, Artificial Sequence
  Description of Artificial Sequence: Synthetic oligonucleotide
tcgggggggtcttcggcttcg

SEQ ID NO: 16007 - DNA, 21 bp, Artificial Sequence
  Description of Artificial Sequence: Synthetic oligonucleotide
ggcagcgacaccaaagtcctc

SEQ ID NO: 16008 - DNA, 21 bp, Artificial Sequence
  Description of Artificial Sequence: Synthetic oligonucleotide
ggtactgcggcgtctaatagt

SEQ ID NO: 16009 - DNA, 21 bp, Artificial Sequence
  Description of Artificial Sequence: Synthetic oligonucleotide
gaaggcaccagccacaccaaa

SEQ ID NO: 16010 - DNA, 21 bp, Artificial Sequence
  Description of Artificial Sequence: Synthetic oligonucleotide
ggcaccagcagcacccccctc

SEQ ID NO: 16011 - DNA, 21 bp, Artificial Sequence
  Description of Artificial Sequence: Synthetic oligonucleotide
gggacgggtcgtgatcagaat

SEQ ID NO: 16012 - DNA, 21 bp, Artificial Sequence
  Description of Artificial Sequence: Synthetic oligonucleotide
gacgtcagcgccagcaacaga

SEQ ID NO: 16013 - DNA, 21 bp, Artificial Sequence
  Description of Artificial Sequence: Synthetic oligonucleotide
aatgaggctcggactccgcag

SEQ ID NO: 16014 - DNA, 21 bp, Artificial Sequence
  Description of Artificial Sequence: Synthetic oligonucleotide
gctcaggttaaggctggtgcg

SEQ ID NO: 16015 - DNA, 21 bp, Artificial Sequence
  Description of Artificial Sequence: Synthetic oligonucleotide
actcagggggctgctgcgtct

SEQ ID NO: 16016 - DNA, 21 bp, Artificial Sequence
  Description of Artificial Sequence: Synthetic oligonucleotide
gacgtcaccggcggcaaaggc

SEQ ID NO: 16017 - DNA, 21 bp, Artificial Sequence
  Description of Artificial Sequence: Synthetic oligonucleotide
ggtaatattgatggtaagaag

SEQ ID NO: 16018 - DNA, 21 bp, Artificial Sequence
  Description of Artificial Sequence: Synthetic oligonucleotide
cacaacggcgcccccagcagc

SEQ ID NO: 16019 - DNA, 21 bp, Artificial Sequence
  Description of Artificial Sequence: Synthetic oligonucleotide
atgcatgatgctaagagtggg

SEQ ID NO: 16020 - DNA, 21 bp, Artificial Sequence
  Description of Artificial Sequence: Synthetic oligonucleotide
gatggtgcgggtgcgagtcat

SEQ ID NO: 16021 - DNA, 21 bp, Artificial Sequence
  Description of Artificial Sequence: Synthetic oligonucleotide
gttacggatgctaagagttct

SEQ ID NO: 16022 - DNA, 21 bp, Artificial Sequence
  Description of Artificial Sequence: Synthetic oligonucleotide
gaaagccaaagagccggcggc

SEQ ID NO: 16023 - DNA, 21 bp, Artificial Sequence
  Description of Artificial Sequence: Synthetic oligonucleotide
gaaagcaacaacggcggcaaa

SEQ ID NO: 16024 - DNA, 21 bp, Artificial Sequence
  Description of Artificial Sequence: Synthetic oligonucleotide
gacgccggcaccaaagccatg

SEQ ID NO: 16025 - DNA, 21 bp, Artificial Sequence
  Description of Artificial Sequence: Synthetic oligonucleotide
ggcgaaggccaaagcaacaga

SEQ ID NO: 16026 - DNA, 21 bp, Artificial Sequence
  Description of Artificial Sequence: Synthetic oligonucleotide
tctccgggtacttcgcagggg

SEQ ID NO: 16027 - DNA, 21 bp, Artificial Sequence
  Description of Artificial Sequence: Synthetic oligonucleotide
agcggcaacagcagcctcagc

SEQ ID NO: 16028 - DNA, 21 bp, Artificial Sequence
  Description of Artificial Sequence: Synthetic oligonucleotide
agcagaaccaccgacaccacc

SEQ ID NO: 16029 - DNA, 21 bp, Artificial Sequence
  Description of Artificial Sequence: Synthetic oligonucleotide
gaggggaagtctgcggcgctt

SEQ ID NO: 16030 - DNA, 21 bp, Artificial Sequence
  Description of Artificial Sequence: Synthetic oligonucleotide
ggcggcgccgccaacagcggc

SEQ ID NO: 16031 - DNA, 21 bp, Artificial Sequence
  Description of Artificial Sequence: Synthetic oligonucleotide
agcagagaaggcagcaacgtc

SEQ ID NO: 16032 - DNA, 21 bp, Artificial Sequence
  Description of Artificial Sequence: Synthetic oligonucleotide
ggttctacgtcgcagcctgcg

SEQ ID NO: 16033 - DNA, 21 bp, Artificial Sequence
  Description of Artificial Sequence: Synthetic oligonucleotide
aacagcgaaaccaaagccagc

SEQ ID NO: 16034 - DNA, 21 bp, Artificial Sequence
  Description of Artificial Sequence: Synthetic oligonucleotide
agtaagacgcagactagtatt

SEQ ID NO: 16035 - DNA, 21 bp, Artificial Sequence
  Description of Artificial Sequence: Synthetic oligonucleotide
ctgaatggtaagacgaatagt

SEQ ID NO: 16036 - DNA, 21 bp, Artificial Sequence
  Description of Artificial Sequence: Synthetic oligonucleotide
aacgtcggcaaagacagagcc

SEQ ID NO: 16037 - DNA, 21 bp, Artificial Sequence
  Description of Artificial Sequence: Synthetic oligonucleotide
aatacggttggtcagaatact

SEQ ID NO: 16038 - DNA, 21 bp, Artificial Sequence
  Description of Artificial Sequence: Synthetic oligonucleotide
caagccagccaaagcgccaaa

SEQ ID NO: 16039 - DNA, 21 bp, Artificial Sequence
  Description of Artificial Sequence: Synthetic oligonucleotide
gagcataatagtgagtctaag

SEQ ID NO: 16040 - DNA, 21 bp, Artificial Sequence
  Description of Artificial Sequence: Synthetic oligonucleotide
aacaccaacagccccagcgcc

SEQ ID NO: 16041 - DNA, 21 bp, Artificial Sequence
  Description of Artificial Sequence: Synthetic oligonucleotide
aacagcggcccccccaccggc

SEQ ID NO: 16042 - DNA, 21 bp, Artificial Sequence
  Description of Artificial Sequence: Synthetic oligonucleotide
aacggcaaagccagccccggc

SEQ ID NO: 16043 - DNA, 21 bp, Artificial Sequence
  Description of Artificial Sequence: Synthetic oligonucleotide
aatgggtcggcgaagccgagt

SEQ ID NO: 16044 - DNA, 21 bp, Artificial Sequence
  Description of Artificial Sequence: Synthetic oligonucleotide
accggccacggcagcgtcgcc

SEQ ID NO: 16045 - DNA, 21 bp, Artificial Sequence
  Description of Artificial Sequence: Synthetic oligonucleotide
acgcgtgattctagtacgact

SEQ ID NO: 16046 - DNA, 21 bp, Artificial Sequence
  Description of Artificial Sequence: Synthetic oligonucleotide
agcagagacgccggccaccac

SEQ ID NO: 16047 - DNA, 21 bp, Artificial Sequence
  Description of Artificial Sequence: Synthetic oligonucleotide
agcggcaaaaacgaagccggc

SEQ ID NO: 16048 - DNA, 21 bp, Artificial Sequence
  Description of Artificial Sequence: Synthetic oligonucleotide
atcagcgacaaagcccccggc

SEQ ID NO: 16049 - DNA, 21 bp, Artificial Sequence
  Description of Artificial Sequence: Synthetic oligonucleotide
caaaccggcggcagcggcagc

SEQ ID NO: 16050 - DNA, 21 bp, Artificial Sequence
  Description of Artificial Sequence: Synthetic oligonucleotide
caaggcggcagcagcagccaa

SEQ ID NO: 16051 - DNA, 21 bp, Artificial Sequence
  Description of Artificial Sequence: Synthetic oligonucleotide
gaaagcagcaacaaaggcggc

SEQ ID NO: 16052 - DNA, 21 bp, Artificial Sequence
  Description of Artificial Sequence: Synthetic oligonucleotide
gaagccagcgaaagacccggc

SEQ ID NO: 16053 - DNA, 21 bp, Artificial Sequence
  Description of Artificial Sequence: Synthetic oligonucleotide
gacagcaaagtcagcacccaa

SEQ ID NO: 16054 - DNA, 21 bp, Artificial Sequence
  Description of Artificial Sequence: Synthetic oligonucleotide
ggcaccggcaacacccccctc

SEQ ID NO: 16055 - DNA, 21 bp, Artificial Sequence
  Description of Artificial Sequence: Synthetic oligonucleotide
ggcagccccgccaccaccggc

SEQ ID NO: 16056 - DNA, 21 bp, Artificial Sequence
  Description of Artificial Sequence: Synthetic oligonucleotide
ggcatcaccccccccggccaa

SEQ ID NO: 16057 - DNA, 21 bp, Artificial Sequence
  Description of Artificial Sequence: Synthetic oligonucleotide
gtccacggcgacaaaaccggc

SEQ ID NO: 16058 - DNA, 21 bp, Artificial Sequence
  Description of Artificial Sequence: Synthetic oligonucleotide
gtcggcacccccaccagcgtc

SEQ ID NO: 16059 - DNA, 21 bp, Artificial Sequence
  Description of Artificial Sequence: Synthetic oligonucleotide
agcagcaccaccaccagcagc

SEQ ID NO: 16060 - DNA, 21 bp, Artificial Sequence
  Description of Artificial Sequence: Synthetic oligonucleotide
caggggacggggaatgatcgg

SEQ ID NO: 16061 - DNA, 21 bp, Artificial Sequence
  Description of Artificial Sequence: Synthetic oligonucleotide
ggtattaaggagtctaagcag

SEQ ID NO: 16062 - DNA, 21 bp, Artificial Sequence
  Description of Artificial Sequence: Synthetic oligonucleotide
tctccgactacgaagaatgtt

SEQ ID NO: 16063 - DNA, 21 bp, Artificial Sequence
  Description of Artificial Sequence: Synthetic oligonucleotide
accggcagcaacgcccccgcc

SEQ ID NO: 16064 - DNA, 21 bp, Artificial Sequence
  Description of Artificial Sequence: Synthetic oligonucleotide
aacagcagcggcacccccacc

SEQ ID NO: 16065 - DNA, 21 bp, Artificial Sequence
  Description of Artificial Sequence: Synthetic oligonucleotide
gtcaacaacagcggcagccac

SEQ ID NO: 16066 - DNA, 21 bp, Artificial Sequence
  Description of Artificial Sequence: Synthetic oligonucleotide
agtgttcatgcgacgccgacg

SEQ ID NO: 16067 - DNA, 21 bp, Artificial Sequence
  Description of Artificial Sequence: Synthetic oligonucleotide
ggcggcgccaaccccggcacc

SEQ ID NO: 16068 - DNA, 21 bp, Artificial Sequence
  Description of Artificial Sequence: Synthetic oligonucleotide
cagagggcggatcatagtagt

SEQ ID NO: 16069 - DNA, 21 bp, Artificial Sequence
  Description of Artificial Sequence: Synthetic oligonucleotide
gaaaaccaaagccccaacaaa

SEQ ID NO: 16070 - DNA, 21 bp, Artificial Sequence
  Description of Artificial Sequence: Synthetic oligonucleotide
agcaccggcaacagcaacgcc

SEQ ID NO: 16071 - DNA, 21 bp, Artificial Sequence
  Description of Artificial Sequence: Synthetic oligonucleotide
aacgccggcgccaacagcatc

SEQ ID NO: 16072 - DNA, 21 bp, Artificial Sequence
  Description of Artificial Sequence: Synthetic oligonucleotide
ggtgctcttactgatcagaag

SEQ ID NO: 16073 - DNA, 21 bp, Artificial Sequence
  Description of Artificial Sequence: Synthetic oligonucleotide
agtagtgcttcgcagccgtcg

SEQ ID NO: 16074 - DNA, 21 bp, Artificial Sequence
  Description of Artificial Sequence: Synthetic oligonucleotide
aacggcagcacccccagccaa

SEQ ID NO: 16075 - DNA, 21 bp, Artificial Sequence
  Description of Artificial Sequence: Synthetic oligonucleotide
tcgacgattagtgctgggaag

SEQ ID NO: 16076 - DNA, 21 bp, Artificial Sequence
  Description of Artificial Sequence: Synthetic oligonucleotide
cttcctaatcctgggagtggg

SEQ ID NO: 16077 - DNA, 21 bp, Artificial Sequence
  Description of Artificial Sequence: Synthetic oligonucleotide
catactggtacttcgaatagt

SEQ ID NO: 16078 - DNA, 21 bp, Artificial Sequence
  Description of Artificial Sequence: Synthetic oligonucleotide
ggcagcggcagcaaagtcgtc

SEQ ID NO: 16079 - DNA, 21 bp, Artificial Sequence
  Description of Artificial Sequence: Synthetic oligonucleotide
accaaagacagcagcccccaa

SEQ ID NO: 16080 - DNA, 21 bp, Artificial Sequence
  Description of Artificial Sequence: Synthetic oligonucleotide
ggcaacagcgacagaagcagc

SEQ ID NO: 16081 - DNA, 21 bp, Artificial Sequence
  Description of Artificial Sequence: Synthetic oligonucleotide
caaagcggcgacagcatcaaa

SEQ ID NO: 16082 - DNA, 21 bp, Artificial Sequence
  Description of Artificial Sequence: Synthetic oligonucleotide
accagcgccaacgccgccacc

SEQ ID NO: 16083 - DNA, 21 bp, Artificial Sequence
  Description of Artificial Sequence: Synthetic oligonucleotide
caaggcgacaaaaccctcgtc

SEQ ID NO: 16084 - DNA, 21 bp, Artificial Sequence
  Description of Artificial Sequence: Synthetic oligonucleotide
ggtatgagtgataagccgatt

SEQ ID NO: 16085 - DNA, 21 bp, Artificial Sequence
  Description of Artificial Sequence: Synthetic oligonucleotide
ggccccaacaccgacgtcaaa

SEQ ID NO: 16086 - DNA, 21 bp, Artificial Sequence
  Description of Artificial Sequence: Synthetic oligonucleotide
accagcgacagcagcaaaggc

SEQ ID NO: 16087 - DNA, 21 bp, Artificial Sequence
  Description of Artificial Sequence: Synthetic oligonucleotide
ctcagcggcaacaaagacgcc

SEQ ID NO: 16088 - DNA, 21 bp, Artificial Sequence
  Description of Artificial Sequence: Synthetic oligonucleotide
ctcggcgccggccaagccctc

SEQ ID NO: 16089 - DNA, 21 bp, Artificial Sequence
  Description of Artificial Sequence: Synthetic oligonucleotide
tcgcagctggagcgtagtgcg

SEQ ID NO: 16090 - DNA, 21 bp, Artificial Sequence
  Description of Artificial Sequence: Synthetic oligonucleotide
cacaacgacaccaaagccacc

SEQ ID NO: 16091 - DNA, 21 bp, Artificial Sequence
  Description of Artificial Sequence: Synthetic oligonucleotide
accggcgaaacccacaaagcc

SEQ ID NO: 16092 - DNA, 21 bp, Artificial Sequence
  Description of Artificial Sequence: Synthetic oligonucleotide
ggcgccgaaaaaaacaacggc

SEQ ID NO: 16093 - DNA, 21 bp, Artificial Sequence
  Description of Artificial Sequence: Synthetic oligonucleotide
gggacgggtaaggatagtttg

SEQ ID NO: 16094 - DNA, 21 bp, Artificial Sequence
  Description of Artificial Sequence: Synthetic oligonucleotide
aaaaccggcaccggcaccgaa

SEQ ID NO: 16095 - DNA, 21 bp, Artificial Sequence
  Description of Artificial Sequence: Synthetic oligonucleotide
ggcggcgccaacagccccagc

SEQ ID NO: 16096 - DNA, 21 bp, Artificial Sequence
  Description of Artificial Sequence: Synthetic oligonucleotide
gacagcaccgacaaaagaacc

SEQ ID NO: 16097 - DNA, 21 bp, Artificial Sequence
  Description of Artificial Sequence: Synthetic oligonucleotide
atttcggataagcagtctgtt

SEQ ID NO: 16098 - DNA, 21 bp, Artificial Sequence
  Description of Artificial Sequence: Synthetic oligonucleotide
gaactcaccggcaccaaagcc

SEQ ID NO: 16099 - DNA, 21 bp, Artificial Sequence
  Description of Artificial Sequence: Synthetic oligonucleotide
ggggcgcaggataagagggag

SEQ ID NO: 16100 - DNA, 21 bp, Artificial Sequence
  Description of Artificial Sequence: Synthetic oligonucleotide
gaaacccacaaagccagcaac

SEQ ID NO: 16101 - DNA, 21 bp, Artificial Sequence
  Description of Artificial Sequence: Synthetic oligonucleotide
caggggactgatcagcatgcg

SEQ ID NO: 16102 - DNA, 21 bp, Artificial Sequence
  Description of Artificial Sequence: Synthetic oligonucleotide
agcggcaccaacaacaacgtc

SEQ ID NO: 16103 - DNA, 21 bp, Artificial Sequence
  Description of Artificial Sequence: Synthetic oligonucleotide
aacctcggcgcccaacacagc

SEQ ID NO: 16104 - DNA, 21 bp, Artificial Sequence
  Description of Artificial Sequence: Synthetic oligonucleotide
gatggtaaggctccttctctt

SEQ ID NO: 16105 - DNA, 21 bp, Artificial Sequence
  Description of Artificial Sequence: Synthetic oligonucleotide
gtcgccggcaccaaaagcgaa

SEQ ID NO: 16106 - DNA, 21 bp, Artificial Sequence
  Description of Artificial Sequence: Synthetic oligonucleotide
agtcctagtaatgtgtcgaag

SEQ ID NO: 16107 - DNA, 21 bp, Artificial Sequence
  Description of Artificial Sequence: Synthetic oligonucleotide
agcgccaccggcaacggcggc

SEQ ID NO: 16108 - DNA, 21 bp, Artificial Sequence
  Description of Artificial Sequence: Synthetic oligonucleotide
tcgggtggtgctgggccggct

SEQ ID NO: 16109 - DNA, 21 bp, Artificial Sequence
  Description of Artificial Sequence: Synthetic oligonucleotide
aacggcggccaaagcaaaacc

SEQ ID NO: 16110 - DNA, 21 bp, Artificial Sequence
  Description of Artificial Sequence: Synthetic oligonucleotide
gttcagggtagtaatcctaat

SEQ ID NO: 16111 - DNA, 21 bp, Artificial Sequence
  Description of Artificial Sequence: Synthetic oligonucleotide
caaggcagccaagcccaagtc

SEQ ID NO: 16112 - DNA, 21 bp, Artificial Sequence
  Description of Artificial Sequence: Synthetic oligonucleotide
agcggcaacagccaaatgaac

SEQ ID NO: 16113 - DNA, 21 bp, Artificial Sequence
  Description of Artificial Sequence: Synthetic oligonucleotide
gaccaaagcagcaaagccgtc

SEQ ID NO: 16114 - DNA, 21 bp, Artificial Sequence
  Description of Artificial Sequence: Synthetic oligonucleotide
agaaccggcaacaccagcgtc

SEQ ID NO: 16115 - DNA, 21 bp, Artificial Sequence
  Description of Artificial Sequence: Synthetic oligonucleotide
gccagaagcgaaagcaccggc

SEQ ID NO: 16116 - DNA, 21 bp, Artificial Sequence
  Description of Artificial Sequence: Synthetic oligonucleotide
gccagcagcaaagaaaacaga

SEQ ID NO: 16117 - DNA, 21 bp, Artificial Sequence
  Description of Artificial Sequence: Synthetic oligonucleotide
tcgaatcagaatgctaaggcg

SEQ ID NO: 16118 - DNA, 21 bp, Artificial Sequence
  Description of Artificial Sequence: Synthetic oligonucleotide
ctgagtgggagtacttcgaat

SEQ ID NO: 16119 - DNA, 21 bp, Artificial Sequence
  Description of Artificial Sequence: Synthetic oligonucleotide
ggtactaatacgaattctggg

SEQ ID NO: 16120 - DNA, 21 bp, Artificial Sequence
  Description of Artificial Sequence: Synthetic oligonucleotide
ggcaccggcggcagcagcagc

SEQ ID NO: 16121 - DNA, 21 bp, Artificial Sequence
  Description of Artificial Sequence: Synthetic oligonucleotide
gagtctgggggtaagcctggt

SEQ ID NO: 16122 - DNA, 21 bp, Artificial Sequence
  Description of Artificial Sequence: Synthetic oligonucleotide
gccaccggcgccagcaacaac

SEQ ID NO: 16123 - DNA, 21 bp, Artificial Sequence
  Description of Artificial Sequence: Synthetic oligonucleotide
tctggtgtgtctggtacgaat

SEQ ID NO: 16124 - DNA, 21 bp, Artificial Sequence
  Description of Artificial Sequence: Synthetic oligonucleotide
gggagtaatactcctctggct

SEQ ID NO: 16125 - DNA, 21 bp, Artificial Sequence
  Description of Artificial Sequence: Synthetic oligonucleotide
tcgggttctaagagtcttctg

SEQ ID NO: 16126 - DNA, 21 bp, Artificial Sequence
  Description of Artificial Sequence: Synthetic oligonucleotide
caaggcagcagcagcgccgtc

SEQ ID NO: 16127 - DNA, 21 bp, Artificial Sequence
  Description of Artificial Sequence: Synthetic oligonucleotide
aattcgaaggcgaataatgtt

SEQ ID NO: 16128 - DNA, 21 bp, Artificial Sequence
  Description of Artificial Sequence: Synthetic oligonucleotide
ctcagcgccaaaagcaacggc

SEQ ID NO: 16129 - DNA, 21 bp, Artificial Sequence
  Description of Artificial Sequence: Synthetic oligonucleotide
agtggtaaggatacttctggg

SEQ ID NO: 16130 - DNA, 21 bp, Artificial Sequence
  Description of Artificial Sequence: Synthetic oligonucleotide
atgaccggcagcaaccacgcc

SEQ ID NO: 16131 - DNA, 21 bp, Artificial Sequence
  Description of Artificial Sequence: Synthetic oligonucleotide
tctaattcgcaggttaatagt

SEQ ID NO: 16132 - DNA, 21 bp, Artificial Sequence
  Description of Artificial Sequence: Synthetic oligonucleotide
agcggcctcgccagcaccggc

SEQ ID NO: 16133 - DNA, 21 bp, Artificial Sequence
  Description of Artificial Sequence: Synthetic oligonucleotide
accaacagcagcaacaacgtc

SEQ ID NO: 16134 - DNA, 21 bp, Artificial Sequence
  Description of Artificial Sequence: Synthetic oligonucleotide
ggcaccacccaagacagaagc

SEQ ID NO: 16135 - DNA, 21 bp, Artificial Sequence
  Description of Artificial Sequence: Synthetic oligonucleotide
ggcgtcagcggcaacaaagac

SEQ ID NO: 16136 - DNA, 21 bp, Artificial Sequence
  Description of Artificial Sequence: Synthetic oligonucleotide
actcaggctagtacgcctacg

SEQ ID NO: 16137 - DNA, 21 bp, Artificial Sequence
  Description of Artificial Sequence: Synthetic oligonucleotide
tctgggtcggggtctacgagg

SEQ ID NO: 16138 - DNA, 21 bp, Artificial Sequence
  Description of Artificial Sequence: Synthetic oligonucleotide
gatgctggtcaggctccgaag

SEQ ID NO: 16139 - DNA, 21 bp, Artificial Sequence
  Description of Artificial Sequence: Synthetic oligonucleotide
agcgaccaacaacccaccaaa

SEQ ID NO: 16140 - DNA, 21 bp, Artificial Sequence
  Description of Artificial Sequence: Synthetic oligonucleotide
agcagcaccacccaccccagc

SEQ ID NO: 16141 - DNA, 21 bp, Artificial Sequence
  Description of Artificial Sequence: Synthetic oligonucleotide
tcggggagtgggactagtaat

SEQ ID NO: 16142 - DNA, 21 bp, Artificial Sequence
  Description of Artificial Sequence: Synthetic oligonucleotide
gccaccaaaaccaccaacggc

SEQ ID NO: 16143 - DNA, 21 bp, Artificial Sequence
  Description of Artificial Sequence: Synthetic oligonucleotide
aatggttcggctcagggtcgg

SEQ ID NO: 16144 - DNA, 21 bp, Artificial Sequence
  Description of Artificial Sequence: Synthetic oligonucleotide
ctcaccaccagcaaagccgaa

SEQ ID NO: 16145 - DNA, 21 bp, Artificial Sequence
  Description of Artificial Sequence: Synthetic oligonucleotide
gacggcgtcacccccaaccac

SEQ ID NO: 16146 - DNA, 21 bp, Artificial Sequence
  Description of Artificial Sequence: Synthetic oligonucleotide
aacggcgccaaagccgacagc

SEQ ID NO: 16147 - DNA, 21 bp, Artificial Sequence
  Description of Artificial Sequence: Synthetic oligonucleotide
accagaaccgacagcaccggc

SEQ ID NO: 16148 - DNA, 21 bp, Artificial Sequence
  Description of Artificial Sequence: Synthetic oligonucleotide
agcacccaacaaagccccggc

SEQ ID NO: 16149 - DNA, 21 bp, Artificial Sequence
  Description of Artificial Sequence: Synthetic oligonucleotide
caaggcaccgccacccaaagc

SEQ ID NO: 16150 - DNA, 21 bp, Artificial Sequence
  Description of Artificial Sequence: Synthetic oligonucleotide
agttctcagacttctgggaag

SEQ ID NO: 16151 - DNA, 21 bp, Artificial Sequence
  Description of Artificial Sequence: Synthetic oligonucleotide
actggggtggggaagggtctt

SEQ ID NO: 16152 - DNA, 21 bp, Artificial Sequence
  Description of Artificial Sequence: Synthetic oligonucleotide
aatggtgggaatgctagtact

SEQ ID NO: 16153 - DNA, 21 bp, Artificial Sequence
  Description of Artificial Sequence: Synthetic oligonucleotide
acggatcagtctaaggtgtct

SEQ ID NO: 16154 - DNA, 21 bp, Artificial Sequence
  Description of Artificial Sequence: Synthetic oligonucleotide
gcttcttctaaggcggtggtt

SEQ ID NO: 16155 - DNA, 21 bp, Artificial Sequence
  Description of Artificial Sequence: Synthetic oligonucleotide
agcagcagcagcacccccaac

SEQ ID NO: 16156 - DNA, 21 bp, Artificial Sequence
  Description of Artificial Sequence: Synthetic oligonucleotide
gccaacaccaaagacaccgcc

SEQ ID NO: 16157 - DNA, 21 bp, Artificial Sequence
  Description of Artificial Sequence: Synthetic oligonucleotide
gggaatacgggtggtacttct

SEQ ID NO: 16158 - DNA, 21 bp, Artificial Sequence
  Description of Artificial Sequence: Synthetic oligonucleotide
agcggcagcggcgaagccaaa

SEQ ID NO: 16159 - DNA, 21 bp, Artificial Sequence
  Description of Artificial Sequence: Synthetic oligonucleotide
gtcagcaccaaaagcgccgtc

SEQ ID NO: 16160 - DNA, 21 bp, Artificial Sequence
  Description of Artificial Sequence: Synthetic oligonucleotide
cagcctgggaatcagactagt

SEQ ID NO: 16161 - DNA, 21 bp, Artificial Sequence
  Description of Artificial Sequence: Synthetic oligonucleotide
agcaccaccaccagcagcggc

SEQ ID NO: 16162 - DNA, 21 bp, Artificial Sequence
  Description of Artificial Sequence: Synthetic oligonucleotide
agcaccgtcaccggcggcagc

SEQ ID NO: 16163 - DNA, 21 bp, Artificial Sequence
  Description of Artificial Sequence: Synthetic oligonucleotide
atgcccagcaacaacagcacc

SEQ ID NO: 16164 - DNA, 21 bp, Artificial Sequence
  Description of Artificial Sequence: Synthetic oligonucleotide
accagcggcgcccccagcgcc

SEQ ID NO: 16165 - DNA, 21 bp, Artificial Sequence
  Description of Artificial Sequence: Synthetic oligonucleotide
ggtaatcagacttctccgatt

SEQ ID NO: 16166 - DNA, 21 bp, Artificial Sequence
  Description of Artificial Sequence: Synthetic oligonucleotide
gagacgaagtctacgcctaat

SEQ ID NO: 16167 - DNA, 21 bp, Artificial Sequence
  Description of Artificial Sequence: Synthetic oligonucleotide
aaccccggcagaaacaccggc

SEQ ID NO: 16168 - DNA, 21 bp, Artificial Sequence
  Description of Artificial Sequence: Synthetic oligonucleotide
caacaaaccgcccaaaccggc

SEQ ID NO: 16169 - DNA, 21 bp, Artificial Sequence
  Description of Artificial Sequence: Synthetic oligonucleotide
gccagagaaatcaaccccggc

SEQ ID NO: 16170 - DNA, 21 bp, Artificial Sequence
  Description of Artificial Sequence: Synthetic oligonucleotide
gccggccaaaaagacagcacc

SEQ ID NO: 16171 - DNA, 21 bp, Artificial Sequence
  Description of Artificial Sequence: Synthetic oligonucleotide
tcttcgaataagggtagtccg

SEQ ID NO: 16172 - DNA, 21 bp, Artificial Sequence
  Description of Artificial Sequence: Synthetic oligonucleotide
accagcaccaaccaacccgtc

SEQ ID NO: 16173 - DNA, 21 bp, Artificial Sequence
  Description of Artificial Sequence: Synthetic oligonucleotide
tctgttgctggggatcgttct

SEQ ID NO: 16174 - DNA, 21 bp, Artificial Sequence
  Description of Artificial Sequence: Synthetic oligonucleotide
accgacagcaccagaagcacc

SEQ ID NO: 16175 - DNA, 21 bp, Artificial Sequence
  Description of Artificial Sequence: Synthetic oligonucleotide
agcggcagcaccagccccaac

SEQ ID NO: 16176 - DNA, 21 bp, Artificial Sequence
  Description of Artificial Sequence: Synthetic oligonucleotide
gggtcgggtagttcgaatact

SEQ ID NO: 16177 - DNA, 21 bp, Artificial Sequence
  Description of Artificial Sequence: Synthetic oligonucleotide
gggagtacgcagtcgtcggct

SEQ ID NO: 16178 - DNA, 21 bp, Artificial Sequence
  Description of Artificial Sequence: Synthetic oligonucleotide
aacgaccaaagcaaacccctc

SEQ ID NO: 16179 - DNA, 21 bp, Artificial Sequence
  Description of Artificial Sequence: Synthetic oligonucleotide
gagtctaggtcgcgtaatgag

SEQ ID NO: 16180 - DNA, 21 bp, Artificial Sequence
  Description of Artificial Sequence: Synthetic oligonucleotide
gatgctacgactcgtcctcct

SEQ ID NO: 16181 - DNA, 21 bp, Artificial Sequence
  Description of Artificial Sequence: Synthetic oligonucleotide
agcagcaccaacaaaaccgtc

SEQ ID NO: 16182 - DNA, 21 bp, Artificial Sequence
  Description of Artificial Sequence: Synthetic oligonucleotide
gcgggttctgctaaggataag

SEQ ID NO: 16183 - DNA, 21 bp, Artificial Sequence
  Description of Artificial Sequence: Synthetic oligonucleotide
gatattgggaagacgcatgcg

SEQ ID NO: 16184 - DNA, 21 bp, Artificial Sequence
  Description of Artificial Sequence: Synthetic oligonucleotide
caagtcaacagcacccccgtc

SEQ ID NO: 16185 - DNA, 21 bp, Artificial Sequence
  Description of Artificial Sequence: Synthetic oligonucleotide
tctggtgcttctagtgtgacg

SEQ ID NO: 16186 - DNA, 21 bp, Artificial Sequence
  Description of Artificial Sequence: Synthetic oligonucleotide
gatagtggtcgtagtccgaat

SEQ ID NO: 16187 - DNA, 21 bp, Artificial Sequence
  Description of Artificial Sequence: Synthetic oligonucleotide
agtaatgatagtaagagtact

SEQ ID NO: 16188 - DNA, 21 bp, Artificial Sequence
  Description of Artificial Sequence: Synthetic oligonucleotide
agtaatgttaagcagatgcct

SEQ ID NO: 16189 - DNA, 21 bp, Artificial Sequence
  Description of Artificial Sequence: Synthetic oligonucleotide
gatggtgggactcatgtgaag

SEQ ID NO: 16190 - DNA, 21 bp, Artificial Sequence
  Description of Artificial Sequence: Synthetic oligonucleotide
ctcagcgacggcaaacccaac

SEQ ID NO: 16191 - DNA, 21 bp, Artificial Sequence
  Description of Artificial Sequence: Synthetic oligonucleotide
gacgcccacaaagtcaacctc

SEQ ID NO: 16192 - DNA, 21 bp, Artificial Sequence
  Description of Artificial Sequence: Synthetic oligonucleotide
gatagtgctgctaaggctgct

SEQ ID NO: 16193 - DNA, 21 bp, Artificial Sequence
  Description of Artificial Sequence: Synthetic oligonucleotide
accggcacccaaaccaacagc

SEQ ID NO: 16194 - DNA, 21 bp, Artificial Sequence
  Description of Artificial Sequence: Synthetic oligonucleotide
aatggtgggggtgctcaggct

SEQ ID NO: 16195 - DNA, 21 bp, Artificial Sequence
  Description of Artificial Sequence: Synthetic oligonucleotide
ggcgccaccagcaaaagcgtc

SEQ ID NO: 16196 - DNA, 21 bp, Artificial Sequence
  Description of Artificial Sequence: Synthetic oligonucleotide
caggcttcggatccgaagctg

SEQ ID NO: 16197 - DNA, 21 bp, Artificial Sequence
  Description of Artificial Sequence: Synthetic oligonucleotide
aacggcaaaagccaagtcagc

SEQ ID NO: 16198 - DNA, 21 bp, Artificial Sequence
  Description of Artificial Sequence: Synthetic oligonucleotide
tctgcttctggtactgggcag

SEQ ID NO: 16199 - DNA, 21 bp, Artificial Sequence
  Description of Artificial Sequence: Synthetic oligonucleotide
ggcgccagcaaaagcaacggc

SEQ ID NO: 16200 - DNA, 21 bp, Artificial Sequence
  Description of Artificial Sequence: Synthetic oligonucleotide
gtcggcgaagccaaaaaagcc

SEQ ID NO: 16201 - DNA, 21 bp, Artificial Sequence
  Description of Artificial Sequence: Synthetic oligonucleotide
atcaccggcagcaccgccgcc

SEQ ID NO: 16202 - DNA, 21 bp, Artificial Sequence
  Description of Artificial Sequence: Synthetic oligonucleotide
actagttcggatcgtcctact

SEQ ID NO: 16203 - DNA, 21 bp, Artificial Sequence
  Description of Artificial Sequence: Synthetic oligonucleotide
gccgccggccaaggcagaagc

SEQ ID NO: 16204 - DNA, 21 bp, Artificial Sequence
  Description of Artificial Sequence: Synthetic oligonucleotide
catactcaggcgtcgccgact

SEQ ID NO: 16205 - DNA, 21 bp, Artificial Sequence
  Description of Artificial Sequence: Synthetic oligonucleotide
ggtagttcgactgagcgggtg

SEQ ID NO: 16206 - DNA, 21 bp, Artificial Sequence
  Description of Artificial Sequence: Synthetic oligonucleotide
actggtgataaggcgattgct

SEQ ID NO: 16207 - DNA, 21 bp, Artificial Sequence
  Description of Artificial Sequence: Synthetic oligonucleotide
ggcaaaaccaccggccaatac

SEQ ID NO: 16208 - DNA, 21 bp, Artificial Sequence
  Description of Artificial Sequence: Synthetic oligonucleotide
agttctactaagacgtcgctt

SEQ ID NO: 16209 - DNA, 21 bp, Artificial Sequence
  Description of Artificial Sequence: Synthetic oligonucleotide
gagggggcgagtgctggtaag

SEQ ID NO: 16210 - DNA, 21 bp, Artificial Sequence
  Description of Artificial Sequence: Synthetic oligonucleotide
caaaccaacaccccccacagc

SEQ ID NO: 16211 - DNA, 21 bp, Artificial Sequence
  Description of Artificial Sequence: Synthetic oligonucleotide
gacagcggcagcagaagcgtc

SEQ ID NO: 16212 - DNA, 21 bp, Artificial Sequence
  Description of Artificial Sequence: Synthetic oligonucleotide
actccgatggataagaaggag

SEQ ID NO: 16213 - DNA, 21 bp, Artificial Sequence
  Description of Artificial Sequence: Synthetic oligonucleotide
agcagaaacaacagcagcgaa

SEQ ID NO: 16214 - DNA, 21 bp, Artificial Sequence
  Description of Artificial Sequence: Synthetic oligonucleotide
agcggcaccaaccacaccacc

SEQ ID NO: 16215 - DNA, 21 bp, Artificial Sequence
  Description of Artificial Sequence: Synthetic oligonucleotide
catggtagtaattcgagtcag

SEQ ID NO: 16216 - DNA, 21 bp, Artificial Sequence
  Description of Artificial Sequence: Synthetic oligonucleotide
ggtggggagaaggtgcattcg

SEQ ID NO: 16217 - DNA, 21 bp, Artificial Sequence
  Description of Artificial Sequence: Synthetic oligonucleotide
ctggtgaataagtcgtctctt

SEQ ID NO: 16218 - DNA, 21 bp, Artificial Sequence
  Description of Artificial Sequence: Synthetic oligonucleotide
gattcgcctaattcgacgaag

SEQ ID NO: 16219 - DNA, 21 bp, Artificial Sequence
  Description of Artificial Sequence: Synthetic oligonucleotide
accaacagcagcagcgtccaa

SEQ ID NO: 16220 - DNA, 21 bp, Artificial Sequence
  Description of Artificial Sequence: Synthetic oligonucleotide
ggggcggatcggggtggttcg

SEQ ID NO: 16221 - DNA, 21 bp, Artificial Sequence
  Description of Artificial Sequence: Synthetic oligonucleotide
cgtgggaatggttctacgtat

SEQ ID NO: 16222 - DNA, 21 bp, Artificial Sequence
  Description of Artificial Sequence: Synthetic oligonucleotide
aacaccggcagccaagcccaa

SEQ ID NO: 16223 - DNA, 21 bp, Artificial Sequence
  Description of Artificial Sequence: Synthetic oligonucleotide
accatcggcggcagccccagc

SEQ ID NO: 16224 - DNA, 21 bp, Artificial Sequence
  Description of Artificial Sequence: Synthetic oligonucleotide
gtgcagaataagcagatgggg

SEQ ID NO: 16225 - DNA, 21 bp, Artificial Sequence
  Description of Artificial Sequence: Synthetic oligonucleotide
agaggcaccagcgaaagaagc

SEQ ID NO: 16226 - DNA, 21 bp, Artificial Sequence
  Description of Artificial Sequence: Synthetic oligonucleotide
cagggtgctccttctattcag

SEQ ID NO: 16227 - DNA, 21 bp, Artificial Sequence
  Description of Artificial Sequence: Synthetic oligonucleotide
cttggtgggagtcagagtaat

SEQ ID NO: 16228 - DNA, 21 bp, Artificial Sequence
  Description of Artificial Sequence: Synthetic oligonucleotide
agcggcacccccgccgccacc

SEQ ID NO: 16229 - DNA, 21 bp, Artificial Sequence
  Description of Artificial Sequence: Synthetic oligonucleotide
gcgacggggagtgagagtcgg

SEQ ID NO: 16230 - DNA, 21 bp, Artificial Sequence
  Description of Artificial Sequence: Synthetic oligonucleotide
ctcggcagccaaaacaacagc

SEQ ID NO: 16231 - DNA, 21 bp, Artificial Sequence
  Description of Artificial Sequence: Synthetic oligonucleotide
aatgtgggtagtacgcatacg

SEQ ID NO: 16232 - DNA, 21 bp, Artificial Sequence
  Description of Artificial Sequence: Synthetic oligonucleotide
gggacggctccgggttcggtg

SEQ ID NO: 16233 - DNA, 21 bp, Artificial Sequence
  Description of Artificial Sequence: Synthetic oligonucleotide
tcgagtcatgagtcgaagggg

SEQ ID NO: 16234 - DNA, 21 bp, Artificial Sequence
  Description of Artificial Sequence: Synthetic oligonucleotide
aatacgacgaagcctaatgat

SEQ ID NO: 16235 - DNA, 21 bp, Artificial Sequence
  Description of Artificial Sequence: Synthetic oligonucleotide
agtcaggcgagtaataagtct

SEQ ID NO: 16236 - DNA, 21 bp, Artificial Sequence
  Description of Artificial Sequence: Synthetic oligonucleotide
ggcagcagcagcaacagaacc

SEQ ID NO: 16237 - DNA, 21 bp, Artificial Sequence
  Description of Artificial Sequence: Synthetic oligonucleotide
agcagcagcgacagaagcagc

SEQ ID NO: 16238 - DNA, 21 bp, Artificial Sequence
  Description of Artificial Sequence: Synthetic oligonucleotide
caaggcagcaccagcggccac

SEQ ID NO: 16239 - DNA, 21 bp, Artificial Sequence
  Description of Artificial Sequence: Synthetic oligonucleotide
acgccggagagtaagtctcag

SEQ ID NO: 16240 - DNA, 21 bp, Artificial Sequence
  Description of Artificial Sequence: Synthetic oligonucleotide
tctacgaatgataagtcgagt

SEQ ID NO: 16241 - DNA, 21 bp, Artificial Sequence
  Description of Artificial Sequence: Synthetic oligonucleotide
tcgttgtctgagaggaaggat

SEQ ID NO: 16242 - DNA, 21 bp, Artificial Sequence
  Description of Artificial Sequence: Synthetic oligonucleotide
aatgttagtaatcttaaggat

SEQ ID NO: 16243 - DNA, 21 bp, Artificial Sequence
  Description of Artificial Sequence: Synthetic oligonucleotide
acggggactggttctcagcct

SEQ ID NO: 16244 - DNA, 21 bp, Artificial Sequence
  Description of Artificial Sequence: Synthetic oligonucleotide
caggggaataatactgcgcat

SEQ ID NO: 16245 - DNA, 21 bp, Artificial Sequence
  Description of Artificial Sequence: Synthetic oligonucleotide
ggtgagcataagactacgagt

SEQ ID NO: 16246 - DNA, 21 bp, Artificial Sequence
  Description of Artificial Sequence: Synthetic oligonucleotide
aaaagcgacgccggcagcacc

SEQ ID NO: 16247 - DNA, 21 bp, Artificial Sequence
  Description of Artificial Sequence: Synthetic oligonucleotide
aatactagtaatccgtcgaat

SEQ ID NO: 16248 - DNA, 21 bp, Artificial Sequence
  Description of Artificial Sequence: Synthetic oligonucleotide
agcagcaccgccccccacaac

SEQ ID NO: 16249 - DNA, 21 bp, Artificial Sequence
  Description of Artificial Sequence: Synthetic oligonucleotide
aggcagggtgataagagtgcg

SEQ ID NO: 16250 - DNA, 21 bp, Artificial Sequence
  Description of Artificial Sequence: Synthetic oligonucleotide
gcgggtgaggggtctacttcg

SEQ ID NO: 16251 - DNA, 21 bp, Artificial Sequence
  Description of Artificial Sequence: Synthetic oligonucleotide
agcagcaacagcacccccagc

SEQ ID NO: 16252 - DNA, 21 bp, Artificial Sequence
  Description of Artificial Sequence: Synthetic oligonucleotide
gaggctgggagtccgactcgg

SEQ ID NO: 16253 - DNA, 21 bp, Artificial Sequence
  Description of Artificial Sequence: Synthetic oligonucleotide
taccccaacgaaaaaacccac

SEQ ID NO: 16254 - DNA, 21 bp, Artificial Sequence
  Description of Artificial Sequence: Synthetic oligonucleotide
ggtactccgggtactggtacg

SEQ ID NO: 16255 - DNA, 21 bp, Artificial Sequence
  Description of Artificial Sequence: Synthetic oligonucleotide
aacgtcggcggcgacaaaaga

SEQ ID NO: 16256 - DNA, 21 bp, Artificial Sequence
  Description of Artificial Sequence: Synthetic oligonucleotide
agtgggaattctgctaattcg

SEQ ID NO: 16257 - DNA, 21 bp, Artificial Sequence
  Description of Artificial Sequence: Synthetic oligonucleotide
ggcgaactcagccaaaacaaa

SEQ ID NO: 16258 - DNA, 21 bp, Artificial Sequence
  Description of Artificial Sequence: Synthetic oligonucleotide
gctggtgataagtctagttct

SEQ ID NO: 16259 - DNA, 21 bp, Artificial Sequence
  Description of Artificial Sequence: Synthetic oligonucleotide
gccggcaacggcgccagccaa

SEQ ID NO: 16260 - DNA, 21 bp, Artificial Sequence
  Description of Artificial Sequence: Synthetic oligonucleotide
accaccagcagcaccggcggc

SEQ ID NO: 16261 - DNA, 21 bp, Artificial Sequence
  Description of Artificial Sequence: Synthetic oligonucleotide
gagggggttcaggggggtcgt

SEQ ID NO: 16262 - DNA, 21 bp, Artificial Sequence
  Description of Artificial Sequence: Synthetic oligonucleotide
aaaaccggcggcaacggcagc

SEQ ID NO: 16263 - DNA, 21 bp, Artificial Sequence
  Description of Artificial Sequence: Synthetic oligonucleotide
ggttctgggcagtctacggct

SEQ ID NO: 16264 - DNA, 21 bp, Artificial Sequence
  Description of Artificial Sequence: Synthetic oligonucleotide
gcgggttcgacgtcgcctcgt

SEQ ID NO: 16265 - DNA, 21 bp, Artificial Sequence
  Description of Artificial Sequence: Synthetic oligonucleotide
cagaatgcgaagagtacgagt

SEQ ID NO: 16266 - DNA, 21 bp, Artificial Sequence
  Description of Artificial Sequence: Synthetic oligonucleotide
gacaacacccccaccaacaga

SEQ ID NO: 16267 - DNA, 21 bp, Artificial Sequence
  Description of Artificial Sequence: Synthetic oligonucleotide
acgcagggtggttctactgcg

SEQ ID NO: 16268 - DNA, 21 bp, Artificial Sequence
  Description of Artificial Sequence: Synthetic oligonucleotide
ggcagcggccaaaccaccagc

SEQ ID NO: 16269 - DNA, 21 bp, Artificial Sequence
  Description of Artificial Sequence: Synthetic oligonucleotide
gccgacggcagcagcggcaga

SEQ ID NO: 16270 - DNA, 21 bp, Artificial Sequence
  Description of Artificial Sequence: Synthetic oligonucleotide
aataatgggtctgcttctaat

SEQ ID NO: 16271 - DNA, 21 bp, Artificial Sequence
  Description of Artificial Sequence: Synthetic oligonucleotide
agtggtgagtctactcgtcat

SEQ ID NO: 16272 - DNA, 21 bp, Artificial Sequence
  Description of Artificial Sequence: Synthetic oligonucleotide
gacagcatcagcaaagccacc

SEQ ID NO: 16273 - DNA, 21 bp, Artificial Sequence
  Description of Artificial Sequence: Synthetic oligonucleotide
acgggtggtagtcctctttct

SEQ ID NO: 16274 - DNA, 21 bp, Artificial Sequence
  Description of Artificial Sequence: Synthetic oligonucleotide
agcaccagcaacaccagccac

SEQ ID NO: 16275 - DNA, 21 bp, Artificial Sequence
  Description of Artificial Sequence: Synthetic oligonucleotide
ctcgccggcaaccccggccac

SEQ ID NO: 16276 - DNA, 21 bp, Artificial Sequence
  Description of Artificial Sequence: Synthetic oligonucleotide
ggcgaagccaaacaccaaccc

SEQ ID NO: 16277 - DNA, 21 bp, Artificial Sequence
  Description of Artificial Sequence: Synthetic oligonucleotide
gccaccaacggcaaacccatc

SEQ ID NO: 16278 - DNA, 21 bp, Artificial Sequence
  Description of Artificial Sequence: Synthetic oligonucleotide
ggcgccgacagcaaaaacagc

SEQ ID NO: 16279 - DNA, 21 bp, Artificial Sequence
  Description of Artificial Sequence: Synthetic oligonucleotide
gacagcgccggcaaaatgggc

SEQ ID NO: 16280 - DNA, 21 bp, Artificial Sequence
  Description of Artificial Sequence: Synthetic oligonucleotide
tcgcagggtgcttctacggct

SEQ ID NO: 16281 - DNA, 21 bp, Artificial Sequence
  Description of Artificial Sequence: Synthetic oligonucleotide
ggtgggggtgagcatagggct

SEQ ID NO: 16282 - DNA, 21 bp, Artificial Sequence
  Description of Artificial Sequence: Synthetic oligonucleotide
agtacggggcatgagcgggtt

SEQ ID NO: 16283 - DNA, 21 bp, Artificial Sequence
  Description of Artificial Sequence: Synthetic oligonucleotide
gccgaaggcaaaaccagcagc

SEQ ID NO: 16284 - DNA, 21 bp, Artificial Sequence
  Description of Artificial Sequence: Synthetic oligonucleotide
gacagcggcagcagccccaaa

SEQ ID NO: 16285 - DNA, 21 bp, Artificial Sequence
  Description of Artificial Sequence: Synthetic oligonucleotide
gaaggccaccaaaccaaaagc

SEQ ID NO: 16286 - DNA, 21 bp, Artificial Sequence
  Description of Artificial Sequence: Synthetic oligonucleotide
gacggcaacggcggcaccaga

SEQ ID NO: 16287 - DNA, 21 bp, Artificial Sequence
  Description of Artificial Sequence: Synthetic oligonucleotide
cagcagtctgcgactagtcag

SEQ ID NO: 16288 - DNA, 21 bp, Artificial Sequence
  Description of Artificial Sequence: Synthetic oligonucleotide
caagccagcagccaaaaccaa

SEQ ID NO: 16289 - DNA, 21 bp, Artificial Sequence
  Description of Artificial Sequence: Synthetic oligonucleotide
catagtactgggggtcagggg

SEQ ID NO: 16290 - DNA, 21 bp, Artificial Sequence
  Description of Artificial Sequence: Synthetic oligonucleotide
gacagaaccgacaaaaacacc

SEQ ID NO: 16291 - DNA, 21 bp, Artificial Sequence
  Description of Artificial Sequence: Synthetic oligonucleotide
ggtaagacgggtcagagtgcg

SEQ ID NO: 16292 - DNA, 21 bp, Artificial Sequence
  Description of Artificial Sequence: Synthetic oligonucleotide
gctgcgactactagtactacg

SEQ ID NO: 16293 - DNA, 21 bp, Artificial Sequence
  Description of Artificial Sequence: Synthetic oligonucleotide
gatattgggtcgaagcgggat

SEQ ID NO: 16294 - DNA, 21 bp, Artificial Sequence
  Description of Artificial Sequence: Synthetic oligonucleotide
gagcagcgtgctaatcctact

SEQ ID NO: 16295 - DNA, 21 bp, Artificial Sequence
  Description of Artificial Sequence: Synthetic oligonucleotide
catcagacttcggggagtaat

SEQ ID NO: 16296 - DNA, 21 bp, Artificial Sequence
  Description of Artificial Sequence: Synthetic oligonucleotide
gataatgcgtcgagggcggcg

SEQ ID NO: 16297 - DNA, 21 bp, Artificial Sequence
  Description of Artificial Sequence: Synthetic oligonucleotide
tcttcgagtcagaagtcgaat

SEQ ID NO: 16298 - DNA, 21 bp, Artificial Sequence
  Description of Artificial Sequence: Synthetic oligonucleotide
agcaaaggcgacaaaaccatc

SEQ ID NO: 16299 - DNA, 21 bp, Artificial Sequence
  Description of Artificial Sequence: Synthetic oligonucleotide
agcagcagcaccacccccgtc

SEQ ID NO: 16300 - DNA, 21 bp, Artificial Sequence
  Description of Artificial Sequence: Synthetic oligonucleotide
gatgctcgtagtgggcaggct

SEQ ID NO: 16301 - DNA, 21 bp, Artificial Sequence
  Description of Artificial Sequence: Synthetic oligonucleotide
agcggcaacggcaccgtccaa

SEQ ID NO: 16302 - DNA, 21 bp, Artificial Sequence
  Description of Artificial Sequence: Synthetic oligonucleotide
agcggcgccaccagcaacagc

SEQ ID NO: 16303 - DNA, 21 bp, Artificial Sequence
  Description of Artificial Sequence: Synthetic oligonucleotide
gttgctaatggtacggctaag

SEQ ID NO: 16304 - DNA, 21 bp, Artificial Sequence
  Description of Artificial Sequence: Synthetic oligonucleotide
ggcagcagcggcagcaacctc

SEQ ID NO: 16305 - DNA, 21 bp, Artificial Sequence
  Description of Artificial Sequence: Synthetic oligonucleotide
gggcgggaggggtcgtcgagt

SEQ ID NO: 16306 - DNA, 21 bp, Artificial Sequence
  Description of Artificial Sequence: Synthetic oligonucleotide
ggcatcggcagcagccccagc

SEQ ID NO: 16307 - DNA, 21 bp, Artificial Sequence
  Description of Artificial Sequence: Synthetic oligonucleotide
ggcggcggcagagacgtcgcc

SEQ ID NO: 16308 - DNA, 21 bp, Artificial Sequence
  Description of Artificial Sequence: Synthetic oligonucleotide
accgccagcaccgccaccgtc

SEQ ID NO: 16309 - DNA, 21 bp, Artificial Sequence
  Description of Artificial Sequence: Synthetic oligonucleotide
aatgggtctcagaaggttcag

SEQ ID NO: 16310 - DNA, 21 bp, Artificial Sequence
  Description of Artificial Sequence: Synthetic oligonucleotide
aacggcaacaccaacggccaa

SEQ ID NO: 16311 - DNA, 21 bp, Artificial Sequence
  Description of Artificial Sequence: Synthetic oligonucleotide
ctcggcagcggcagcaccacc

SEQ ID NO: 16312 - DNA, 21 bp, Artificial Sequence
  Description of Artificial Sequence: Synthetic oligonucleotide
aatagtggtggttcttcgtct

SEQ ID NO: 16313 - DNA, 21 bp, Artificial Sequence
  Description of Artificial Sequence: Synthetic oligonucleotide
aatggtaatcctactccttcg

SEQ ID NO: 16314 - DNA, 21 bp, Artificial Sequence
  Description of Artificial Sequence: Synthetic oligonucleotide
tctggtacgaatcatactggt

SEQ ID NO: 16315 - DNA, 21 bp, Artificial Sequence
  Description of Artificial Sequence: Synthetic oligonucleotide
gggactggttctgatcgtact

SEQ ID NO: 16316 - DNA, 21 bp, Artificial Sequence
  Description of Artificial Sequence: Synthetic oligonucleotide
gtccccagcagcaaccccaac

SEQ ID NO: 16317 - DNA, 21 bp, Artificial Sequence
  Description of Artificial Sequence: Synthetic oligonucleotide
cagacgccgagtaagatgtct

SEQ ID NO: 16318 - DNA, 21 bp, Artificial Sequence
  Description of Artificial Sequence: Synthetic oligonucleotide
gaaggcaaaagcagcctcgcc

SEQ ID NO: 16319 - DNA, 21 bp, Artificial Sequence
  Description of Artificial Sequence: Synthetic oligonucleotide
gctaatggtgcgggttctcat

SEQ ID NO: 16320 - DNA, 21 bp, Artificial Sequence
  Description of Artificial Sequence: Synthetic oligonucleotide
agactcgacaacaccggcggc

SEQ ID NO: 16321 - DNA, 21 bp, Artificial Sequence
  Description of Artificial Sequence: Synthetic oligonucleotide
aataaggtgcagagtcatgag

SEQ ID NO: 16322 - DNA, 21 bp, Artificial Sequence
  Description of Artificial Sequence: Synthetic oligonucleotide
agcaccggcgccaccagcagc

SEQ ID NO: 16323 - DNA, 21 bp, Artificial Sequence
  Description of Artificial Sequence: Synthetic oligonucleotide
catactgataagagtggggct

SEQ ID NO: 16324 - DNA, 21 bp, Artificial Sequence
  Description of Artificial Sequence: Synthetic oligonucleotide
actgggagtagtactattact

SEQ ID NO: 16325 - DNA, 21 bp, Artificial Sequence
  Description of Artificial Sequence: Synthetic oligonucleotide
ctgagttctcagaagggtaat

SEQ ID NO: 16326 - DNA, 21 bp, Artificial Sequence
  Description of Artificial Sequence: Synthetic oligonucleotide
atgcccagcaacagcagcacc

SEQ ID NO: 16327 - DNA, 21 bp, Artificial Sequence
  Description of Artificial Sequence: Synthetic oligonucleotide
accagaaacacccccaccgaa

SEQ ID NO: 16328 - DNA, 21 bp, Artificial Sequence
  Description of Artificial Sequence: Synthetic oligonucleotide
gccgtcgacaacaaaagccac

SEQ ID NO: 16329 - DNA, 21 bp, Artificial Sequence
  Description of Artificial Sequence: Synthetic oligonucleotide
aacagcgtcagcagcaccggc

SEQ ID NO: 16330 - DNA, 21 bp, Artificial Sequence
  Description of Artificial Sequence: Synthetic oligonucleotide
gccgccagcagcaccccccaa

SEQ ID NO: 16331 - DNA, 21 bp, Artificial Sequence
  Description of Artificial Sequence: Synthetic oligonucleotide
ggcagcagagacagcaccggc

SEQ ID NO: 16332 - DNA, 21 bp, Artificial Sequence
  Description of Artificial Sequence: Synthetic oligonucleotide
ggcgaactcaaaaacgccggc

SEQ ID NO: 16333 - DNA, 21 bp, Artificial Sequence
  Description of Artificial Sequence: Synthetic oligonucleotide
tcgggtagggatgggcataat

SEQ ID NO: 16334 - DNA, 21 bp, Artificial Sequence
  Description of Artificial Sequence: Synthetic oligonucleotide
agcgccggcaacggcaaaagc

SEQ ID NO: 16335 - DNA, 21 bp, Artificial Sequence
  Description of Artificial Sequence: Synthetic oligonucleotide
gacaacaaaaccgccagcaac

SEQ ID NO: 16336 - DNA, 21 bp, Artificial Sequence
  Description of Artificial Sequence: Synthetic oligonucleotide
accgccaccgaaagcagaggc

SEQ ID NO: 16337 - DNA, 21 bp, Artificial Sequence
  Description of Artificial Sequence: Synthetic oligonucleotide
gccaccaccccccccaccagc

SEQ ID NO: 16338 - DNA, 21 bp, Artificial Sequence
  Description of Artificial Sequence: Synthetic oligonucleotide
cagagttcgaatcagatgacg

SEQ ID NO: 16339 - DNA, 21 bp, Artificial Sequence
  Description of Artificial Sequence: Synthetic oligonucleotide
gggaatcatcagccttcttct

SEQ ID NO: 16340 - DNA, 21 bp, Artificial Sequence
  Description of Artificial Sequence: Synthetic oligonucleotide
acgagtaagcctaatccgtct

SEQ ID NO: 16341 - DNA, 21 bp, Artificial Sequence
  Description of Artificial Sequence: Synthetic oligonucleotide
actgggggtactaattctgtt

SEQ ID NO: 16342 - DNA, 21 bp, Artificial Sequence
  Description of Artificial Sequence: Synthetic oligonucleotide
gacaccggcgtcaacagaggc

SEQ ID NO: 16343 - DNA, 21 bp, Artificial Sequence
  Description of Artificial Sequence: Synthetic oligonucleotide
tctggggctggtactcctagt

SEQ ID NO: 16344 - DNA, 21 bp, Artificial Sequence
  Description of Artificial Sequence: Synthetic oligonucleotide
gataatactgttaagactaat

SEQ ID NO: 16345 - DNA, 21 bp, Artificial Sequence
  Description of Artificial Sequence: Synthetic oligonucleotide
gatcagggttctgttagtaag

SEQ ID NO: 16346 - DNA, 21 bp, Artificial Sequence
  Description of Artificial Sequence: Synthetic oligonucleotide
gccatgggcgacagcaaaggc

SEQ ID NO: 16347 - DNA, 21 bp, Artificial Sequence
  Description of Artificial Sequence: Synthetic oligonucleotide
ggcaacagcgccggcggcgcc

SEQ ID NO: 16348 - DNA, 21 bp, Artificial Sequence
  Description of Artificial Sequence: Synthetic oligonucleotide
ggtactgctaaggatgttgct

SEQ ID NO: 16349 - DNA, 21 bp, Artificial Sequence
  Description of Artificial Sequence: Synthetic oligonucleotide
gacagagccgacaaaatgggc

SEQ ID NO: 16350 - DNA, 21 bp, Artificial Sequence
  Description of Artificial Sequence: Synthetic oligonucleotide
gacagaggcaccccccccacc

SEQ ID NO: 16351 - DNA, 21 bp, Artificial Sequence
  Description of Artificial Sequence: Synthetic oligonucleotide
ggcgacggcggcagcctcaaa

SEQ ID NO: 16352 - DNA, 21 bp, Artificial Sequence
  Description of Artificial Sequence: Synthetic oligonucleotide
accatgagcgacaaaggcatg

SEQ ID NO: 16353 - DNA, 21 bp, Artificial Sequence
  Description of Artificial Sequence: Synthetic oligonucleotide
aacaccatcggcgacaacaaa

SEQ ID NO: 16354 - DNA, 21 bp, Artificial Sequence
  Description of Artificial Sequence: Synthetic oligonucleotide
accaccagcgacggcgccaaa

SEQ ID NO: 16355 - DNA, 21 bp, Artificial Sequence
  Description of Artificial Sequence: Synthetic oligonucleotide
agcaacagcaacggccacagc

SEQ ID NO: 16356 - DNA, 21 bp, Artificial Sequence
  Description of Artificial Sequence: Synthetic oligonucleotide
agtggttcgcctcctgctgct

SEQ ID NO: 16357 - DNA, 21 bp, Artificial Sequence
  Description of Artificial Sequence: Synthetic oligonucleotide
agtgggtcgaatcagcctagg

SEQ ID NO: 16358 - DNA, 21 bp, Artificial Sequence
  Description of Artificial Sequence: Synthetic oligonucleotide
cgggatgggtctggtaaggtg

SEQ ID NO: 16359 - DNA, 21 bp, Artificial Sequence
  Description of Artificial Sequence: Synthetic oligonucleotide
aaccaagccgccagccccgtc

SEQ ID NO: 16360 - DNA, 21 bp, Artificial Sequence
  Description of Artificial Sequence: Synthetic oligonucleotide
tcgggttctgcttcgaatgtt

SEQ ID NO: 16361 - DNA, 21 bp, Artificial Sequence
  Description of Artificial Sequence: Synthetic oligonucleotide
agtattgctaaggatcgggcg

SEQ ID NO: 16362 - DNA, 21 bp, Artificial Sequence
  Description of Artificial Sequence: Synthetic oligonucleotide
gatcgtacggttaaggaggtt

SEQ ID NO: 16363 - DNA, 21 bp, Artificial Sequence
  Description of Artificial Sequence: Synthetic oligonucleotide
accaaaaacagccaagtcgtc

SEQ ID NO: 16364 - DNA, 21 bp, Artificial Sequence
  Description of Artificial Sequence: Synthetic oligonucleotide
gaaagcgccaacagaaacgcc

SEQ ID NO: 16365 - DNA, 21 bp, Artificial Sequence
  Description of Artificial Sequence: Synthetic oligonucleotide
agccacagcgaaagcgccaaa

SEQ ID NO: 16366 - DNA, 21 bp, Artificial Sequence
  Description of Artificial Sequence: Synthetic oligonucleotide
agcggcgtcggcggcaaagaa

SEQ ID NO: 16367 - DNA, 21 bp, Artificial Sequence
  Description of Artificial Sequence: Synthetic oligonucleotide
gccccccccgaaggcgccaaa

SEQ ID NO: 16368 - DNA, 21 bp, Artificial Sequence
  Description of Artificial Sequence: Synthetic oligonucleotide
aatgcgcagggggcgaatgct

SEQ ID NO: 16369 - DNA, 21 bp, Artificial Sequence
  Description of Artificial Sequence: Synthetic oligonucleotide
caagtcggcgcccaaaacagc

SEQ ID NO: 16370 - DNA, 21 bp, Artificial Sequence
  Description of Artificial Sequence: Synthetic oligonucleotide
cacagcaacggccacgcccaa

SEQ ID NO: 16371 - DNA, 21 bp, Artificial Sequence
  Description of Artificial Sequence: Synthetic oligonucleotide
ggcaacgccagccccagcgtc

SEQ ID NO: 16372 - DNA, 21 bp, Artificial Sequence
  Description of Artificial Sequence: Synthetic oligonucleotide
ggggattcgaagagtacgctt

SEQ ID NO: 16373 - DNA, 21 bp, Artificial Sequence
  Description of Artificial Sequence: Synthetic oligonucleotide
actcgggctagtggttctact

SEQ ID NO: 16374 - DNA, 21 bp, Artificial Sequence
  Description of Artificial Sequence: Synthetic oligonucleotide
agcgtcacccccagcggcggc

SEQ ID NO: 16375 - DNA, 21 bp, Artificial Sequence
  Description of Artificial Sequence: Synthetic oligonucleotide
acgagtcagacttctactact

SEQ ID NO: 16376 - DNA, 21 bp, Artificial Sequence
  Description of Artificial Sequence: Synthetic oligonucleotide
gaagccaaaagcgaccacaga

SEQ ID NO: 16377 - DNA, 21 bp, Artificial Sequence
  Description of Artificial Sequence: Synthetic oligonucleotide
gccgaaagccacaacgtcaaa

SEQ ID NO: 16378 - DNA, 21 bp, Artificial Sequence
  Description of Artificial Sequence: Synthetic oligonucleotide
ggcatcggcagccccaccgcc

SEQ ID NO: 16379 - DNA, 21 bp, Artificial Sequence
  Description of Artificial Sequence: Synthetic oligonucleotide
ggccaaggcgccggcgccagc

SEQ ID NO: 16380 - DNA, 21 bp, Artificial Sequence
  Description of Artificial Sequence: Synthetic oligonucleotide
caacaaggcagcggcagccac

SEQ ID NO: 16381 - DNA, 21 bp, Artificial Sequence
  Description of Artificial Sequence: Synthetic oligonucleotide
gacaaccccaccaaaacccaa

SEQ ID NO: 16382 - DNA, 21 bp, Artificial Sequence
  Description of Artificial Sequence: Synthetic oligonucleotide
actggtactacggctgctact

SEQ ID NO: 16383 - DNA, 21 bp, Artificial Sequence
  Description of Artificial Sequence: Synthetic oligonucleotide
acttcggggtctgctccgact

SEQ ID NO: 16384 - DNA, 21 bp, Artificial Sequence
  Description of Artificial Sequence: Synthetic oligonucleotide
gggactggttcgacttctaat

SEQ ID NO: 16385 - DNA, 21 bp, Artificial Sequence
  Description of Artificial Sequence: Synthetic oligonucleotide
aattctgggtctaattctatg

SEQ ID NO: 16386 - DNA, 21 bp, Artificial Sequence
  Description of Artificial Sequence: Synthetic oligonucleotide
caaaccggccaacacagcacc

SEQ ID NO: 16387 - DNA, 21 bp, Artificial Sequence
  Description of Artificial Sequence: Synthetic oligonucleotide
ggcgaccccaaaaacagcggc

SEQ ID NO: 16388 - DNA, 21 bp, Artificial Sequence
  Description of Artificial Sequence: Synthetic oligonucleotide
tcttcgccgccgccttcgcat

SEQ ID NO: 16389 - DNA, 21 bp, Artificial Sequence
  Description of Artificial Sequence: Synthetic oligonucleotide
ggccaagacagagtcgccagc

SEQ ID NO: 16390 - DNA, 21 bp, Artificial Sequence
  Description of Artificial Sequence: Synthetic oligonucleotide
gaggtggcgcagccttctaat

SEQ ID NO: 16391 - DNA, 21 bp, Artificial Sequence
  Description of Artificial Sequence: Synthetic oligonucleotide
ctcaacgaacacaaagtcagc

SEQ ID NO: 16392 - DNA, 21 bp, Artificial Sequence
  Description of Artificial Sequence: Synthetic oligonucleotide
ggtgagactggtcagcataag

SEQ ID NO: 16393 - DNA, 21 bp, Artificial Sequence
  Description of Artificial Sequence: Synthetic oligonucleotide
tcgactcaggaggctaagcat

SEQ ID NO: 16394 - DNA, 21 bp, Artificial Sequence
  Description of Artificial Sequence: Synthetic oligonucleotide
cagagtcatgataagactaat

SEQ ID NO: 16395 - DNA, 21 bp, Artificial Sequence
  Description of Artificial Sequence: Synthetic oligonucleotide
cacagcgacaccagcaaaagc

SEQ ID NO: 16396 - DNA, 21 bp, Artificial Sequence
  Description of Artificial Sequence: Synthetic oligonucleotide
agcggcatcggcaccagcacc

SEQ ID NO: 16397 - DNA, 21 bp, Artificial Sequence
  Description of Artificial Sequence: Synthetic oligonucleotide
aatacgggggagactccgagg

SEQ ID NO: 16398 - DNA, 21 bp, Artificial Sequence
  Description of Artificial Sequence: Synthetic oligonucleotide
caggggggtgatagtacgcgt

SEQ ID NO: 16399 - DNA, 21 bp, Artificial Sequence
  Description of Artificial Sequence: Synthetic oligonucleotide
acgacgactgagaagtctggt

SEQ ID NO: 16400 - DNA, 21 bp, Artificial Sequence
  Description of Artificial Sequence: Synthetic oligonucleotide
acgactactgcgacttctcag

SEQ ID NO: 16401 - DNA, 21 bp, Artificial Sequence
  Description of Artificial Sequence: Synthetic oligonucleotide
tctggggcgaagtcggatgct

SEQ ID NO: 16402 - DNA, 21 bp, Artificial Sequence
  Description of Artificial Sequence: Synthetic oligonucleotide
aacagcgccgacaaaagcatc

SEQ ID NO: 16403 - DNA, 21 bp, Artificial Sequence
  Description of Artificial Sequence: Synthetic oligonucleotide
gccagcagccccagcagcatg

SEQ ID NO: 16404 - DNA, 21 bp, Artificial Sequence
  Description of Artificial Sequence: Synthetic oligonucleotide
gcgcctagttctaatcctgtt

SEQ ID NO: 16405 - DNA, 21 bp, Artificial Sequence
  Description of Artificial Sequence: Synthetic oligonucleotide
ggcatcgacgccaaaatgagc

SEQ ID NO: 16406 - DNA, 21 bp, Artificial Sequence
  Description of Artificial Sequence: Synthetic oligonucleotide
gatacggtttctaagacggct

SEQ ID NO: 16407 - DNA, 21 bp, Artificial Sequence
  Description of Artificial Sequence: Synthetic oligonucleotide
aattcgggtagtcaggcgaat

SEQ ID NO: 16408 - DNA, 21 bp, Artificial Sequence
  Description of Artificial Sequence: Synthetic oligonucleotide
accagccaagcccaaaccggc

SEQ ID NO: 16409 - DNA, 21 bp, Artificial Sequence
  Description of Artificial Sequence: Synthetic oligonucleotide
accggccaacccagcagcgtc

SEQ ID NO: 16410 - DNA, 21 bp, Artificial Sequence
  Description of Artificial Sequence: Synthetic oligonucleotide
agcaccggccaagcccccagc

SEQ ID NO: 16411 - DNA, 21 bp, Artificial Sequence
  Description of Artificial Sequence: Synthetic oligonucleotide
agccccggccacaaactcatg

SEQ ID NO: 16412 - DNA, 21 bp, Artificial Sequence
  Description of Artificial Sequence: Synthetic oligonucleotide
ggcaccgaaaccaaaaccggc

SEQ ID NO: 16413 - DNA, 21 bp, Artificial Sequence
  Description of Artificial Sequence: Synthetic oligonucleotide
ggtggtgatcagggggttaag

SEQ ID NO: 16414 - DNA, 21 bp, Artificial Sequence
  Description of Artificial Sequence: Synthetic oligonucleotide
gtcgtcggcagaacccccggc

SEQ ID NO: 16415 - DNA, 21 bp, Artificial Sequence
  Description of Artificial Sequence: Synthetic oligonucleotide
gaaggcagcaaaacccccgtc

SEQ ID NO: 16416 - DNA, 21 bp, Artificial Sequence
  Description of Artificial Sequence: Synthetic oligonucleotide
accagcgacagaaccagcacc

SEQ ID NO: 16417 - DNA, 21 bp, Artificial Sequence
  Description of Artificial Sequence: Synthetic oligonucleotide
atgaagcagacgtcggctgtg

SEQ ID NO: 16418 - DNA, 21 bp, Artificial Sequence
  Description of Artificial Sequence: Synthetic oligonucleotide
gacgtccccaccagcaaagcc

SEQ ID NO: 16419 - DNA, 21 bp, Artificial Sequence
  Description of Artificial Sequence: Synthetic oligonucleotide
actgcggcgactgtggctaag

SEQ ID NO: 16420 - DNA, 21 bp, Artificial Sequence
  Description of Artificial Sequence: Synthetic oligonucleotide
aggcagtctgataaggtttct

SEQ ID NO: 16421 - DNA, 21 bp, Artificial Sequence
  Description of Artificial Sequence: Synthetic oligonucleotide
ggcctccaaaccaacggcacc

SEQ ID NO: 16422 - DNA, 21 bp, Artificial Sequence
  Description of Artificial Sequence: Synthetic oligonucleotide
agcggcgtccaagccaccaac

SEQ ID NO: 16423 - DNA, 21 bp, Artificial Sequence
  Description of Artificial Sequence: Synthetic oligonucleotide
gctacgaatgagaagacgttt

SEQ ID NO: 16424 - DNA, 21 bp, Artificial Sequence
  Description of Artificial Sequence: Synthetic oligonucleotide
tctggggaggctaaggttgct

SEQ ID NO: 16425 - DNA, 21 bp, Artificial Sequence
  Description of Artificial Sequence: Synthetic oligonucleotide
gacagcgccaaacccaacagc

SEQ ID NO: 16426 - DNA, 21 bp, Artificial Sequence
  Description of Artificial Sequence: Synthetic oligonucleotide
actacgggggcgtctcctatt

SEQ ID NO: 16427 - DNA, 21 bp, Artificial Sequence
  Description of Artificial Sequence: Synthetic oligonucleotide
gttacggggaatgctggtact

SEQ ID NO: 16428 - DNA, 21 bp, Artificial Sequence
  Description of Artificial Sequence: Synthetic oligonucleotide
aatacgacttcgggtaataat

SEQ ID NO: 16429 - DNA, 21 bp, Artificial Sequence
  Description of Artificial Sequence: Synthetic oligonucleotide
aatgatagtcagaaggtggct

SEQ ID NO: 16430 - DNA, 21 bp, Artificial Sequence
  Description of Artificial Sequence: Synthetic oligonucleotide
gcgagtacgggttcgagtaag

SEQ ID NO: 16431 - DNA, 21 bp, Artificial Sequence
  Description of Artificial Sequence: Synthetic oligonucleotide
tcgtctgggggggcgtcgacg

SEQ ID NO: 16432 - DNA, 21 bp, Artificial Sequence
  Description of Artificial Sequence: Synthetic oligonucleotide
gacggcagacaaaccaccagc

SEQ ID NO: 16433 - DNA, 21 bp, Artificial Sequence
  Description of Artificial Sequence: Synthetic oligonucleotide
gctggggagactgcgaggacg

SEQ ID NO: 16434 - DNA, 21 bp, Artificial Sequence
  Description of Artificial Sequence: Synthetic oligonucleotide
gccagcaacagccccgtcagc

SEQ ID NO: 16435 - DNA, 21 bp, Artificial Sequence
  Description of Artificial Sequence: Synthetic oligonucleotide
agcggcaaaggcagcagcgtc

SEQ ID NO: 16436 - DNA, 21 bp, Artificial Sequence
  Description of Artificial Sequence: Synthetic oligonucleotide
tctgggagtgagtcgccgaag

SEQ ID NO: 16437 - DNA, 21 bp, Artificial Sequence
  Description of Artificial Sequence: Synthetic oligonucleotide
accgccagcggcaccccccaa

SEQ ID NO: 16438 - DNA, 21 bp, Artificial Sequence
  Description of Artificial Sequence: Synthetic oligonucleotide
aacaccggcagcgccagcatc

SEQ ID NO: 16439 - DNA, 21 bp, Artificial Sequence
  Description of Artificial Sequence: Synthetic oligonucleotide
gaggctactgttaagacgggg

SEQ ID NO: 16440 - DNA, 21 bp, Artificial Sequence
  Description of Artificial Sequence: Synthetic oligonucleotide
atccaaaaaggcaacaacgaa

SEQ ID NO: 16441 - DNA, 21 bp, Artificial Sequence
  Description of Artificial Sequence: Synthetic oligonucleotide
gattcgaataagcagaatctt

SEQ ID NO: 16442 - DNA, 21 bp, Artificial Sequence
  Description of Artificial Sequence: Synthetic oligonucleotide
actggtggtaatccggttacg

SEQ ID NO: 16443 - DNA, 21 bp, Artificial Sequence
  Description of Artificial Sequence: Synthetic oligonucleotide
caaggcagcaacaacagcaga

SEQ ID NO: 16444 - DNA, 21 bp, Artificial Sequence
  Description of Artificial Sequence: Synthetic oligonucleotide
aaagtcgccaccagcagcagc

SEQ ID NO: 16445 - DNA, 21 bp, Artificial Sequence
  Description of Artificial Sequence: Synthetic oligonucleotide
gacagcagcagagaagccaga

SEQ ID NO: 16446 - DNA, 21 bp, Artificial Sequence
  Description of Artificial Sequence: Synthetic oligonucleotide
gaaggcagcagcagcagcatg

SEQ ID NO: 16447 - DNA, 21 bp, Artificial Sequence
  Description of Artificial Sequence: Synthetic oligonucleotide
aataatggttcttctgttgcg

SEQ ID NO: 16448 - DNA, 21 bp, Artificial Sequence
  Description of Artificial Sequence: Synthetic oligonucleotide
gaaaccagcgaaagaaaccaa

SEQ ID NO: 16449 - DNA, 21 bp, Artificial Sequence
  Description of Artificial Sequence: Synthetic oligonucleotide
gacagcggcaccggccccacc

SEQ ID NO: 16450 - DNA, 21 bp, Artificial Sequence
  Description of Artificial Sequence: Synthetic oligonucleotide
gatagtgctaagtctagtgtt

SEQ ID NO: 16451 - DNA, 21 bp, Artificial Sequence
  Description of Artificial Sequence: Synthetic oligonucleotide
tctgatactaagacgtctacg

SEQ ID NO: 16452 - DNA, 21 bp, Artificial Sequence
  Description of Artificial Sequence: Synthetic oligonucleotide
cagggtcagggtcaggctagt

SEQ ID NO: 16453 - DNA, 21 bp, Artificial Sequence
  Description of Artificial Sequence: Synthetic oligonucleotide
aacaacggcgtcagcagcacc

SEQ ID NO: 16454 - DNA, 21 bp, Artificial Sequence
  Description of Artificial Sequence: Synthetic oligonucleotide
agacaagccagcagcaccacc

SEQ ID NO: 16455 - DNA, 21 bp, Artificial Sequence
  Description of Artificial Sequence: Synthetic oligonucleotide
agcaacaacgccagccccagc

SEQ ID NO: 16456 - DNA, 21 bp, Artificial Sequence
  Description of Artificial Sequence: Synthetic oligonucleotide
agcgacggcaaaagccacccc

SEQ ID NO: 16457 - DNA, 21 bp, Artificial Sequence
  Description of Artificial Sequence: Synthetic oligonucleotide
tcgcctagtaattcgcatagt

SEQ ID NO: 16458 - DNA, 21 bp, Artificial Sequence
  Description of Artificial Sequence: Synthetic oligonucleotide
gctcagtctgagaagacgctt

SEQ ID NO: 16459 - DNA, 21 bp, Artificial Sequence
  Description of Artificial Sequence: Synthetic oligonucleotide
tctacttctaaggattatagt

SEQ ID NO: 16460 - DNA, 21 bp, Artificial Sequence
  Description of Artificial Sequence: Synthetic oligonucleotide
agcaccggcgccaccagcaac

SEQ ID NO: 16461 - DNA, 21 bp, Artificial Sequence
  Description of Artificial Sequence: Synthetic oligonucleotide
accggcagcggcagcagcagc

SEQ ID NO: 16462 - DNA, 21 bp, Artificial Sequence
  Description of Artificial Sequence: Synthetic oligonucleotide
actgggtctaatcatcctggt

SEQ ID NO: 16463 - DNA, 21 bp, Artificial Sequence
  Description of Artificial Sequence: Synthetic oligonucleotide
accagagcccccaccaccggc

SEQ ID NO: 16464 - DNA, 21 bp, Artificial Sequence
  Description of Artificial Sequence: Synthetic oligonucleotide
agtggggtgaatacgccggct

SEQ ID NO: 16465 - DNA, 21 bp, Artificial Sequence
  Description of Artificial Sequence: Synthetic oligonucleotide
cacggcgccggccaaagcagc

SEQ ID NO: 16466 - DNA, 21 bp, Artificial Sequence
  Description of Artificial Sequence: Synthetic oligonucleotide
ggtggtgggaatacggctatg

SEQ ID NO: 16467 - DNA, 21 bp, Artificial Sequence
  Description of Artificial Sequence: Synthetic oligonucleotide
ggttcttctgcgcctgctctg

SEQ ID NO: 16468 - DNA, 21 bp, Artificial Sequence
  Description of Artificial Sequence: Synthetic oligonucleotide
cagaatgctacgactagttct

SEQ ID NO: 16469 - DNA, 21 bp, Artificial Sequence
  Description of Artificial Sequence: Synthetic oligonucleotide
ggcagccaaaacggcctcagc

SEQ ID NO: 16470 - DNA, 21 bp, Artificial Sequence
  Description of Artificial Sequence: Synthetic oligonucleotide
cagtctactcctggtactcag

SEQ ID NO: 16471 - DNA, 21 bp, Artificial Sequence
  Description of Artificial Sequence: Synthetic oligonucleotide
aggaaggagcagtcgagtcag

SEQ ID NO: 16472 - DNA, 21 bp, Artificial Sequence
  Description of Artificial Sequence: Synthetic oligonucleotide
ggggttgggggggcttcgtct

SEQ ID NO: 16473 - DNA, 21 bp, Artificial Sequence
  Description of Artificial Sequence: Synthetic oligonucleotide
aggcagagtgggagtaaggat

SEQ ID NO: 16474 - DNA, 21 bp, Artificial Sequence
  Description of Artificial Sequence: Synthetic oligonucleotide
gccacccaaagcgccagcagc

SEQ ID NO: 16475 - DNA, 21 bp, Artificial Sequence
  Description of Artificial Sequence: Synthetic oligonucleotide
agaaacggcggcagcagcatg

SEQ ID NO: 16476 - DNA, 21 bp, Artificial Sequence
  Description of Artificial Sequence: Synthetic oligonucleotide
agcggcggcgccagcagcctc

SEQ ID NO: 16477 - DNA, 21 bp, Artificial Sequence
  Description of Artificial Sequence: Synthetic oligonucleotide
cagacgacggcgccgcatggt

SEQ ID NO: 16478 - DNA, 21 bp, Artificial Sequence
  Description of Artificial Sequence: Synthetic oligonucleotide
agcaacagcaccgccccccac

SEQ ID NO: 16479 - DNA, 21 bp, Artificial Sequence
  Description of Artificial Sequence: Synthetic oligonucleotide
agcggcagcaacaccccccac

SEQ ID NO: 16480 - DNA, 21 bp, Artificial Sequence
  Description of Artificial Sequence: Synthetic oligonucleotide
ggcagcagcgccggcggcaac

SEQ ID NO: 16481 - DNA, 21 bp, Artificial Sequence
  Description of Artificial Sequence: Synthetic oligonucleotide
acgggtactaatactgtgttg

SEQ ID NO: 16482 - DNA, 21 bp, Artificial Sequence
  Description of Artificial Sequence: Synthetic oligonucleotide
aaagacggcggcagccaagtc

SEQ ID NO: 16483 - DNA, 21 bp, Artificial Sequence
  Description of Artificial Sequence: Synthetic oligonucleotide
accaccggcggcaccaacgtc

SEQ ID NO: 16484 - DNA, 21 bp, Artificial Sequence
  Description of Artificial Sequence: Synthetic oligonucleotide
cagaatcaggataagccgact

SEQ ID NO: 16485 - DNA, 21 bp, Artificial Sequence
  Description of Artificial Sequence: Synthetic oligonucleotide
gaacaaagaagcagcggcctc

SEQ ID NO: 16486 - DNA, 21 bp, Artificial Sequence
  Description of Artificial Sequence: Synthetic oligonucleotide
agtactactaattctggtggt

SEQ ID NO: 16487 - DNA, 21 bp, Artificial Sequence
  Description of Artificial Sequence: Synthetic oligonucleotide
accctcgtcgccaaacccgaa

SEQ ID NO: 16488 - DNA, 21 bp, Artificial Sequence
  Description of Artificial Sequence: Synthetic oligonucleotide
gagagtcctcagaagtctggg

SEQ ID NO: 16489 - DNA, 21 bp, Artificial Sequence
  Description of Artificial Sequence: Synthetic oligonucleotide
gaccccagcaaaagcagcggc

SEQ ID NO: 16490 - DNA, 21 bp, Artificial Sequence
  Description of Artificial Sequence: Synthetic oligonucleotide
aatgttggttctggtactctt

SEQ ID NO: 16491 - DNA, 21 bp, Artificial Sequence
  Description of Artificial Sequence: Synthetic oligonucleotide
agtcatgggaataaggagacg

SEQ ID NO: 16492 - DNA, 21 bp, Artificial Sequence
  Description of Artificial Sequence: Synthetic oligonucleotide
aacagcggccacgcccccgtc

SEQ ID NO: 16493 - DNA, 21 bp, Artificial Sequence
  Description of Artificial Sequence: Synthetic oligonucleotide
aatgagcataatggggttaag

SEQ ID NO: 16494 - DNA, 21 bp, Artificial Sequence
  Description of Artificial Sequence: Synthetic oligonucleotide
accggccaacccagcagcaga

SEQ ID NO: 16495 - DNA, 21 bp, Artificial Sequence
  Description of Artificial Sequence: Synthetic oligonucleotide
caaggccccagccaacccggc

SEQ ID NO: 16496 - DNA, 21 bp, Artificial Sequence
  Description of Artificial Sequence: Synthetic oligonucleotide
gctactacgtcttctaatagt

SEQ ID NO: 16497 - DNA, 21 bp, Artificial Sequence
  Description of Artificial Sequence: Synthetic oligonucleotide
gtgactagtaatgataagggg

SEQ ID NO: 16498 - DNA, 21 bp, Artificial Sequence
  Description of Artificial Sequence: Synthetic oligonucleotide
attggtactggtaagcctgag

SEQ ID NO: 16499 - DNA, 21 bp, Artificial Sequence
  Description of Artificial Sequence: Synthetic oligonucleotide
gccaccggcgccagcagcaac

SEQ ID NO: 16500 - DNA, 21 bp, Artificial Sequence
  Description of Artificial Sequence: Synthetic oligonucleotide
ctccccagcaacgccaaaggc

SEQ ID NO: 16501 - DNA, 21 bp, Artificial Sequence
  Description of Artificial Sequence: Synthetic oligonucleotide
agcgtcggcagcgccggcggc

SEQ ID NO: 16502 - DNA, 21 bp, Artificial Sequence
  Description of Artificial Sequence: Synthetic oligonucleotide
aacaccggcagcggcggcacc

SEQ ID NO: 16503 - DNA, 21 bp, Artificial Sequence
  Description of Artificial Sequence: Synthetic oligonucleotide
ggtgcgggtggtaattcttct

SEQ ID NO: 16504 - DNA, 21 bp, Artificial Sequence
  Description of Artificial Sequence: Synthetic oligonucleotide
agcaacaacaaacccagcctc

SEQ ID NO: 16505 - DNA, 21 bp, Artificial Sequence
  Description of Artificial Sequence: Synthetic oligonucleotide
gaacaaggcaaaaacagccac

SEQ ID NO: 16506 - DNA, 21 bp, Artificial Sequence
  Description of Artificial Sequence: Synthetic oligonucleotide
gattcgtcttctattgtgaag

SEQ ID NO: 16507 - DNA, 21 bp, Artificial Sequence
  Description of Artificial Sequence: Synthetic oligonucleotide
gccaccggcaccagcggcaga

SEQ ID NO: 16508 - DNA, 21 bp, Artificial Sequence
  Description of Artificial Sequence: Synthetic oligonucleotide
accaccaacgaacccagaatc

SEQ ID NO: 16509 - DNA, 21 bp, Artificial Sequence
  Description of Artificial Sequence: Synthetic oligonucleotide
cataatacttctgggattgcg

SEQ ID NO: 16510 - DNA, 21 bp, Artificial Sequence
  Description of Artificial Sequence: Synthetic oligonucleotide
agcggcaccaacagcagcagc

SEQ ID NO: 16511 - DNA, 21 bp, Artificial Sequence
  Description of Artificial Sequence: Synthetic oligonucleotide
atgggtgggaatactgctggt

SEQ ID NO: 16512 - DNA, 21 bp, Artificial Sequence
  Description of Artificial Sequence: Synthetic oligonucleotide
ggcgccagcccccaaaaaggc

SEQ ID NO: 16513 - DNA, 21 bp, Artificial Sequence
  Description of Artificial Sequence: Synthetic oligonucleotide
gggattgggaagtcggatgcg

SEQ ID NO: 16514 - DNA, 21 bp, Artificial Sequence
  Description of Artificial Sequence: Synthetic oligonucleotide
gtcagcagcggcagcagcacc

SEQ ID NO: 16515 - DNA, 21 bp, Artificial Sequence
  Description of Artificial Sequence: Synthetic oligonucleotide
agcgccaccaacaccagcaac

SEQ ID NO: 16516 - DNA, 21 bp, Artificial Sequence
  Description of Artificial Sequence: Synthetic oligonucleotide
aattctggggttacgcatgct

SEQ ID NO: 16517 - DNA, 21 bp, Artificial Sequence
  Description of Artificial Sequence: Synthetic oligonucleotide
gggtcgtcttctcctgcgaag

SEQ ID NO: 16518 - DNA, 21 bp, Artificial Sequence
  Description of Artificial Sequence: Synthetic oligonucleotide
gcgggtagttctagttcgaag

SEQ ID NO: 16519 - DNA, 21 bp, Artificial Sequence
  Description of Artificial Sequence: Synthetic oligonucleotide
ggggggatttctgataataag

SEQ ID NO: 16520 - DNA, 21 bp, Artificial Sequence
  Description of Artificial Sequence: Synthetic oligonucleotide
aacagcaaaaccaacagccaa

SEQ ID NO: 16521 - DNA, 21 bp, Artificial Sequence
  Description of Artificial Sequence: Synthetic oligonucleotide
atgaacggcagcgccgccagc

SEQ ID NO: 16522 - DNA, 21 bp, Artificial Sequence
  Description of Artificial Sequence: Synthetic oligonucleotide
caaggcaaagacagcggcagc

SEQ ID NO: 16523 - DNA, 21 bp, Artificial Sequence
  Description of Artificial Sequence: Synthetic oligonucleotide
aggactgtgggtgatcggtct

SEQ ID NO: 16524 - DNA, 21 bp, Artificial Sequence
  Description of Artificial Sequence: Synthetic oligonucleotide
gaagccgccaacaaaaacatc

SEQ ID NO: 16525 - DNA, 21 bp, Artificial Sequence
  Description of Artificial Sequence: Synthetic oligonucleotide
agtacgacgacgaaggcgggg

SEQ ID NO: 16526 - DNA, 21 bp, Artificial Sequence
  Description of Artificial Sequence: Synthetic oligonucleotide
cataagacggagaatgggggg

SEQ ID NO: 16527 - DNA, 21 bp, Artificial Sequence
  Description of Artificial Sequence: Synthetic oligonucleotide
gacaacaacggcagaaacacc

SEQ ID NO: 16528 - DNA, 21 bp, Artificial Sequence
  Description of Artificial Sequence: Synthetic oligonucleotide
actcagtcttcgtcggctaat

SEQ ID NO: 16529 - DNA, 21 bp, Artificial Sequence
  Description of Artificial Sequence: Synthetic oligonucleotide
tctggtaatgcgaatacgctt

SEQ ID NO: 16530 - DNA, 21 bp, Artificial Sequence
  Description of Artificial Sequence: Synthetic oligonucleotide
agcaccagcaacggcgccaaa

SEQ ID NO: 16531 - DNA, 21 bp, Artificial Sequence
  Description of Artificial Sequence: Synthetic oligonucleotide
gccaacggcgcccacagcagc

SEQ ID NO: 16532 - DNA, 21 bp, Artificial Sequence
  Description of Artificial Sequence: Synthetic oligonucleotide
ggcagcggcaacgcccacagc

SEQ ID NO: 16533 - DNA, 21 bp, Artificial Sequence
  Description of Artificial Sequence: Synthetic oligonucleotide
acggtgaattctaaggctcag

SEQ ID NO: 16534 - DNA, 21 bp, Artificial Sequence
  Description of Artificial Sequence: Synthetic oligonucleotide
ctgggggggtcttctcctaag

SEQ ID NO: 16535 - DNA, 21 bp, Artificial Sequence
  Description of Artificial Sequence: Synthetic oligonucleotide
gaaaaacccaaccccggccac

SEQ ID NO: 16536 - DNA, 21 bp, Artificial Sequence
  Description of Artificial Sequence: Synthetic oligonucleotide
gaaagaacccccagcagccaa

SEQ ID NO: 16537 - DNA, 21 bp, Artificial Sequence
  Description of Artificial Sequence: Synthetic oligonucleotide
gccgtcaacagcagcaccggc

SEQ ID NO: 16538 - DNA, 21 bp, Artificial Sequence
  Description of Artificial Sequence: Synthetic oligonucleotide
tctcattctaatgatcgtgcg

SEQ ID NO: 16539 - DNA, 21 bp, Artificial Sequence
  Description of Artificial Sequence: Synthetic oligonucleotide
agcaccgccaccgccagcgcc

SEQ ID NO: 16540 - DNA, 21 bp, Artificial Sequence
  Description of Artificial Sequence: Synthetic oligonucleotide
caaagcaccaccaacggcagc

SEQ ID NO: 16541 - DNA, 21 bp, Artificial Sequence
  Description of Artificial Sequence: Synthetic oligonucleotide
agcggcggcaaccccatcaac

SEQ ID NO: 16542 - DNA, 21 bp, Artificial Sequence
  Description of Artificial Sequence: Synthetic oligonucleotide
gattctgtgaatccgaagcag

SEQ ID NO: 16543 - DNA, 21 bp, Artificial Sequence
  Description of Artificial Sequence: Synthetic oligonucleotide
aacggcaccaccagcgccaga

SEQ ID NO: 16544 - DNA, 21 bp, Artificial Sequence
  Description of Artificial Sequence: Synthetic oligonucleotide
aataatgatcgtgcgtcgctt

SEQ ID NO: 16545 - DNA, 21 bp, Artificial Sequence
  Description of Artificial Sequence: Synthetic oligonucleotide
accaacggcagcagccccgtc

SEQ ID NO: 16546 - DNA, 21 bp, Artificial Sequence
  Description of Artificial Sequence: Synthetic oligonucleotide
gttagtggttcgggtaatcag

SEQ ID NO: 16547 - DNA, 21 bp, Artificial Sequence
  Description of Artificial Sequence: Synthetic oligonucleotide
ggccaaatcagcagccccaaa

SEQ ID NO: 16548 - DNA, 21 bp, Artificial Sequence
  Description of Artificial Sequence: Synthetic oligonucleotide
agtgtgtcgccgtcgaatacg

SEQ ID NO: 16549 - DNA, 21 bp, Artificial Sequence
  Description of Artificial Sequence: Synthetic oligonucleotide
gaggttgtttcgaagactggt

SEQ ID NO: 16550 - DNA, 21 bp, Artificial Sequence
  Description of Artificial Sequence: Synthetic oligonucleotide
cagggggagtcgcgttctgcg

SEQ ID NO: 16551 - DNA, 21 bp, Artificial Sequence
  Description of Artificial Sequence: Synthetic oligonucleotide
cacaccaccagcagcagcggc

SEQ ID NO: 16552 - DNA, 21 bp, Artificial Sequence
  Description of Artificial Sequence: Synthetic oligonucleotide
gttgggaagggtagttctgtg

SEQ ID NO: 16553 - DNA, 21 bp, Artificial Sequence
  Description of Artificial Sequence: Synthetic oligonucleotide
gatacgcgtgatggtaagagt

SEQ ID NO: 16554 - DNA, 21 bp, Artificial Sequence
  Description of Artificial Sequence: Synthetic oligonucleotide
tcgggtaatgtgacgagtggg

SEQ ID NO: 16555 - DNA, 21 bp, Artificial Sequence
  Description of Artificial Sequence: Synthetic oligonucleotide
acccaaggcaacaccagcggc

SEQ ID NO: 16556 - DNA, 21 bp, Artificial Sequence
  Description of Artificial Sequence: Synthetic oligonucleotide
caagccgacaaaaacatgggc

SEQ ID NO: 16557 - DNA, 21 bp, Artificial Sequence
  Description of Artificial Sequence: Synthetic oligonucleotide
agccaaggcagcagcgccatc

SEQ ID NO: 16558 - DNA, 21 bp, Artificial Sequence
  Description of Artificial Sequence: Synthetic oligonucleotide
atcagagacagcaccagcaac

SEQ ID NO: 16559 - DNA, 21 bp, Artificial Sequence
  Description of Artificial Sequence: Synthetic oligonucleotide
ggcggcagagaagtcaacagc

SEQ ID NO: 16560 - DNA, 21 bp, Artificial Sequence
  Description of Artificial Sequence: Synthetic oligonucleotide
gaaggcggcgccaccatgagc

SEQ ID NO: 16561 - DNA, 21 bp, Artificial Sequence
  Description of Artificial Sequence: Synthetic oligonucleotide
agaaaccaaggccaaagcatc

SEQ ID NO: 16562 - DNA, 21 bp, Artificial Sequence
  Description of Artificial Sequence: Synthetic oligonucleotide
agtgtgggtgcggcgagttcg

SEQ ID NO: 16563 - DNA, 21 bp, Artificial Sequence
  Description of Artificial Sequence: Synthetic oligonucleotide
atgaagcagaataatcaggag

SEQ ID NO: 16564 - DNA, 21 bp, Artificial Sequence
  Description of Artificial Sequence: Synthetic oligonucleotide
attcggagtaaggattcggtt

SEQ ID NO: 16565 - DNA, 21 bp, Artificial Sequence
  Description of Artificial Sequence: Synthetic oligonucleotide
agtactactgagcggtctggt

SEQ ID NO: 16566 - DNA, 21 bp, Artificial Sequence
  Description of Artificial Sequence: Synthetic oligonucleotide
agtaatggtccttcttctggg

SEQ ID NO: 16567 - DNA, 21 bp, Artificial Sequence
  Description of Artificial Sequence: Synthetic oligonucleotide
accaccaaccccagcaacagc

SEQ ID NO: 16568 - DNA, 21 bp, Artificial Sequence
  Description of Artificial Sequence: Synthetic oligonucleotide
gaaagacaacaacaacccgtc

SEQ ID NO: 16569 - DNA, 21 bp, Artificial Sequence
  Description of Artificial Sequence: Synthetic oligonucleotide
ggtaatggttctccgattacg

SEQ ID NO: 16570 - DNA, 21 bp, Artificial Sequence
  Description of Artificial Sequence: Synthetic oligonucleotide
aatcgtggggagagtgtgtcg

SEQ ID NO: 16571 - DNA, 21 bp, Artificial Sequence
  Description of Artificial Sequence: Synthetic oligonucleotide
agcagcagcgcccaacacacc

SEQ ID NO: 16572 - DNA, 21 bp, Artificial Sequence
  Description of Artificial Sequence: Synthetic oligonucleotide
agcgccacccaagcccccagc

SEQ ID NO: 16573 - DNA, 21 bp, Artificial Sequence
  Description of Artificial Sequence: Synthetic oligonucleotide
aacgccaacgcccacgccacc

SEQ ID NO: 16574 - DNA, 21 bp, Artificial Sequence
  Description of Artificial Sequence: Synthetic oligonucleotide
agttcgggtagtgctccttct

SEQ ID NO: 16575 - DNA, 21 bp, Artificial Sequence
  Description of Artificial Sequence: Synthetic oligonucleotide
caacccgaaggcaccaacaaa

SEQ ID NO: 16576 - DNA, 21 bp, Artificial Sequence
  Description of Artificial Sequence: Synthetic oligonucleotide
actcttagtgataagccgctg

SEQ ID NO: 16577 - DNA, 21 bp, Artificial Sequence
  Description of Artificial Sequence: Synthetic oligonucleotide
atcggcgaaaaaagcaacacc

SEQ ID NO: 16578 - DNA, 21 bp, Artificial Sequence
  Description of Artificial Sequence: Synthetic oligonucleotide
gatccttcgaagacgaatggg

SEQ ID NO: 16579 - DNA, 21 bp, Artificial Sequence
  Description of Artificial Sequence: Synthetic oligonucleotide
aacggcagcagcagcggcgcc

SEQ ID NO: 16580 - DNA, 21 bp, Artificial Sequence
  Description of Artificial Sequence: Synthetic oligonucleotide
caagccggcaacgccaccgcc

SEQ ID NO: 16581 - DNA, 21 bp, Artificial Sequence
  Description of Artificial Sequence: Synthetic oligonucleotide
gattctagtcatacgaataag

SEQ ID NO: 16582 - DNA, 21 bp, Artificial Sequence
  Description of Artificial Sequence: Synthetic oligonucleotide
gccggcggccccaccgccacc

SEQ ID NO: 16583 - DNA, 21 bp, Artificial Sequence
  Description of Artificial Sequence: Synthetic oligonucleotide
caacacggcgaaatgaaaggc

SEQ ID NO: 16584 - DNA, 21 bp, Artificial Sequence
  Description of Artificial Sequence: Synthetic oligonucleotide
caggtggatgcggggaatcgg

SEQ ID NO: 16585 - DNA, 21 bp, Artificial Sequence
  Description of Artificial Sequence: Synthetic oligonucleotide
gtcaacaacagcgccaccatg

SEQ ID NO: 16586 - DNA, 21 bp, Artificial Sequence
  Description of Artificial Sequence: Synthetic oligonucleotide
agcaacggcgccggcaccaaa

SEQ ID NO: 16587 - DNA, 21 bp, Artificial Sequence
  Description of Artificial Sequence: Synthetic oligonucleotide
agcaccagcaccaaagacagc

SEQ ID NO: 16588 - DNA, 21 bp, Artificial Sequence
  Description of Artificial Sequence: Synthetic oligonucleotide
ggcgccagcgacaccaacaga

SEQ ID NO: 16589 - DNA, 21 bp, Artificial Sequence
  Description of Artificial Sequence: Synthetic oligonucleotide
gacggcatgggcaccacccaa

SEQ ID NO: 16590 - DNA, 21 bp, Artificial Sequence
  Description of Artificial Sequence: Synthetic oligonucleotide
agttcggcgaattcgccgtcg

SEQ ID NO: 16591 - DNA, 21 bp, Artificial Sequence
  Description of Artificial Sequence: Synthetic oligonucleotide
agcgcccacaaaggcgaaagc

SEQ ID NO: 16592 - DNA, 21 bp, Artificial Sequence
  Description of Artificial Sequence: Synthetic oligonucleotide
catggttctgagaagttgtct

SEQ ID NO: 16593 - DNA, 21 bp, Artificial Sequence
  Description of Artificial Sequence: Synthetic oligonucleotide
actggtgggggtagtagggag

SEQ ID NO: 16594 - DNA, 21 bp, Artificial Sequence
  Description of Artificial Sequence: Synthetic oligonucleotide
agcggcatcgacaaaagcctc

SEQ ID NO: 16595 - DNA, 21 bp, Artificial Sequence
  Description of Artificial Sequence: Synthetic oligonucleotide
gacgccaccaaaaccaccaac

SEQ ID NO: 16596 - DNA, 21 bp, Artificial Sequence
  Description of Artificial Sequence: Synthetic oligonucleotide
gggacgacggggtctccgggg

SEQ ID NO: 16597 - DNA, 21 bp, Artificial Sequence
  Description of Artificial Sequence: Synthetic oligonucleotide
gatgttccgggtactaagggt

SEQ ID NO: 16598 - DNA, 21 bp, Artificial Sequence
  Description of Artificial Sequence: Synthetic oligonucleotide
gaagtcgtcaaagccggcagc

SEQ ID NO: 16599 - DNA, 21 bp, Artificial Sequence
  Description of Artificial Sequence: Synthetic oligonucleotide
gggcagggttctgcggcttcg

SEQ ID NO: 16600 - DNA, 21 bp, Artificial Sequence
  Description of Artificial Sequence: Synthetic oligonucleotide
ggcgacatgaaaaccagcagc

SEQ ID NO: 16601 - DNA, 21 bp, Artificial Sequence
  Description of Artificial Sequence: Synthetic oligonucleotide
accagcgacagccccggcaga

SEQ ID NO: 16602 - DNA, 21 bp, Artificial Sequence
  Description of Artificial Sequence: Synthetic oligonucleotide
cacgccagcagcagccccacc

SEQ ID NO: 16603 - DNA, 21 bp, Artificial Sequence
  Description of Artificial Sequence: Synthetic oligonucleotide
gaaagagccacccaaagcgtc

SEQ ID NO: 16604 - DNA, 21 bp, Artificial Sequence
  Description of Artificial Sequence: Synthetic oligonucleotide
gacccccccgaaaaaaccggc

SEQ ID NO: 16605 - DNA, 21 bp, Artificial Sequence
  Description of Artificial Sequence: Synthetic oligonucleotide
gagactactgggaataagtcg

SEQ ID NO: 16606 - DNA, 21 bp, Artificial Sequence
  Description of Artificial Sequence: Synthetic oligonucleotide
gagggtgggtcttctcggggg

SEQ ID NO: 16607 - DNA, 21 bp, Artificial Sequence
  Description of Artificial Sequence: Synthetic oligonucleotide
gccatgcacgccaccgccggc

SEQ ID NO: 16608 - DNA, 21 bp, Artificial Sequence
  Description of Artificial Sequence: Synthetic oligonucleotide
ggccacaccaccaaagacgcc

SEQ ID NO: 16609 - DNA, 21 bp, Artificial Sequence
  Description of Artificial Sequence: Synthetic oligonucleotide
tctgatgtgaaggggagtaat

SEQ ID NO: 16610 - DNA, 21 bp, Artificial Sequence
  Description of Artificial Sequence: Synthetic oligonucleotide
ggcctcgccaccgacaccaaa

SEQ ID NO: 16611 - DNA, 21 bp, Artificial Sequence
  Description of Artificial Sequence: Synthetic oligonucleotide
gaaaccctcagcggcgccaaa

SEQ ID NO: 16612 - DNA, 21 bp, Artificial Sequence
  Description of Artificial Sequence: Synthetic oligonucleotide
atcagcaacggcaaactcgcc

SEQ ID NO: 16613 - DNA, 21 bp, Artificial Sequence
  Description of Artificial Sequence: Synthetic oligonucleotide
cagactgggcagtcggctgct

SEQ ID NO: 16614 - DNA, 21 bp, Artificial Sequence
  Description of Artificial Sequence: Synthetic oligonucleotide
gggagtggtaaggggaatgtt

SEQ ID NO: 16615 - DNA, 21 bp, Artificial Sequence
  Description of Artificial Sequence: Synthetic oligonucleotide
ggtaatgcgggtgcttcgact

SEQ ID NO: 16616 - DNA, 21 bp, Artificial Sequence
  Description of Artificial Sequence: Synthetic oligonucleotide
agcaccaacacccacggcaaa

SEQ ID NO: 16617 - DNA, 21 bp, Artificial Sequence
  Description of Artificial Sequence: Synthetic oligonucleotide
gaaaccagaaaagacgcccaa

SEQ ID NO: 16618 - DNA, 21 bp, Artificial Sequence
  Description of Artificial Sequence: Synthetic oligonucleotide
ggcaacaaaagcgaaagccaa

SEQ ID NO: 16619 - DNA, 21 bp, Artificial Sequence
  Description of Artificial Sequence: Synthetic oligonucleotide
ttgggggattcgagttcgaag

SEQ ID NO: 16620 - DNA, 21 bp, Artificial Sequence
  Description of Artificial Sequence: Synthetic oligonucleotide
ggcggcaacaaagccgacagc

SEQ ID NO: 16621 - DNA, 21 bp, Artificial Sequence
  Description of Artificial Sequence: Synthetic oligonucleotide
agttcttctgggacgactagt

SEQ ID NO: 16622 - DNA, 21 bp, Artificial Sequence
  Description of Artificial Sequence: Synthetic oligonucleotide
agcaccggcgccagcgccgtc

SEQ ID NO: 16623 - DNA, 21 bp, Artificial Sequence
  Description of Artificial Sequence: Synthetic oligonucleotide
actggggggacggctactagt

SEQ ID NO: 16624 - DNA, 21 bp, Artificial Sequence
  Description of Artificial Sequence: Synthetic oligonucleotide
ctcaccggcaacagcagcccc

SEQ ID NO: 16625 - DNA, 21 bp, Artificial Sequence
  Description of Artificial Sequence: Synthetic oligonucleotide
ttttcggagaatagtgttaag

SEQ ID NO: 16626 - DNA, 21 bp, Artificial Sequence
  Description of Artificial Sequence: Synthetic oligonucleotide
aatgcgggtgctacgtcgaat

SEQ ID NO: 16627 - DNA, 21 bp, Artificial Sequence
  Description of Artificial Sequence: Synthetic oligonucleotide
atgaccaacagcaacgtcaaa

SEQ ID NO: 16628 - DNA, 21 bp, Artificial Sequence
  Description of Artificial Sequence: Synthetic oligonucleotide
agcagcgacgcccacagcaaa

SEQ ID NO: 16629 - DNA, 21 bp, Artificial Sequence
  Description of Artificial Sequence: Synthetic oligonucleotide
ggcaaaggcgccggcagcacc

SEQ ID NO: 16630 - DNA, 21 bp, Artificial Sequence
  Description of Artificial Sequence: Synthetic oligonucleotide
aacaccggcagcagcgacaaa

SEQ ID NO: 16631 - DNA, 21 bp, Artificial Sequence
  Description of Artificial Sequence: Synthetic oligonucleotide
agaaacggcggcaccagcagc

SEQ ID NO: 16632 - DNA, 21 bp, Artificial Sequence
  Description of Artificial Sequence: Synthetic oligonucleotide
gtcagcaccggcaacaacggc

SEQ ID NO: 16633 - DNA, 21 bp, Artificial Sequence
  Description of Artificial Sequence: Synthetic oligonucleotide
acggatgggcctcagcgttcg

SEQ ID NO: 16634 - DNA, 21 bp, Artificial Sequence
  Description of Artificial Sequence: Synthetic oligonucleotide
gccaacggcacccacaccgcc

SEQ ID NO: 16635 - DNA, 21 bp, Artificial Sequence
  Description of Artificial Sequence: Synthetic oligonucleotide
gacagaagcagagaaagcgtc

SEQ ID NO: 16636 - DNA, 21 bp, Artificial Sequence
  Description of Artificial Sequence: Synthetic oligonucleotide
aattctgttgataaggctagt

SEQ ID NO: 16637 - DNA, 21 bp, Artificial Sequence
  Description of Artificial Sequence: Synthetic oligonucleotide
gtgtcgggtgctaattctatt

SEQ ID NO: 16638 - DNA, 21 bp, Artificial Sequence
  Description of Artificial Sequence: Synthetic oligonucleotide
cggagttctcctactagtgtg

SEQ ID NO: 16639 - DNA, 21 bp, Artificial Sequence
  Description of Artificial Sequence: Synthetic oligonucleotide
accagagacaccagcagcctc

SEQ ID NO: 16640 - DNA, 21 bp, Artificial Sequence
  Description of Artificial Sequence: Synthetic oligonucleotide
agcctcagcagcaccaacagc

SEQ ID NO: 16641 - DNA, 21 bp, Artificial Sequence
  Description of Artificial Sequence: Synthetic oligonucleotide
aatgcggatagtagtaagttg

SEQ ID NO: 16642 - DNA, 21 bp, Artificial Sequence
  Description of Artificial Sequence: Synthetic oligonucleotide
agaaccggcgcccaacccggc

SEQ ID NO: 16643 - DNA, 21 bp, Artificial Sequence
  Description of Artificial Sequence: Synthetic oligonucleotide
agtccgggtggggatttgaag

SEQ ID NO: 16644 - DNA, 21 bp, Artificial Sequence
  Description of Artificial Sequence: Synthetic oligonucleotide
cacggcgccaccacccccggc

SEQ ID NO: 16645 - DNA, 21 bp, Artificial Sequence
  Description of Artificial Sequence: Synthetic oligonucleotide
ggccccaccatgaacgacaaa

SEQ ID NO: 16646 - DNA, 21 bp, Artificial Sequence
  Description of Artificial Sequence: Synthetic oligonucleotide
gggagttcgcagtctgggacg

SEQ ID NO: 16647 - DNA, 21 bp, Artificial Sequence
  Description of Artificial Sequence: Synthetic oligonucleotide
ggggataagaaggagatggcg

SEQ ID NO: 16648 - DNA, 21 bp, Artificial Sequence
  Description of Artificial Sequence: Synthetic oligonucleotide
ctccaaagcaaaaccggcagc

SEQ ID NO: 16649 - DNA, 21 bp, Artificial Sequence
  Description of Artificial Sequence: Synthetic oligonucleotide
tctccgatttcgaaggagggg

SEQ ID NO: 16650 - DNA, 21 bp, Artificial Sequence
  Description of Artificial Sequence: Synthetic oligonucleotide
agaggcaccggcagcaccacc

SEQ ID NO: 16651 - DNA, 21 bp, Artificial Sequence
  Description of Artificial Sequence: Synthetic oligonucleotide
gcgaattctgggacgtcgact

SEQ ID NO: 16652 - DNA, 21 bp, Artificial Sequence
  Description of Artificial Sequence: Synthetic oligonucleotide
tcgactggggcgacggctctt

SEQ ID NO: 16653 - DNA, 21 bp, Artificial Sequence
  Description of Artificial Sequence: Synthetic oligonucleotide
agcggcgcccccagcgtcaac

SEQ ID NO: 16654 - DNA, 21 bp, Artificial Sequence
  Description of Artificial Sequence: Synthetic oligonucleotide
agcgtcgccagccaaagccaa

SEQ ID NO: 16655 - DNA, 21 bp, Artificial Sequence
  Description of Artificial Sequence: Synthetic oligonucleotide
ggccaccaaggcagcagcagc

SEQ ID NO: 16656 - DNA, 21 bp, Artificial Sequence
  Description of Artificial Sequence: Synthetic oligonucleotide
aatagtgttgataaggctaag

SEQ ID NO: 16657 - DNA, 21 bp, Artificial Sequence
  Description of Artificial Sequence: Synthetic oligonucleotide
aacacccacgccaacagcacc

SEQ ID NO: 16658 - DNA, 21 bp, Artificial Sequence
  Description of Artificial Sequence: Synthetic oligonucleotide
ggccaacaccaacccctcgcc

SEQ ID NO: 16659 - DNA, 21 bp, Artificial Sequence
  Description of Artificial Sequence: Synthetic oligonucleotide
tcgacgaagagttcgcctagt

SEQ ID NO: 16660 - DNA, 21 bp, Artificial Sequence
  Description of Artificial Sequence: Synthetic oligonucleotide
gatacgtctagtactgggaag

SEQ ID NO: 16661 - DNA, 21 bp, Artificial Sequence
  Description of Artificial Sequence: Synthetic oligonucleotide
gtccccagcagcaaccccaaa

SEQ ID NO: 16662 - DNA, 21 bp, Artificial Sequence
  Description of Artificial Sequence: Synthetic oligonucleotide
accaaaaacggccacaacagc

SEQ ID NO: 16663 - DNA, 21 bp, Artificial Sequence
  Description of Artificial Sequence: Synthetic oligonucleotide
gaaaccggccaaaaagaaggc

SEQ ID NO: 16664 - DNA, 21 bp, Artificial Sequence
  Description of Artificial Sequence: Synthetic oligonucleotide
gggccgaataaggatgtgcat

SEQ ID NO: 16665 - DNA, 21 bp, Artificial Sequence
  Description of Artificial Sequence: Synthetic oligonucleotide
gggcctggtaatgggaatggg

SEQ ID NO: 16666 - DNA, 21 bp, Artificial Sequence
  Description of Artificial Sequence: Synthetic oligonucleotide
agtagtcagaagacggggtct

SEQ ID NO: 16667 - DNA, 21 bp, Artificial Sequence
  Description of Artificial Sequence: Synthetic oligonucleotide
aatacggatagttctcggagt

SEQ ID NO: 16668 - DNA, 21 bp, Artificial Sequence
  Description of Artificial Sequence: Synthetic oligonucleotide
cacggcgaaagcaaaaacaac

SEQ ID NO: 16669 - DNA, 21 bp, Artificial Sequence
  Description of Artificial Sequence: Synthetic oligonucleotide
gatggtcagtcgcagaatcgg

SEQ ID NO: 16670 - DNA, 21 bp, Artificial Sequence
  Description of Artificial Sequence: Synthetic oligonucleotide
ggcgaacacaaagacagcaga

SEQ ID NO: 16671 - DNA, 21 bp, Artificial Sequence
  Description of Artificial Sequence: Synthetic oligonucleotide
ggcgaagtcaccggcagaacc

SEQ ID NO: 16672 - DNA, 21 bp, Artificial Sequence
  Description of Artificial Sequence: Synthetic oligonucleotide
gatggtgcggctactaagaat

SEQ ID NO: 16673 - DNA, 21 bp, Artificial Sequence
  Description of Artificial Sequence: Synthetic oligonucleotide
catcgtgatacggagtcgaag

SEQ ID NO: 16674 - DNA, 21 bp, Artificial Sequence
  Description of Artificial Sequence: Synthetic oligonucleotide
accagcggcgacagaaccggc

SEQ ID NO: 16675 - DNA, 21 bp, Artificial Sequence
  Description of Artificial Sequence: Synthetic oligonucleotide
agtgttggtgaggcgaggtct

SEQ ID NO: 16676 - DNA, 21 bp, Artificial Sequence
  Description of Artificial Sequence: Synthetic oligonucleotide
caaagcaacaccagcaccggc

SEQ ID NO: 16677 - DNA, 21 bp, Artificial Sequence
  Description of Artificial Sequence: Synthetic oligonucleotide
gaaaaacaaagcaccagcgtc

SEQ ID NO: 16678 - DNA, 21 bp, Artificial Sequence
  Description of Artificial Sequence: Synthetic oligonucleotide
gagccgacgaagtcggctagt

SEQ ID NO: 16679 - DNA, 21 bp, Artificial Sequence
  Description of Artificial Sequence: Synthetic oligonucleotide
agtcctattccgaataagggt

SEQ ID NO: 16680 - DNA, 21 bp, Artificial Sequence
  Description of Artificial Sequence: Synthetic oligonucleotide
gccaccaccagaaacaacagc

SEQ ID NO: 16681 - DNA, 21 bp, Artificial Sequence
  Description of Artificial Sequence: Synthetic oligonucleotide
gccagcagccaaagcgccaaa

SEQ ID NO: 16682 - DNA, 21 bp, Artificial Sequence
  Description of Artificial Sequence: Synthetic oligonucleotide
caaggcgtcagcagcagcacc

SEQ ID NO: 16683 - DNA, 21 bp, Artificial Sequence
  Description of Artificial Sequence: Synthetic oligonucleotide
ggtaataataaggttaatagt

SEQ ID NO: 16684 - DNA, 21 bp, Artificial Sequence
  Description of Artificial Sequence: Synthetic oligonucleotide
gaaggcaacagccccatcaga

SEQ ID NO: 16685 - DNA, 21 bp, Artificial Sequence
  Description of Artificial Sequence: Synthetic oligonucleotide
tcgggggggaagcaggggatt

SEQ ID NO: 16686 - DNA, 21 bp, Artificial Sequence
  Description of Artificial Sequence: Synthetic oligonucleotide
gataagactaagggggggcag

SEQ ID NO: 16687 - DNA, 21 bp, Artificial Sequence
  Description of Artificial Sequence: Synthetic oligonucleotide
acggctgcgacttctactagt

SEQ ID NO: 16688 - DNA, 21 bp, Artificial Sequence
  Description of Artificial Sequence: Synthetic oligonucleotide
catcaggcgaatagtactcat

SEQ ID NO: 16689 - DNA, 21 bp, Artificial Sequence
  Description of Artificial Sequence: Synthetic oligonucleotide
actgggtctggtaatccggtt

SEQ ID NO: 16690 - DNA, 21 bp, Artificial Sequence
  Description of Artificial Sequence: Synthetic oligonucleotide
gttgagtctaaggggactcag

SEQ ID NO: 16691 - DNA, 21 bp, Artificial Sequence
  Description of Artificial Sequence: Synthetic oligonucleotide
ggtaagcagggtagtaatgct

SEQ ID NO: 16692 - DNA, 21 bp, Artificial Sequence
  Description of Artificial Sequence: Synthetic oligonucleotide
cagcgtaatgagaaggcgagt

SEQ ID NO: 16693 - DNA, 21 bp, Artificial Sequence
  Description of Artificial Sequence: Synthetic oligonucleotide
caaagcaaagacagccaacaa

SEQ ID NO: 16694 - DNA, 21 bp, Artificial Sequence
  Description of Artificial Sequence: Synthetic oligonucleotide
acgacgggttctagtcctggg

SEQ ID NO: 16695 - DNA, 21 bp, Artificial Sequence
  Description of Artificial Sequence: Synthetic oligonucleotide
tctggtgctggggggactacg

SEQ ID NO: 16696 - DNA, 21 bp, Artificial Sequence
  Description of Artificial Sequence: Synthetic oligonucleotide
cttacttctggtaaggagagt

SEQ ID NO: 16697 - DNA, 21 bp, Artificial Sequence
  Description of Artificial Sequence: Synthetic oligonucleotide
gagcggagtgtgagtactcag

SEQ ID NO: 16698 - DNA, 21 bp, Artificial Sequence
  Description of Artificial Sequence: Synthetic oligonucleotide
ggtgggacgacgaatgggaat

SEQ ID NO: 16699 - DNA, 21 bp, Artificial Sequence
  Description of Artificial Sequence: Synthetic oligonucleotide
agcaccagcagcaccaacagc

SEQ ID NO: 16700 - DNA, 21 bp, Artificial Sequence
  Description of Artificial Sequence: Synthetic oligonucleotide
gacagccaaacccccctcaga

SEQ ID NO: 16701 - DNA, 21 bp, Artificial Sequence
  Description of Artificial Sequence: Synthetic oligonucleotide
gtcggcggcagcagcaacaaa

SEQ ID NO: 16702 - DNA, 21 bp, Artificial Sequence
  Description of Artificial Sequence: Synthetic oligonucleotide
tcgtctaagccttcgtctgtg

SEQ ID NO: 16703 - DNA, 21 bp, Artificial Sequence
  Description of Artificial Sequence: Synthetic oligonucleotide
caaggcgtcaccagcagcagc

SEQ ID NO: 16704 - DNA, 21 bp, Artificial Sequence
  Description of Artificial Sequence: Synthetic oligonucleotide
gacagcagcaaaagcggcgtc

SEQ ID NO: 16705 - DNA, 21 bp, Artificial Sequence
  Description of Artificial Sequence: Synthetic oligonucleotide
atgggcagcagcggcaacaaa

SEQ ID NO: 16706 - DNA, 21 bp, Artificial Sequence
  Description of Artificial Sequence: Synthetic oligonucleotide
aattctaagactggggttgcg

SEQ ID NO: 16707 - DNA, 21 bp, Artificial Sequence
  Description of Artificial Sequence: Synthetic oligonucleotide
gctggtagttctactagtact

SEQ ID NO: 16708 - DNA, 21 bp, Artificial Sequence
  Description of Artificial Sequence: Synthetic oligonucleotide
ggcagcggcagcagcgcccac

SEQ ID NO: 16709 - DNA, 21 bp, Artificial Sequence
  Description of Artificial Sequence: Synthetic oligonucleotide
agtacgtctcagtctagttct

SEQ ID NO: 16710 - DNA, 21 bp, Artificial Sequence
  Description of Artificial Sequence: Synthetic oligonucleotide
gacaacgccaaaagcagcgcc

SEQ ID NO: 16711 - DNA, 21 bp, Artificial Sequence
  Description of Artificial Sequence: Synthetic oligonucleotide
ggtaagcagggtcagtcttcg

SEQ ID NO: 16712 - DNA, 21 bp, Artificial Sequence
  Description of Artificial Sequence: Synthetic oligonucleotide
gcttctactaaggcgaatact

SEQ ID NO: 16713 - DNA, 21 bp, Artificial Sequence
  Description of Artificial Sequence: Synthetic oligonucleotide
agcagaaacggcgaagccgcc

SEQ ID NO: 16714 - DNA, 21 bp, Artificial Sequence
  Description of Artificial Sequence: Synthetic oligonucleotide
aacgtcagcagcagccccacc

SEQ ID NO: 16715 - DNA, 21 bp, Artificial Sequence
  Description of Artificial Sequence: Synthetic oligonucleotide
tctagtacttcgcagccgggg

SEQ ID NO: 16716 - DNA, 21 bp, Artificial Sequence
  Description of Artificial Sequence: Synthetic oligonucleotide
ggcttcggcgtcaaacccgaa

SEQ ID NO: 16717 - DNA, 21 bp, Artificial Sequence
  Description of Artificial Sequence: Synthetic oligonucleotide
caaagcgccagcacccaagtc

SEQ ID NO: 16718 - DNA, 21 bp, Artificial Sequence
  Description of Artificial Sequence: Synthetic oligonucleotide
gccggcagcagccccatcgtc

SEQ ID NO: 16719 - DNA, 21 bp, Artificial Sequence
  Description of Artificial Sequence: Synthetic oligonucleotide
ggtacgggtggtaaggcggcc

SEQ ID NO: 16720 - DNA, 21 bp, Artificial Sequence
  Description of Artificial Sequence: Synthetic oligonucleotide
accggccaaggcggcggcagc

SEQ ID NO: 16721 - DNA, 21 bp, Artificial Sequence
  Description of Artificial Sequence: Synthetic oligonucleotide
ctgggtagtacggagaagcat

SEQ ID NO: 16722 - DNA, 21 bp, Artificial Sequence
  Description of Artificial Sequence: Synthetic oligonucleotide
gggggtaatcaggcttcttct

SEQ ID NO: 16723 - DNA, 21 bp, Artificial Sequence
  Description of Artificial Sequence: Synthetic oligonucleotide
ggtagtaagcagacttctgtt

SEQ ID NO: 16724 - DNA, 21 bp, Artificial Sequence
  Description of Artificial Sequence: Synthetic oligonucleotide
gttaatgatggtcatccgaag

SEQ ID NO: 16725 - DNA, 21 bp, Artificial Sequence
  Description of Artificial Sequence: Synthetic oligonucleotide
tcgaatgggacttctacgaat

SEQ ID NO: 16726 - DNA, 21 bp, Artificial Sequence
  Description of Artificial Sequence: Synthetic oligonucleotide
tcgcctcagggtaatggtggt

SEQ ID NO: 16727 - DNA, 21 bp, Artificial Sequence
  Description of Artificial Sequence: Synthetic oligonucleotide
ctcagccacaaaagcagcgaa

SEQ ID NO: 16728 - DNA, 21 bp, Artificial Sequence
  Description of Artificial Sequence: Synthetic oligonucleotide
tcgccgtctactaagtcgaat

SEQ ID NO: 16729 - DNA, 21 bp, Artificial Sequence
  Description of Artificial Sequence: Synthetic oligonucleotide
gaaagaaacagcggcaccacc

SEQ ID NO: 16730 - DNA, 21 bp, Artificial Sequence
  Description of Artificial Sequence: Synthetic oligonucleotide
ggcaacggccaaagccaaacc

SEQ ID NO: 16731 - DNA, 21 bp, Artificial Sequence
  Description of Artificial Sequence: Synthetic oligonucleotide
agcagcggcagcaaaatggaa

SEQ ID NO: 16732 - DNA, 21 bp, Artificial Sequence
  Description of Artificial Sequence: Synthetic oligonucleotide
actcaggggtcggataaggtg

SEQ ID NO: 16733 - DNA, 21 bp, Artificial Sequence
  Description of Artificial Sequence: Synthetic oligonucleotide
gacagcatcaaagccgccagc

SEQ ID NO: 16734 - DNA, 21 bp, Artificial Sequence
  Description of Artificial Sequence: Synthetic oligonucleotide
gagaataaggcttctactcag

SEQ ID NO: 16735 - DNA, 21 bp, Artificial Sequence
  Description of Artificial Sequence: Synthetic oligonucleotide
gaagccgtcacccccgtcaga

SEQ ID NO: 16736 - DNA, 21 bp, Artificial Sequence
  Description of Artificial Sequence: Synthetic oligonucleotide
agtgcttcttcgaagggtagt

SEQ ID NO: 16737 - DNA, 21 bp, Artificial Sequence
  Description of Artificial Sequence: Synthetic oligonucleotide
aaccaaaccgccagccccacc

SEQ ID NO: 16738 - DNA, 21 bp, Artificial Sequence
  Description of Artificial Sequence: Synthetic oligonucleotide
gaggggaagggtcagagtaat

SEQ ID NO: 16739 - DNA, 21 bp, Artificial Sequence
  Description of Artificial Sequence: Synthetic oligonucleotide
ggtactaatgcggggagtggg

SEQ ID NO: 16740 - DNA, 21 bp, Artificial Sequence
  Description of Artificial Sequence: Synthetic oligonucleotide
acgactactaagtctactgag

SEQ ID NO: 16741 - DNA, 21 bp, Artificial Sequence
  Description of Artificial Sequence: Synthetic oligonucleotide
gagagtaagccgtctaatctt

SEQ ID NO: 16742 - DNA, 21 bp, Artificial Sequence
  Description of Artificial Sequence: Synthetic oligonucleotide
agcaccggcggcagcagcagc

SEQ ID NO: 16743 - DNA, 21 bp, Artificial Sequence
  Description of Artificial Sequence: Synthetic oligonucleotide
gaccaaagccaagccgtcaaa

SEQ ID NO: 16744 - DNA, 21 bp, Artificial Sequence
  Description of Artificial Sequence: Synthetic oligonucleotide
ggcagcaaccccagcagcggc

SEQ ID NO: 16745 - DNA, 21 bp, Artificial Sequence
  Description of Artificial Sequence: Synthetic oligonucleotide
ggggtgactgattcttcgaag

SEQ ID NO: 16746 - DNA, 21 bp, Artificial Sequence
  Description of Artificial Sequence: Synthetic oligonucleotide
agcaccaccggcgacgccaaa

SEQ ID NO: 16747 - DNA, 21 bp, Artificial Sequence
  Description of Artificial Sequence: Synthetic oligonucleotide
gaccccagcagcaaaaaagaa

SEQ ID NO: 16748 - DNA, 21 bp, Artificial Sequence
  Description of Artificial Sequence: Synthetic oligonucleotide
ggttctactggggagcagcgg

SEQ ID NO: 16749 - DNA, 21 bp, Artificial Sequence
  Description of Artificial Sequence: Synthetic oligonucleotide
gtcaacagcgaaagaagcgcc

SEQ ID NO: 16750 - DNA, 21 bp, Artificial Sequence
  Description of Artificial Sequence: Synthetic oligonucleotide
ggtaatgggtcgagtatgtcg

SEQ ID NO: 16751 - DNA, 21 bp, Artificial Sequence
  Description of Artificial Sequence: Synthetic oligonucleotide
acggggactaataatgctaat

SEQ ID NO: 16752 - DNA, 21 bp, Artificial Sequence
  Description of Artificial Sequence: Synthetic oligonucleotide
atttcgggtcagcagcctact

SEQ ID NO: 16753 - DNA, 21 bp, Artificial Sequence
  Description of Artificial Sequence: Synthetic oligonucleotide
caaggcgacagcagcctcaaa

SEQ ID NO: 16754 - DNA, 21 bp, Artificial Sequence
  Description of Artificial Sequence: Synthetic oligonucleotide
acccaaaccgccaccgccaac

SEQ ID NO: 16755 - DNA, 21 bp, Artificial Sequence
  Description of Artificial Sequence: Synthetic oligonucleotide
tctccgcatggggataagtcg

SEQ ID NO: 16756 - DNA, 21 bp, Artificial Sequence
  Description of Artificial Sequence: Synthetic oligonucleotide
agtggtgctactccggcgttg

SEQ ID NO: 16757 - DNA, 21 bp, Artificial Sequence
  Description of Artificial Sequence: Synthetic oligonucleotide
gacagcctcagcagcagcaaa

SEQ ID NO: 16758 - DNA, 21 bp, Artificial Sequence
  Description of Artificial Sequence: Synthetic oligonucleotide
gggactgcgtctgataagcag

SEQ ID NO: 16759 - DNA, 21 bp, Artificial Sequence
  Description of Artificial Sequence: Synthetic oligonucleotide
agcgtcaacaaaaccggcggc

SEQ ID NO: 16760 - DNA, 21 bp, Artificial Sequence
  Description of Artificial Sequence: Synthetic oligonucleotide
agcagagacgccaaagtcagc

SEQ ID NO: 16761 - DNA, 21 bp, Artificial Sequence
  Description of Artificial Sequence: Synthetic oligonucleotide
actgggtctactactactctt

SEQ ID NO: 16762 - DNA, 21 bp, Artificial Sequence
  Description of Artificial Sequence: Synthetic oligonucleotide
accagcgaaaccaaattcggc

SEQ ID NO: 16763 - DNA, 21 bp, Artificial Sequence
  Description of Artificial Sequence: Synthetic oligonucleotide
cagggtggttctagtgtgtcg

SEQ ID NO: 16764 - DNA, 21 bp, Artificial Sequence
  Description of Artificial Sequence: Synthetic oligonucleotide
acgaaggagcagacggcgcag

SEQ ID NO: 16765 - DNA, 21 bp, Artificial Sequence
  Description of Artificial Sequence: Synthetic oligonucleotide
agcaccggcaaaagcgtcacc

SEQ ID NO: 16766 - DNA, 21 bp, Artificial Sequence
  Description of Artificial Sequence: Synthetic oligonucleotide
ctcagcagcagcaccgtcccc

SEQ ID NO: 16767 - DNA, 21 bp, Artificial Sequence
  Description of Artificial Sequence: Synthetic oligonucleotide
gttggtactacggcggggaag

SEQ ID NO: 16768 - DNA, 21 bp, Artificial Sequence
  Description of Artificial Sequence: Synthetic oligonucleotide
ggcctcagcagcagcaaagaa

SEQ ID NO: 16769 - DNA, 21 bp, Artificial Sequence
  Description of Artificial Sequence: Synthetic oligonucleotide
accggcgtcaaagaaatcgtc

SEQ ID NO: 16770 - DNA, 21 bp, Artificial Sequence
  Description of Artificial Sequence: Synthetic oligonucleotide
cagggtgcgacgacgggtacg

SEQ ID NO: 16771 - DNA, 21 bp, Artificial Sequence
  Description of Artificial Sequence: Synthetic oligonucleotide
ggcagcagcgccaccgacaga

SEQ ID NO: 16772 - DNA, 21 bp, Artificial Sequence
  Description of Artificial Sequence: Synthetic oligonucleotide
aatactggtacgcctaagaat

SEQ ID NO: 16773 - DNA, 21 bp, Artificial Sequence
  Description of Artificial Sequence: Synthetic oligonucleotide
catacttcttctaatgggggt

SEQ ID NO: 16774 - DNA, 21 bp, Artificial Sequence
  Description of Artificial Sequence: Synthetic oligonucleotide
tctacgtctacggggagtacg

SEQ ID NO: 16775 - DNA, 21 bp, Artificial Sequence
  Description of Artificial Sequence: Synthetic oligonucleotide
ttcggcgaaggcagcgtcaaa

SEQ ID NO: 16776 - DNA, 21 bp, Artificial Sequence
  Description of Artificial Sequence: Synthetic oligonucleotide
gacaacagcgtcaaaaaccaa

SEQ ID NO: 16777 - DNA, 21 bp, Artificial Sequence
  Description of Artificial Sequence: Synthetic oligonucleotide
agcagcgccaaagccagcctc

SEQ ID NO: 16778 - DNA, 21 bp, Artificial Sequence
  Description of Artificial Sequence: Synthetic oligonucleotide
gccgccaccagcagcaacacc

SEQ ID NO: 16779 - DNA, 21 bp, Artificial Sequence
  Description of Artificial Sequence: Synthetic oligonucleotide
ggtacttcgacgaggagtgag

SEQ ID NO: 16780 - DNA, 21 bp, Artificial Sequence
  Description of Artificial Sequence: Synthetic oligonucleotide
actactgatgcgaagactgtt

SEQ ID NO: 16781 - DNA, 21 bp, Artificial Sequence
  Description of Artificial Sequence: Synthetic oligonucleotide
agcaccaccgcccccagcaga

SEQ ID NO: 16782 - DNA, 21 bp, Artificial Sequence
  Description of Artificial Sequence: Synthetic oligonucleotide
gcgtcggatggtgctggtcgg

SEQ ID NO: 16783 - DNA, 21 bp, Artificial Sequence
  Description of Artificial Sequence: Synthetic oligonucleotide
gatagtaataagacggggcct

SEQ ID NO: 16784 - DNA, 21 bp, Artificial Sequence
  Description of Artificial Sequence: Synthetic oligonucleotide
ggttctcttgataataagggt

SEQ ID NO: 16785 - DNA, 21 bp, Artificial Sequence
  Description of Artificial Sequence: Synthetic oligonucleotide
agccaagccagcgccaacacc

SEQ ID NO: 16786 - DNA, 21 bp, Artificial Sequence
  Description of Artificial Sequence: Synthetic oligonucleotide
gatgggaagggttctggtaat

SEQ ID NO: 16787 - DNA, 21 bp, Artificial Sequence
  Description of Artificial Sequence: Synthetic oligonucleotide
tcgggtacttctagttctggt

SEQ ID NO: 16788 - DNA, 21 bp, Artificial Sequence
  Description of Artificial Sequence: Synthetic oligonucleotide
gtcaccggcagcaacggcggc

SEQ ID NO: 16789 - DNA, 21 bp, Artificial Sequence
  Description of Artificial Sequence: Synthetic oligonucleotide
agcaacagcaccagcggcagc

SEQ ID NO: 16790 - DNA, 21 bp, Artificial Sequence
  Description of Artificial Sequence: Synthetic oligonucleotide
tctgggtctaagacgtctagt

SEQ ID NO: 16791 - DNA, 21 bp, Artificial Sequence
  Description of Artificial Sequence: Synthetic oligonucleotide
tctgatgcggggaagcaggtt

SEQ ID NO: 16792 - DNA, 21 bp, Artificial Sequence
  Description of Artificial Sequence: Synthetic oligonucleotide
agtagtaatactccttcttcg

SEQ ID NO: 16793 - DNA, 21 bp, Artificial Sequence
  Description of Artificial Sequence: Synthetic oligonucleotide
ctcgccgaaagcaaaaccatg

SEQ ID NO: 16794 - DNA, 21 bp, Artificial Sequence
  Description of Artificial Sequence: Synthetic oligonucleotide
ggcaccaccggcgacatcaaa

SEQ ID NO: 16795 - DNA, 21 bp, Artificial Sequence
  Description of Artificial Sequence: Synthetic oligonucleotide
gccggcaccgaaagaagcatg

SEQ ID NO: 16796 - DNA, 21 bp, Artificial Sequence
  Description of Artificial Sequence: Synthetic oligonucleotide
gtgtctggttctacgcctact

SEQ ID NO: 16797 - DNA, 21 bp, Artificial Sequence
  Description of Artificial Sequence: Synthetic oligonucleotide
atgaacaacggcaaagtcagc

SEQ ID NO: 16798 - DNA, 21 bp, Artificial Sequence
  Description of Artificial Sequence: Synthetic oligonucleotide
actgggaaggatacgatggtg

SEQ ID NO: 16799 - DNA, 21 bp, Artificial Sequence
  Description of Artificial Sequence: Synthetic oligonucleotide
atggtcgccggcaacaaaggc

SEQ ID NO: 16800 - DNA, 21 bp, Artificial Sequence
  Description of Artificial Sequence: Synthetic oligonucleotide
ggcgccgacagcgtcaccaaa

SEQ ID NO: 16801 - DNA, 21 bp, Artificial Sequence
  Description of Artificial Sequence: Synthetic oligonucleotide
acccaaagcgccagcaccgcc

SEQ ID NO: 16802 - DNA, 21 bp, Artificial Sequence
  Description of Artificial Sequence: Synthetic oligonucleotide
gacagaaccaacgcccccagc

SEQ ID NO: 16803 - DNA, 21 bp, Artificial Sequence
  Description of Artificial Sequence: Synthetic oligonucleotide
accagcagcaccaccagcggc

SEQ ID NO: 16804 - DNA, 21 bp, Artificial Sequence
  Description of Artificial Sequence: Synthetic oligonucleotide
gtcagaggcaaagaacccatg

SEQ ID NO: 16805 - DNA, 21 bp, Artificial Sequence
  Description of Artificial Sequence: Synthetic oligonucleotide
gacgccgccagaaccaacgtc

SEQ ID NO: 16806 - DNA, 21 bp, Artificial Sequence
  Description of Artificial Sequence: Synthetic oligonucleotide
gagaaggtgacgagtagtggt

SEQ ID NO: 16807 - DNA, 21 bp, Artificial Sequence
  Description of Artificial Sequence: Synthetic oligonucleotide
gacggcatcagcagcaaccac

SEQ ID NO: 16808 - DNA, 21 bp, Artificial Sequence
  Description of Artificial Sequence: Synthetic oligonucleotide
agcggcaaccaacaaagcaac

SEQ ID NO: 16809 - DNA, 21 bp, Artificial Sequence
  Description of Artificial Sequence: Synthetic oligonucleotide
ggcggcgtcagcaacagcatc

SEQ ID NO: 16810 - DNA, 21 bp, Artificial Sequence
  Description of Artificial Sequence: Synthetic oligonucleotide
ggtattaatggtaaggatggt

SEQ ID NO: 16811 - DNA, 21 bp, Artificial Sequence
  Description of Artificial Sequence: Synthetic oligonucleotide
agttctgcggatccgaagtct

SEQ ID NO: 16812 - DNA, 21 bp, Artificial Sequence
  Description of Artificial Sequence: Synthetic oligonucleotide
aacggccaaagcgtcaacagc

SEQ ID NO: 16813 - DNA, 21 bp, Artificial Sequence
  Description of Artificial Sequence: Synthetic oligonucleotide
gcggtttcggagaagtcgggg

SEQ ID NO: 16814 - DNA, 21 bp, Artificial Sequence
  Description of Artificial Sequence: Synthetic oligonucleotide
agtagtcagacttctaatgtt

SEQ ID NO: 16815 - DNA, 21 bp, Artificial Sequence
  Description of Artificial Sequence: Synthetic oligonucleotide
ttgcagtctacgaagggtagt

SEQ ID NO: 16816 - DNA, 21 bp, Artificial Sequence
  Description of Artificial Sequence: Synthetic oligonucleotide
agcaacgacgacaaacccaga

SEQ ID NO: 16817 - DNA, 21 bp, Artificial Sequence
  Description of Artificial Sequence: Synthetic oligonucleotide
caggggaattcggcgatgact

SEQ ID NO: 16818 - DNA, 21 bp, Artificial Sequence
  Description of Artificial Sequence: Synthetic oligonucleotide
cattctgatagtactcagaag

SEQ ID NO: 16819 - DNA, 21 bp, Artificial Sequence
  Description of Artificial Sequence: Synthetic oligonucleotide
agccaaaaacccagcccccaa

SEQ ID NO: 16820 - DNA, 21 bp, Artificial Sequence
  Description of Artificial Sequence: Synthetic oligonucleotide
gacggcctccaaaccaccaga

SEQ ID NO: 16821 - DNA, 21 bp, Artificial Sequence
  Description of Artificial Sequence: Synthetic oligonucleotide
tcggctcatgataagacgaat

SEQ ID NO: 16822 - DNA, 21 bp, Artificial Sequence
  Description of Artificial Sequence: Synthetic oligonucleotide
atgggtggttcgactcagcag

SEQ ID NO: 16823 - DNA, 21 bp, Artificial Sequence
  Description of Artificial Sequence: Synthetic oligonucleotide
ggcgtcaccggcagcaaagcc

SEQ ID NO: 16824 - DNA, 21 bp, Artificial Sequence
  Description of Artificial Sequence: Synthetic oligonucleotide
cgtgagggtcagacttctatg

SEQ ID NO: 16825 - DNA, 21 bp, Artificial Sequence
  Description of Artificial Sequence: Synthetic oligonucleotide
agcaaaagcaccaacctcgcc

SEQ ID NO: 16826 - DNA, 21 bp, Artificial Sequence
  Description of Artificial Sequence: Synthetic oligonucleotide
agcagcggcagcagcgtcaaa

SEQ ID NO: 16827 - DNA, 21 bp, Artificial Sequence
  Description of Artificial Sequence: Synthetic oligonucleotide
aacgccgccaacccccccggc

SEQ ID NO: 16828 - DNA, 21 bp, Artificial Sequence
  Description of Artificial Sequence: Synthetic oligonucleotide
aattcgactccggggagtggg

SEQ ID NO: 16829 - DNA, 21 bp, Artificial Sequence
  Description of Artificial Sequence: Synthetic oligonucleotide
accgtcgcccccaaaaccggc

SEQ ID NO: 16830 - DNA, 21 bp, Artificial Sequence
  Description of Artificial Sequence: Synthetic oligonucleotide
actcagaatcagagtcttggt

SEQ ID NO: 16831 - DNA, 21 bp, Artificial Sequence
  Description of Artificial Sequence: Synthetic oligonucleotide
agcaaagaagaaaaaaacagc

SEQ ID NO: 16832 - DNA, 21 bp, Artificial Sequence
  Description of Artificial Sequence: Synthetic oligonucleotide
agcagcgaaagcaaaagcgcc

SEQ ID NO: 16833 - DNA, 21 bp, Artificial Sequence
  Description of Artificial Sequence: Synthetic oligonucleotide
agcgtcgaacccaaagtccaa

SEQ ID NO: 16834 - DNA, 21 bp, Artificial Sequence
  Description of Artificial Sequence: Synthetic oligonucleotide
agtatggaggctaggaatgct

SEQ ID NO: 16835 - DNA, 21 bp, Artificial Sequence
  Description of Artificial Sequence: Synthetic oligonucleotide
caaggcggcaaccacagcggc

SEQ ID NO: 16836 - DNA, 21 bp, Artificial Sequence
  Description of Artificial Sequence: Synthetic oligonucleotide
ctcgccagcaaagacgccggc

SEQ ID NO: 16837 - DNA, 21 bp, Artificial Sequence
  Description of Artificial Sequence: Synthetic oligonucleotide
gacagcaccagcggcaaaaga

SEQ ID NO: 16838 - DNA, 21 bp, Artificial Sequence
  Description of Artificial Sequence: Synthetic oligonucleotide
gcccacaccagcagccccggc

SEQ ID NO: 16839 - DNA, 21 bp, Artificial Sequence
  Description of Artificial Sequence: Synthetic oligonucleotide
gctgatcataagacgtcgggg

SEQ ID NO: 16840 - DNA, 21 bp, Artificial Sequence
  Description of Artificial Sequence: Synthetic oligonucleotide
ggcaccggcgaacccagaagc

SEQ ID NO: 16841 - DNA, 21 bp, Artificial Sequence
  Description of Artificial Sequence: Synthetic oligonucleotide
gggaaggggggggttaatcct

SEQ ID NO: 16842 - DNA, 21 bp, Artificial Sequence
  Description of Artificial Sequence: Synthetic oligonucleotide
ggtatggattctaagaggctt

SEQ ID NO: 16843 - DNA, 21 bp, Artificial Sequence
  Description of Artificial Sequence: Synthetic oligonucleotide
ggtccggctggtaatactgtt

SEQ ID NO: 16844 - DNA, 21 bp, Artificial Sequence
  Description of Artificial Sequence: Synthetic oligonucleotide
accgtcggcacccccgtcagc

SEQ ID NO: 16845 - DNA, 21 bp, Artificial Sequence
  Description of Artificial Sequence: Synthetic oligonucleotide
ctgtctgagaagtcttcgtcg

SEQ ID NO: 16846 - DNA, 21 bp, Artificial Sequence
  Description of Artificial Sequence: Synthetic oligonucleotide
gatactaatgggaaggctact

SEQ ID NO: 16847 - DNA, 21 bp, Artificial Sequence
  Description of Artificial Sequence: Synthetic oligonucleotide
ggcctcaccaaaagcaccggc

SEQ ID NO: 16848 - DNA, 21 bp, Artificial Sequence
  Description of Artificial Sequence: Synthetic oligonucleotide
accaacagcacccacgccgcc

SEQ ID NO: 16849 - DNA, 21 bp, Artificial Sequence
  Description of Artificial Sequence: Synthetic oligonucleotide
accagcgaaagagcccccggc

SEQ ID NO: 16850 - DNA, 21 bp, Artificial Sequence
  Description of Artificial Sequence: Synthetic oligonucleotide
acgtcttctaatacgccgatg

SEQ ID NO: 16851 - DNA, 21 bp, Artificial Sequence
  Description of Artificial Sequence: Synthetic oligonucleotide
agcaaaggcagcggcgccggc

SEQ ID NO: 16852 - DNA, 21 bp, Artificial Sequence
  Description of Artificial Sequence: Synthetic oligonucleotide
agcaccaccggcgccaccggc

SEQ ID NO: 16853 - DNA, 21 bp, Artificial Sequence
  Description of Artificial Sequence: Synthetic oligonucleotide
agccccgccgccggccacaac

SEQ ID NO: 16854 - DNA, 21 bp, Artificial Sequence
  Description of Artificial Sequence: Synthetic oligonucleotide
ggcgccagcaaacccggccac

SEQ ID NO: 16855 - DNA, 21 bp, Artificial Sequence
  Description of Artificial Sequence: Synthetic oligonucleotide
agcgccaacaaacccgccggc

SEQ ID NO: 16856 - DNA, 21 bp, Artificial Sequence
  Description of Artificial Sequence: Synthetic oligonucleotide
ggtcctgtgggttcggcgacg

SEQ ID NO: 16857 - DNA, 21 bp, Artificial Sequence
  Description of Artificial Sequence: Synthetic oligonucleotide
gaaggcagcagcaccgtcaga

SEQ ID NO: 16858 - DNA, 21 bp, Artificial Sequence
  Description of Artificial Sequence: Synthetic oligonucleotide
gctaattcgagttcggcgacg

SEQ ID NO: 16859 - DNA, 21 bp, Artificial Sequence
  Description of Artificial Sequence: Synthetic oligonucleotide
gtcagcggcgccagcaccgcc

SEQ ID NO: 16860 - DNA, 21 bp, Artificial Sequence
  Description of Artificial Sequence: Synthetic oligonucleotide
ggcagcagcagccccgcccac

SEQ ID NO: 16861 - DNA, 21 bp, Artificial Sequence
  Description of Artificial Sequence: Synthetic oligonucleotide
atgagcggcaccggcagcagc

SEQ ID NO: 16862 - DNA, 21 bp, Artificial Sequence
  Description of Artificial Sequence: Synthetic oligonucleotide
catacgggggggtcgccttct

SEQ ID NO: 16863 - DNA, 21 bp, Artificial Sequence
  Description of Artificial Sequence: Synthetic oligonucleotide
tcgaagcagaatggggtgact

SEQ ID NO: 16864 - DNA, 21 bp, Artificial Sequence
  Description of Artificial Sequence: Synthetic oligonucleotide
gaaagcatggacaaagccaga

SEQ ID NO: 16865 - DNA, 21 bp, Artificial Sequence
  Description of Artificial Sequence: Synthetic oligonucleotide
ttgcgggagacttcttctcat

SEQ ID NO: 16866 - DNA, 21 bp, Artificial Sequence
  Description of Artificial Sequence: Synthetic oligonucleotide
gagcgggctgataggtctatt

SEQ ID NO: 16867 - DNA, 21 bp, Artificial Sequence
  Description of Artificial Sequence: Synthetic oligonucleotide
cgtagtgagtctaagggtggg

SEQ ID NO: 16868 - DNA, 21 bp, Artificial Sequence
  Description of Artificial Sequence: Synthetic oligonucleotide
gaacacagcagcgccagcggc

SEQ ID NO: 16869 - DNA, 21 bp, Artificial Sequence
  Description of Artificial Sequence: Synthetic oligonucleotide
gcgcatagtaaggagaatatg

SEQ ID NO: 16870 - DNA, 21 bp, Artificial Sequence
  Description of Artificial Sequence: Synthetic oligonucleotide
gggattaataataaggctggt

SEQ ID NO: 16871 - DNA, 21 bp, Artificial Sequence
  Description of Artificial Sequence: Synthetic oligonucleotide
ggtactgcgtctggtgctcag

SEQ ID NO: 16872 - DNA, 21 bp, Artificial Sequence
  Description of Artificial Sequence: Synthetic oligonucleotide
agcaccaacagcagcagccac

SEQ ID NO: 16873 - DNA, 21 bp, Artificial Sequence
  Description of Artificial Sequence: Synthetic oligonucleotide
acccaaaccaacagcagcagc

SEQ ID NO: 16874 - DNA, 21 bp, Artificial Sequence
  Description of Artificial Sequence: Synthetic oligonucleotide
gaaagcagccaaccccccaga

SEQ ID NO: 16875 - DNA, 21 bp, Artificial Sequence
  Description of Artificial Sequence: Synthetic oligonucleotide
gaaagaaacagcagccccacc

SEQ ID NO: 16876 - DNA, 21 bp, Artificial Sequence
  Description of Artificial Sequence: Synthetic oligonucleotide
agcctcgacaacaaaagcggc

SEQ ID NO: 16877 - DNA, 21 bp, Artificial Sequence
  Description of Artificial Sequence: Synthetic oligonucleotide
gacaacggccacaaaatgctc

SEQ ID NO: 16878 - DNA, 21 bp, Artificial Sequence
  Description of Artificial Sequence: Synthetic oligonucleotide
gaggggaagagtaatgatggg

SEQ ID NO: 16879 - DNA, 21 bp, Artificial Sequence
  Description of Artificial Sequence: Synthetic oligonucleotide
cagactagtagtggtagtggt

SEQ ID NO: 16880 - DNA, 21 bp, Artificial Sequence
  Description of Artificial Sequence: Synthetic oligonucleotide
gggtctgggcagacttcttct

SEQ ID NO: 16881 - DNA, 21 bp, Artificial Sequence
  Description of Artificial Sequence: Synthetic oligonucleotide
tctattcctactggttctggg

SEQ ID NO: 16882 - DNA, 21 bp, Artificial Sequence
  Description of Artificial Sequence: Synthetic oligonucleotide
agtcagggttcgaaggattcg

SEQ ID NO: 16883 - DNA, 21 bp, Artificial Sequence
  Description of Artificial Sequence: Synthetic oligonucleotide
gccagcgacagccccagcaga

SEQ ID NO: 16884 - DNA, 21 bp, Artificial Sequence
  Description of Artificial Sequence: Synthetic oligonucleotide
gaaaaagtcagcagcgtcggc

SEQ ID NO: 16885 - DNA, 21 bp, Artificial Sequence
  Description of Artificial Sequence: Synthetic oligonucleotide
ggcgaaggcgccagactcagc

SEQ ID NO: 16886 - DNA, 21 bp, Artificial Sequence
  Description of Artificial Sequence: Synthetic oligonucleotide
ggtgctggtactaggacggag

SEQ ID NO: 16887 - DNA, 21 bp, Artificial Sequence
  Description of Artificial Sequence: Synthetic oligonucleotide
ggtaaggagaatggggctcag

SEQ ID NO: 16888 - DNA, 21 bp, Artificial Sequence
  Description of Artificial Sequence: Synthetic oligonucleotide
aatcggcagccgaagcaggag

SEQ ID NO: 16889 - DNA, 21 bp, Artificial Sequence
  Description of Artificial Sequence: Synthetic oligonucleotide
aacaccgccgccagcaacacc

SEQ ID NO: 16890 - DNA, 21 bp, Artificial Sequence
  Description of Artificial Sequence: Synthetic oligonucleotide
accagacaaaccaaagtcgaa

SEQ ID NO: 16891 - DNA, 21 bp, Artificial Sequence
  Description of Artificial Sequence: Synthetic oligonucleotide
agtctgtctactgctcctact

SEQ ID NO: 16892 - DNA, 21 bp, Artificial Sequence
  Description of Artificial Sequence: Synthetic oligonucleotide
gaccaaagcagcaaaaccaac

SEQ ID NO: 16893 - DNA, 21 bp, Artificial Sequence
  Description of Artificial Sequence: Synthetic oligonucleotide
actgcggcgagtagtactagt

SEQ ID NO: 16894 - DNA, 21 bp, Artificial Sequence
  Description of Artificial Sequence: Synthetic oligonucleotide
atgggttctccgagtgcgtct

SEQ ID NO: 16895 - DNA, 21 bp, Artificial Sequence
  Description of Artificial Sequence: Synthetic oligonucleotide
ctccaaagcaccgcccccagc

SEQ ID NO: 16896 - DNA, 21 bp, Artificial Sequence
  Description of Artificial Sequence: Synthetic oligonucleotide
aatcatgggtctcctggggtt

SEQ ID NO: 16897 - DNA, 21 bp, Artificial Sequence
  Description of Artificial Sequence: Synthetic oligonucleotide
ggttctggtacgtctatgaat

SEQ ID NO: 16898 - DNA, 21 bp, Artificial Sequence
  Description of Artificial Sequence: Synthetic oligonucleotide
accggcaccagcagcgtcgcc

SEQ ID NO: 16899 - DNA, 21 bp, Artificial Sequence
  Description of Artificial Sequence: Synthetic oligonucleotide
gatgctaaggggggcgctggt

SEQ ID NO: 16900 - DNA, 21 bp, Artificial Sequence
  Description of Artificial Sequence: Synthetic oligonucleotide
actggttcttctacggcgcat

SEQ ID NO: 16901 - DNA, 21 bp, Artificial Sequence
  Description of Artificial Sequence: Synthetic oligonucleotide
actactggttcggggaatctt

SEQ ID NO: 16902 - DNA, 21 bp, Artificial Sequence
  Description of Artificial Sequence: Synthetic oligonucleotide
agcaccgcccaaaccagcgtc

SEQ ID NO: 16903 - DNA, 21 bp, Artificial Sequence
  Description of Artificial Sequence: Synthetic oligonucleotide
tctgggaatgataatcggaat

SEQ ID NO: 16904 - DNA, 21 bp, Artificial Sequence
  Description of Artificial Sequence: Synthetic oligonucleotide
actttgaatggtaaggcggtg

SEQ ID NO: 16905 - DNA, 21 bp, Artificial Sequence
  Description of Artificial Sequence: Synthetic oligonucleotide
gcggagccggggaataagatg

SEQ ID NO: 16906 - DNA, 21 bp, Artificial Sequence
  Description of Artificial Sequence: Synthetic oligonucleotide
aacaccagcaacggcagccaa

SEQ ID NO: 16907 - DNA, 21 bp, Artificial Sequence
  Description of Artificial Sequence: Synthetic oligonucleotide
cagtctaatactgctcattct

SEQ ID NO: 16908 - DNA, 21 bp, Artificial Sequence
  Description of Artificial Sequence: Synthetic oligonucleotide
aaaaccgccaccagcagcacc

SEQ ID NO: 16909 - DNA, 21 bp, Artificial Sequence
  Description of Artificial Sequence: Synthetic oligonucleotide
gtcagcggcaccagcaacgtc

SEQ ID NO: 16910 - DNA, 21 bp, Artificial Sequence
  Description of Artificial Sequence: Synthetic oligonucleotide
tcgggttcgaaggaggcgact

SEQ ID NO: 16911 - DNA, 21 bp, Artificial Sequence
  Description of Artificial Sequence: Synthetic oligonucleotide
actggtggttcttcgtcgctt

SEQ ID NO: 16912 - DNA, 21 bp, Artificial Sequence
  Description of Artificial Sequence: Synthetic oligonucleotide
gatgttactaagagttctgcg

SEQ ID NO: 16913 - DNA, 21 bp, Artificial Sequence
  Description of Artificial Sequence: Synthetic oligonucleotide
aatacgactggtcattcgagt

SEQ ID NO: 16914 - DNA, 21 bp, Artificial Sequence
  Description of Artificial Sequence: Synthetic oligonucleotide
gataatgttcagaaggtgtcg

SEQ ID NO: 16915 - DNA, 21 bp, Artificial Sequence
  Description of Artificial Sequence: Synthetic oligonucleotide
ggtaatggggtgccgaatggt

SEQ ID NO: 16916 - DNA, 21 bp, Artificial Sequence
  Description of Artificial Sequence: Synthetic oligonucleotide
caacaagccgcccccagcgtc

SEQ ID NO: 16917 - DNA, 21 bp, Artificial Sequence
  Description of Artificial Sequence: Synthetic oligonucleotide
tcgcaggataataataggtcg

SEQ ID NO: 16918 - DNA, 21 bp, Artificial Sequence
  Description of Artificial Sequence: Synthetic oligonucleotide
gtggagaagggtaagaatgag

SEQ ID NO: 16919 - DNA, 21 bp, Artificial Sequence
  Description of Artificial Sequence: Synthetic oligonucleotide
agcacccaaggcaccagcagc

SEQ ID NO: 16920 - DNA, 21 bp, Artificial Sequence
  Description of Artificial Sequence: Synthetic oligonucleotide
agaagcggcgacaaccccagc

SEQ ID NO: 16921 - DNA, 21 bp, Artificial Sequence
  Description of Artificial Sequence: Synthetic oligonucleotide
accaccgccagccacaacgtc

SEQ ID NO: 16922 - DNA, 21 bp, Artificial Sequence
  Description of Artificial Sequence: Synthetic oligonucleotide
caaagcgtcgaccccaaactc

SEQ ID NO: 16923 - DNA, 21 bp, Artificial Sequence
  Description of Artificial Sequence: Synthetic oligonucleotide
ggtgttacgaatgcgaagtct

SEQ ID NO: 16924 - DNA, 21 bp, Artificial Sequence
  Description of Artificial Sequence: Synthetic oligonucleotide
aatgagtctcgggggtcgtcg

SEQ ID NO: 16925 - DNA, 21 bp, Artificial Sequence
  Description of Artificial Sequence: Synthetic oligonucleotide
caagacagcaaacaaggcgcc

SEQ ID NO: 16926 - DNA, 21 bp, Artificial Sequence
  Description of Artificial Sequence: Synthetic oligonucleotide
agcatgagcagcgaacccaaa

SEQ ID NO: 16927 - DNA, 21 bp, Artificial Sequence
  Description of Artificial Sequence: Synthetic oligonucleotide
agcggcgccggcgccagcctc

SEQ ID NO: 16928 - DNA, 21 bp, Artificial Sequence
  Description of Artificial Sequence: Synthetic oligonucleotide
caaaccagcggcagccacggc

SEQ ID NO: 16929 - DNA, 21 bp, Artificial Sequence
  Description of Artificial Sequence: Synthetic oligonucleotide
gtcggcaacagcaacaccacc

SEQ ID NO: 16930 - DNA, 21 bp, Artificial Sequence
  Description of Artificial Sequence: Synthetic oligonucleotide
agcaaaagcgccgcccccacc

SEQ ID NO: 16931 - DNA, 21 bp, Artificial Sequence
  Description of Artificial Sequence: Synthetic oligonucleotide
gggacgggtcagtctccggtt

SEQ ID NO: 16932 - DNA, 21 bp, Artificial Sequence
  Description of Artificial Sequence: Synthetic oligonucleotide
agcagcaccagcagccacagc

SEQ ID NO: 16933 - DNA, 21 bp, Artificial Sequence
  Description of Artificial Sequence: Synthetic oligonucleotide
atcaaaaacagccaaaccagc

SEQ ID NO: 16934 - DNA, 21 bp, Artificial Sequence
  Description of Artificial Sequence: Synthetic oligonucleotide
agtcatggggataagactctt

SEQ ID NO: 16935 - DNA, 21 bp, Artificial Sequence
  Description of Artificial Sequence: Synthetic oligonucleotide
aatgcttctcagcaggggcag

SEQ ID NO: 16936 - DNA, 21 bp, Artificial Sequence
  Description of Artificial Sequence: Synthetic oligonucleotide
gatggggtgggtactgggagc

SEQ ID NO: 16937 - DNA, 21 bp, Artificial Sequence
  Description of Artificial Sequence: Synthetic oligonucleotide
ggtagtacggggtcgagtgtg

SEQ ID NO: 16938 - DNA, 21 bp, Artificial Sequence
  Description of Artificial Sequence: Synthetic oligonucleotide
gccgtcagcaaccccagccaa

SEQ ID NO: 16939 - DNA, 21 bp, Artificial Sequence
  Description of Artificial Sequence: Synthetic oligonucleotide
accagcggccaaaccggcagc

SEQ ID NO: 16940 - DNA, 21 bp, Artificial Sequence
  Description of Artificial Sequence: Synthetic oligonucleotide
agcggcaccagcaccaccagc

SEQ ID NO: 16941 - DNA, 21 bp, Artificial Sequence
  Description of Artificial Sequence: Synthetic oligonucleotide
cggcaggatgctaagtctgag

SEQ ID NO: 16942 - DNA, 21 bp, Artificial Sequence
  Description of Artificial Sequence: Synthetic oligonucleotide
atgagcaccgtcaaaccccaa

SEQ ID NO: 16943 - DNA, 21 bp, Artificial Sequence
  Description of Artificial Sequence: Synthetic oligonucleotide
gcttttgatcctaagggtggt

SEQ ID NO: 16944 - DNA, 21 bp, Artificial Sequence
  Description of Artificial Sequence: Synthetic oligonucleotide
gttgcgggggcttcgactggt

SEQ ID NO: 16945 - DNA, 21 bp, Artificial Sequence
  Description of Artificial Sequence: Synthetic oligonucleotide
agtggtgctgggactattagt

SEQ ID NO: 16946 - DNA, 21 bp, Artificial Sequence
  Description of Artificial Sequence: Synthetic oligonucleotide
agcctcagcgacaaagccaga

SEQ ID NO: 16947 - DNA, 21 bp, Artificial Sequence
  Description of Artificial Sequence: Synthetic oligonucleotide
tcgactcagtcggctcctact

SEQ ID NO: 16948 - DNA, 21 bp, Artificial Sequence
  Description of Artificial Sequence: Synthetic oligonucleotide
gtgacgggtaagactgatagt

SEQ ID NO: 16949 - DNA, 21 bp, Artificial Sequence
  Description of Artificial Sequence: Synthetic oligonucleotide
caggatactaagagtacttct

SEQ ID NO: 16950 - DNA, 21 bp, Artificial Sequence
  Description of Artificial Sequence: Synthetic oligonucleotide
caagtcggcagcagcagcgtc

SEQ ID NO: 16951 - DNA, 21 bp, Artificial Sequence
  Description of Artificial Sequence: Synthetic oligonucleotide
aacagccaagccccccccaac

SEQ ID NO: 16952 - DNA, 21 bp, Artificial Sequence
  Description of Artificial Sequence: Synthetic oligonucleotide
atgacttcgaaggatatggtg

SEQ ID NO: 16953 - DNA, 21 bp, Artificial Sequence
  Description of Artificial Sequence: Synthetic oligonucleotide
cagtcgtcgagtcagcctggg

SEQ ID NO: 16954 - DNA, 21 bp, Artificial Sequence
  Description of Artificial Sequence: Synthetic oligonucleotide
ggcaccggcagcgcccccgtc

SEQ ID NO: 16955 - DNA, 21 bp, Artificial Sequence
  Description of Artificial Sequence: Synthetic oligonucleotide
tcgggtagttctactgctacg

SEQ ID NO: 16956 - DNA, 21 bp, Artificial Sequence
  Description of Artificial Sequence: Synthetic oligonucleotide
ttgaatactcagtctccgtct

SEQ ID NO: 16957 - DNA, 21 bp, Artificial Sequence
  Description of Artificial Sequence: Synthetic oligonucleotide
ggcgacaccaacgtcaaaggc

SEQ ID NO: 16958 - DNA, 21 bp, Artificial Sequence
  Description of Artificial Sequence: Synthetic oligonucleotide
gccagcaccggcaaagacggc

SEQ ID NO: 16959 - DNA, 21 bp, Artificial Sequence
  Description of Artificial Sequence: Synthetic oligonucleotide
cgtactgggtcttcgaatggt

SEQ ID NO: 16960 - DNA, 21 bp, Artificial Sequence
  Description of Artificial Sequence: Synthetic oligonucleotide
tacaacaacggcgtcagcaaa

SEQ ID NO: 16961 - DNA, 21 bp, Artificial Sequence
  Description of Artificial Sequence: Synthetic oligonucleotide
aacgtcggcagcaccaacagc

SEQ ID NO: 16962 - DNA, 21 bp, Artificial Sequence
  Description of Artificial Sequence: Synthetic oligonucleotide
gggatggcggatcggaataag

SEQ ID NO: 16963 - DNA, 21 bp, Artificial Sequence
  Description of Artificial Sequence: Synthetic oligonucleotide
gggaggcaggatggtgcgaag

SEQ ID NO: 16964 - DNA, 21 bp, Artificial Sequence
  Description of Artificial Sequence: Synthetic oligonucleotide
acgaagtcgaatccgaatagt

SEQ ID NO: 16965 - DNA, 21 bp, Artificial Sequence
  Description of Artificial Sequence: Synthetic oligonucleotide
ggcagcaacaacagcagcggc

SEQ ID NO: 16966 - DNA, 21 bp, Artificial Sequence
  Description of Artificial Sequence: Synthetic oligonucleotide
gtcggcaccaccagcgccagc

SEQ ID NO: 16967 - DNA, 21 bp, Artificial Sequence
  Description of Artificial Sequence: Synthetic oligonucleotide
gtggagggggctagtgtgcgt

SEQ ID NO: 16968 - DNA, 21 bp, Artificial Sequence
  Description of Artificial Sequence: Synthetic oligonucleotide
ggcagcgccaccaaaagcacc

SEQ ID NO: 16969 - DNA, 21 bp, Artificial Sequence
  Description of Artificial Sequence: Synthetic oligonucleotide
tcggctaaggctccgtctctt

SEQ ID NO: 16970 - DNA, 21 bp, Artificial Sequence
  Description of Artificial Sequence: Synthetic oligonucleotide
ggtacgaatacgaataaggcg

SEQ ID NO: 16971 - DNA, 21 bp, Artificial Sequence
  Description of Artificial Sequence: Synthetic oligonucleotide
gaaggcagcagcggcgtcaaa

SEQ ID NO: 16972 - DNA, 21 bp, Artificial Sequence
  Description of Artificial Sequence: Synthetic oligonucleotide
gatagtcgttctgcgagtagt

SEQ ID NO: 16973 - DNA, 21 bp, Artificial Sequence
  Description of Artificial Sequence: Synthetic oligonucleotide
gagaagggtgctgggtcgaag

SEQ ID NO: 16974 - DNA, 21 bp, Artificial Sequence
  Description of Artificial Sequence: Synthetic oligonucleotide
aacaacgccggcaacctcggc

SEQ ID NO: 16975 - DNA, 21 bp, Artificial Sequence
  Description of Artificial Sequence: Synthetic oligonucleotide
agagacgccagcaccaccggc

SEQ ID NO: 16976 - DNA, 21 bp, Artificial Sequence
  Description of Artificial Sequence: Synthetic oligonucleotide
agcagcaaaccccaaagcatg

SEQ ID NO: 16977 - DNA, 21 bp, Artificial Sequence
  Description of Artificial Sequence: Synthetic oligonucleotide
gccaccgacaaaaccgccctc

SEQ ID NO: 16978 - DNA, 21 bp, Artificial Sequence
  Description of Artificial Sequence: Synthetic oligonucleotide
gaaagcagcagccccgccatg

SEQ ID NO: 16979 - DNA, 21 bp, Artificial Sequence
  Description of Artificial Sequence: Synthetic oligonucleotide
atgctcaacgacgccggcaaa

SEQ ID NO: 16980 - DNA, 21 bp, Artificial Sequence
  Description of Artificial Sequence: Synthetic oligonucleotide
caagccggcaacagccccgcc

SEQ ID NO: 16981 - DNA, 21 bp, Artificial Sequence
  Description of Artificial Sequence: Synthetic oligonucleotide
gccggccccagcggcggcggc

SEQ ID NO: 16982 - DNA, 21 bp, Artificial Sequence
  Description of Artificial Sequence: Synthetic oligonucleotide
ggtaatagtaagtcgagtcag

SEQ ID NO: 16983 - DNA, 21 bp, Artificial Sequence
  Description of Artificial Sequence: Synthetic oligonucleotide
ggtgataagacgagtttgacg

SEQ ID NO: 16984 - DNA, 21 bp, Artificial Sequence
  Description of Artificial Sequence: Synthetic oligonucleotide
accgccggccaaggcagcagc

SEQ ID NO: 16985 - DNA, 21 bp, Artificial Sequence
  Description of Artificial Sequence: Synthetic oligonucleotide
aacaccaccagcgccagcgcc

SEQ ID NO: 16986 - DNA, 21 bp, Artificial Sequence
  Description of Artificial Sequence: Synthetic oligonucleotide
ggcgtcgccgcccaaaacagc

SEQ ID NO: 16987 - DNA, 21 bp, Artificial Sequence
  Description of Artificial Sequence: Synthetic oligonucleotide
ggtcagggtcagaagtcgatg

SEQ ID NO: 16988 - DNA, 21 bp, Artificial Sequence
  Description of Artificial Sequence: Synthetic oligonucleotide
ggtcagccttctggtaagacg

SEQ ID NO: 16989 - DNA, 21 bp, Artificial Sequence
  Description of Artificial Sequence: Synthetic oligonucleotide
gaacccagcaccaaaggcctc

SEQ ID NO: 16990 - DNA, 21 bp, Artificial Sequence
  Description of Artificial Sequence: Synthetic oligonucleotide
acggcgactgattctcgtact

SEQ ID NO: 16991 - DNA, 21 bp, Artificial Sequence
  Description of Artificial Sequence: Synthetic oligonucleotide
caaagcgacaacgtcaacaga

SEQ ID NO: 16992 - DNA, 21 bp, Artificial Sequence
  Description of Artificial Sequence: Synthetic oligonucleotide
gctcaggttaagtctaatggt

SEQ ID NO: 16993 - DNA, 21 bp, Artificial Sequence
  Description of Artificial Sequence: Synthetic oligonucleotide
caaagcagccccaccagcagc

SEQ ID NO: 16994 - DNA, 21 bp, Artificial Sequence
  Description of Artificial Sequence: Synthetic oligonucleotide
gatgctgcgcgtaattcggcg

SEQ ID NO: 16995 - DNA, 21 bp, Artificial Sequence
  Description of Artificial Sequence: Synthetic oligonucleotide
gtggatgggggtaagactaat

SEQ ID NO: 16996 - DNA, 21 bp, Artificial Sequence
  Description of Artificial Sequence: Synthetic oligonucleotide
cacggttctggacagaatcaa

SEQ ID NO: 16997 - DNA, 21 bp, Artificial Sequence
  Description of Artificial Sequence: Synthetic oligonucleotide
cttagtggtggttctacgggg

SEQ ID NO: 16998 - DNA, 21 bp, Artificial Sequence
  Description of Artificial Sequence: Synthetic oligonucleotide
cagacgaagccgcaggcggct

SEQ ID NO: 16999 - DNA, 21 bp, Artificial Sequence
  Description of Artificial Sequence: Synthetic oligonucleotide
gacaccaccgccaaaaacatc

SEQ ID NO: 17000 - DNA, 21 bp, Artificial Sequence
  Description of Artificial Sequence: Synthetic oligonucleotide
tctggtgcgcagactgctttg

SEQ ID NO: 17001 - DNA, 21 bp, Artificial Sequence
  Description of Artificial Sequence: Synthetic oligonucleotide
ggcagaaacggcgaagtcaaa

SEQ ID NO: 17002 - DNA, 21 bp, Artificial Sequence
  Description of Artificial Sequence: Synthetic oligonucleotide
cagcataaggatggggcgggg

SEQ ID NO: 17003 - DNA, 21 bp, Artificial Sequence
  Description of Artificial Sequence: Synthetic oligonucleotide
accctcgacagcgtcggcaaa

SEQ ID NO: 17004 - DNA, 21 bp, Artificial Sequence
  Description of Artificial Sequence: Synthetic oligonucleotide
aagcataattcggagcagtcg

SEQ ID NO: 17005 - DNA, 21 bp, Artificial Sequence
  Description of Artificial Sequence: Synthetic oligonucleotide
cagcaggcttcgagtactggt

SEQ ID NO: 17006 - DNA, 21 bp, Artificial Sequence
  Description of Artificial Sequence: Synthetic oligonucleotide
gctacgagtccgccgtctggt

SEQ ID NO: 17007 - DNA, 21 bp, Artificial Sequence
  Description of Artificial Sequence: Synthetic oligonucleotide
cacaccaaagcccaagccggc

SEQ ID NO: 17008 - DNA, 21 bp, Artificial Sequence
  Description of Artificial Sequence: Synthetic oligonucleotide
cgtagtaatggggcggcttct

SEQ ID NO: 17009 - DNA, 21 bp, Artificial Sequence
  Description of Artificial Sequence: Synthetic oligonucleotide
gtcgccaccaaaagcaccagc

SEQ ID NO: 17010 - DNA, 21 bp, Artificial Sequence
  Description of Artificial Sequence: Synthetic oligonucleotide
accagcggcgccggcgtcaac

SEQ ID NO: 17011 - DNA, 21 bp, Artificial Sequence
  Description of Artificial Sequence: Synthetic oligonucleotide
acccacaacagcagcagcagc

SEQ ID NO: 17012 - DNA, 21 bp, Artificial Sequence
  Description of Artificial Sequence: Synthetic oligonucleotide
ggtgagggtaatgcgaggaat

SEQ ID NO: 17013 - DNA, 21 bp, Artificial Sequence
  Description of Artificial Sequence: Synthetic oligonucleotide
ggcagcgtcaaaaccagcagc

SEQ ID NO: 17014 - DNA, 21 bp, Artificial Sequence
  Description of Artificial Sequence: Synthetic oligonucleotide
gctggggagaaggggcttcat

SEQ ID NO: 17015 - DNA, 21 bp, Artificial Sequence
  Description of Artificial Sequence: Synthetic oligonucleotide
ggtcagactgggtctaagacg

SEQ ID NO: 17016 - DNA, 21 bp, Artificial Sequence
  Description of Artificial Sequence: Synthetic oligonucleotide
ggtgggtctaaggggtctcag

SEQ ID NO: 17017 - DNA, 21 bp, Artificial Sequence
  Description of Artificial Sequence: Synthetic oligonucleotide
agtcagtctgcgccgaataag

SEQ ID NO: 17018 - DNA, 21 bp, Artificial Sequence
  Description of Artificial Sequence: Synthetic oligonucleotide
agcgtcgaaggcaccagagtc

SEQ ID NO: 17019 - DNA, 21 bp, Artificial Sequence
  Description of Artificial Sequence: Synthetic oligonucleotide
caaagcggcagccaaggcaac

SEQ ID NO: 17020 - DNA, 21 bp, Artificial Sequence
  Description of Artificial Sequence: Synthetic oligonucleotide
ggtactgatcgtcctagtgtt

SEQ ID NO: 17021 - DNA, 21 bp, Artificial Sequence
  Description of Artificial Sequence: Synthetic oligonucleotide
aacgccagcgccggcagcggc

SEQ ID NO: 17022 - DNA, 21 bp, Artificial Sequence
  Description of Artificial Sequence: Synthetic oligonucleotide
ggcggcagcaaagccctcgaa

SEQ ID NO: 17023 - DNA, 21 bp, Artificial Sequence
  Description of Artificial Sequence: Synthetic oligonucleotide
gacggcaaacaacccggcgtc

SEQ ID NO: 17024 - DNA, 21 bp, Artificial Sequence
  Description of Artificial Sequence: Synthetic oligonucleotide
agcggcaccaccagcaacctc

SEQ ID NO: 17025 - DNA, 21 bp, Artificial Sequence
  Description of Artificial Sequence: Synthetic oligonucleotide
gaaagcagagccaccagcacc

SEQ ID NO: 17026 - DNA, 21 bp, Artificial Sequence
  Description of Artificial Sequence: Synthetic oligonucleotide
tctgcgggggctacgcaggct

SEQ ID NO: 17027 - DNA, 21 bp, Artificial Sequence
  Description of Artificial Sequence: Synthetic oligonucleotide
cacagcgccgccgccaccacc

SEQ ID NO: 17028 - DNA, 21 bp, Artificial Sequence
  Description of Artificial Sequence: Synthetic oligonucleotide
gccaccagccaaggcgccacc

SEQ ID NO: 17029 - DNA, 21 bp, Artificial Sequence
  Description of Artificial Sequence: Synthetic oligonucleotide
agccacaaaagcagcaacgaa

SEQ ID NO: 17030 - DNA, 21 bp, Artificial Sequence
  Description of Artificial Sequence: Synthetic oligonucleotide
atgcaaagcgccagcagcggc

SEQ ID NO: 17031 - DNA, 21 bp, Artificial Sequence
  Description of Artificial Sequence: Synthetic oligonucleotide
ctgggtggtgggaattctact

SEQ ID NO: 17032 - DNA, 21 bp, Artificial Sequence
  Description of Artificial Sequence: Synthetic oligonucleotide
agcggcaaagacagcctcgcc

SEQ ID NO: 17033 - DNA, 21 bp, Artificial Sequence
  Description of Artificial Sequence: Synthetic oligonucleotide
actcagtcgacttcttctgct

SEQ ID NO: 17034 - DNA, 21 bp, Artificial Sequence
  Description of Artificial Sequence: Synthetic oligonucleotide
catactggttctcagagtggg

SEQ ID NO: 17035 - DNA, 21 bp, Artificial Sequence
  Description of Artificial Sequence: Synthetic oligonucleotide
gtcaccaccaacagcaacgcc

SEQ ID NO: 17036 - DNA, 21 bp, Artificial Sequence
  Description of Artificial Sequence: Synthetic oligonucleotide
tctcatgaggctagtccgcat

SEQ ID NO: 17037 - DNA, 21 bp, Artificial Sequence
  Description of Artificial Sequence: Synthetic oligonucleotide
aaccaaaaacaaagccccagc

SEQ ID NO: 17038 - DNA, 21 bp, Artificial Sequence
  Description of Artificial Sequence: Synthetic oligonucleotide
accagcggcaccagcagcaga

SEQ ID NO: 17039 - DNA, 21 bp, Artificial Sequence
  Description of Artificial Sequence: Synthetic oligonucleotide
caacacaccaaccaaaacagc

SEQ ID NO: 17040 - DNA, 21 bp, Artificial Sequence
  Description of Artificial Sequence: Synthetic oligonucleotide
gggacggcgtcgtcggcttcg

SEQ ID NO: 17041 - DNA, 21 bp, Artificial Sequence
  Description of Artificial Sequence: Synthetic oligonucleotide
gggactgagccgcagccgaag

SEQ ID NO: 17042 - DNA, 21 bp, Artificial Sequence
  Description of Artificial Sequence: Synthetic oligonucleotide
aacggcgaaagaagcagcggc

SEQ ID NO: 17043 - DNA, 21 bp, Artificial Sequence
  Description of Artificial Sequence: Synthetic oligonucleotide
atgaccaccaacagcaaagaa

SEQ ID NO: 17044 - DNA, 21 bp, Artificial Sequence
  Description of Artificial Sequence: Synthetic oligonucleotide
caaaccggcggccacagcaga

SEQ ID NO: 17045 - DNA, 21 bp, Artificial Sequence
  Description of Artificial Sequence: Synthetic oligonucleotide
gaactcagcagcaaagccggc

SEQ ID NO: 17046 - DNA, 21 bp, Artificial Sequence
  Description of Artificial Sequence: Synthetic oligonucleotide
gccgacagcaaaagcagccac

SEQ ID NO: 17047 - DNA, 21 bp, Artificial Sequence
  Description of Artificial Sequence: Synthetic oligonucleotide
ggcctcagcagaaacaccggc

SEQ ID NO: 17048 - DNA, 21 bp, Artificial Sequence
  Description of Artificial Sequence: Synthetic oligonucleotide
ttgaataatggtagtaatact

SEQ ID NO: 17049 - DNA, 21 bp, Artificial Sequence
  Description of Artificial Sequence: Synthetic oligonucleotide
gttagtggtaattcgagtcat

SEQ ID NO: 17050 - DNA, 21 bp, Artificial Sequence
  Description of Artificial Sequence: Synthetic oligonucleotide
agcggcgtcgccaccagcacc

SEQ ID NO: 17051 - DNA, 21 bp, Artificial Sequence
  Description of Artificial Sequence: Synthetic oligonucleotide
agcagcagcaaagaagccagc

SEQ ID NO: 17052 - DNA, 21 bp, Artificial Sequence
  Description of Artificial Sequence: Synthetic oligonucleotide
tctcctcagtctgatacgaag

SEQ ID NO: 17053 - DNA, 21 bp, Artificial Sequence
  Description of Artificial Sequence: Synthetic oligonucleotide
agcggcggcagcgaaagagcc

SEQ ID NO: 17054 - DNA, 21 bp, Artificial Sequence
  Description of Artificial Sequence: Synthetic oligonucleotide
atggggagtgatcatgtgcgg

SEQ ID NO: 17055 - DNA, 21 bp, Artificial Sequence
  Description of Artificial Sequence: Synthetic oligonucleotide
gcccccagcgccgaaagaggc

SEQ ID NO: 17056 - DNA, 21 bp, Artificial Sequence
  Description of Artificial Sequence: Synthetic oligonucleotide
aggaatggtggtgctaatatg

SEQ ID NO: 17057 - DNA, 21 bp, Artificial Sequence
  Description of Artificial Sequence: Synthetic oligonucleotide
agggctgatggtgatgcgaag

SEQ ID NO: 17058 - DNA, 21 bp, Artificial Sequence
  Description of Artificial Sequence: Synthetic oligonucleotide
acgaatgattcgaagatggct

SEQ ID NO: 17059 - DNA, 21 bp, Artificial Sequence
  Description of Artificial Sequence: Synthetic oligonucleotide
gacagaatcgaaaaaagcagc

SEQ ID NO: 17060 - DNA, 21 bp, Artificial Sequence
  Description of Artificial Sequence: Synthetic oligonucleotide
ggcgtcgacagccccaacaga

SEQ ID NO: 17061 - DNA, 21 bp, Artificial Sequence
  Description of Artificial Sequence: Synthetic oligonucleotide
tctgttacttcgagtcctcat

SEQ ID NO: 17062 - DNA, 21 bp, Artificial Sequence
  Description of Artificial Sequence: Synthetic oligonucleotide
agacaagacagccccgcccaa

SEQ ID NO: 17063 - DNA, 21 bp, Artificial Sequence
  Description of Artificial Sequence: Synthetic oligonucleotide
tcttcgaatggtaagtcggct

SEQ ID NO: 17064 - DNA, 21 bp, Artificial Sequence
  Description of Artificial Sequence: Synthetic oligonucleotide
aacagcgccggccaaagccac

SEQ ID NO: 17065 - DNA, 21 bp, Artificial Sequence
  Description of Artificial Sequence: Synthetic oligonucleotide
gggagtcatgataagtcgacg

SEQ ID NO: 17066 - DNA, 21 bp, Artificial Sequence
  Description of Artificial Sequence: Synthetic oligonucleotide
ggggaggtgggtcagtctcgt

SEQ ID NO: 17067 - DNA, 21 bp, Artificial Sequence
  Description of Artificial Sequence: Synthetic oligonucleotide
atgggttcgaaggagagtggg

SEQ ID NO: 17068 - DNA, 21 bp, Artificial Sequence
  Description of Artificial Sequence: Synthetic oligonucleotide
agcgccctcaaaaaccaaggc

SEQ ID NO: 17069 - DNA, 21 bp, Artificial Sequence
  Description of Artificial Sequence: Synthetic oligonucleotide
accacccaaagcaccagcatc

SEQ ID NO: 17070 - DNA, 21 bp, Artificial Sequence
  Description of Artificial Sequence: Synthetic oligonucleotide
tcgtctggtggggcgactacg

SEQ ID NO: 17071 - DNA, 21 bp, Artificial Sequence
  Description of Artificial Sequence: Synthetic oligonucleotide
agtgatgataagagtcgtatg

SEQ ID NO: 17072 - DNA, 21 bp, Artificial Sequence
  Description of Artificial Sequence: Synthetic oligonucleotide
ggcagcaccctcggcagcggc

SEQ ID NO: 17073 - DNA, 21 bp, Artificial Sequence
  Description of Artificial Sequence: Synthetic oligonucleotide
actgggggtcctgggaatggt

SEQ ID NO: 17074 - DNA, 21 bp, Artificial Sequence
  Description of Artificial Sequence: Synthetic oligonucleotide
aacaccaaccacaaagaaggc

SEQ ID NO: 17075 - DNA, 21 bp, Artificial Sequence
  Description of Artificial Sequence: Synthetic oligonucleotide
agccaaaacagcggcaaagtc

SEQ ID NO: 17076 - DNA, 21 bp, Artificial Sequence
  Description of Artificial Sequence: Synthetic oligonucleotide
gaggggcgtggtactccgggt

SEQ ID NO: 17077 - DNA, 21 bp, Artificial Sequence
  Description of Artificial Sequence: Synthetic oligonucleotide
agcacccacaaacccctcgaa

SEQ ID NO: 17078 - DNA, 21 bp, Artificial Sequence
  Description of Artificial Sequence: Synthetic oligonucleotide
ggccccggcagcaacctcacc

SEQ ID NO: 17079 - DNA, 21 bp, Artificial Sequence
  Description of Artificial Sequence: Synthetic oligonucleotide
gacctcgacagcagaaaaagc

SEQ ID NO: 17080 - DNA, 21 bp, Artificial Sequence
  Description of Artificial Sequence: Synthetic oligonucleotide
gtcaccaccaccggcagcagc

SEQ ID NO: 17081 - DNA, 21 bp, Artificial Sequence
  Description of Artificial Sequence: Synthetic oligonucleotide
ttgggtactacgtctgggggt

SEQ ID NO: 17082 - DNA, 21 bp, Artificial Sequence
  Description of Artificial Sequence: Synthetic oligonucleotide
tcgaatagttctaagtcgggg

SEQ ID NO: 17083 - DNA, 21 bp, Artificial Sequence
  Description of Artificial Sequence: Synthetic oligonucleotide
actggtagtggttctcatggt

SEQ ID NO: 17084 - DNA, 21 bp, Artificial Sequence
  Description of Artificial Sequence: Synthetic oligonucleotide
caactcagcaaagaaagcagc

SEQ ID NO: 17085 - DNA, 21 bp, Artificial Sequence
  Description of Artificial Sequence: Synthetic oligonucleotide
agcggcggcacccccagcagc

SEQ ID NO: 17086 - DNA, 21 bp, Artificial Sequence
  Description of Artificial Sequence: Synthetic oligonucleotide
gacaccggcacccccaaacac

SEQ ID NO: 17087 - DNA, 21 bp, Artificial Sequence
  Description of Artificial Sequence: Synthetic oligonucleotide
accaaaaccggcagccccatg

SEQ ID NO: 17088 - DNA, 21 bp, Artificial Sequence
  Description of Artificial Sequence: Synthetic oligonucleotide
ggtactacggcgactgatcgt

SEQ ID NO: 17089 - DNA, 21 bp, Artificial Sequence
  Description of Artificial Sequence: Synthetic oligonucleotide
cacaacaccgcccccaccagc

SEQ ID NO: 17090 - DNA, 21 bp, Artificial Sequence
  Description of Artificial Sequence: Synthetic oligonucleotide
aggggtgggagtgcttctgat

SEQ ID NO: 17091 - DNA, 21 bp, Artificial Sequence
  Description of Artificial Sequence: Synthetic oligonucleotide
gaggctgcgaatcagggtaag

SEQ ID NO: 17092 - DNA, 21 bp, Artificial Sequence
  Description of Artificial Sequence: Synthetic oligonucleotide
accagaaccgccaccgccgcc

SEQ ID NO: 17093 - DNA, 21 bp, Artificial Sequence
  Description of Artificial Sequence: Synthetic oligonucleotide
cacaacaacagcgccaccaaa

SEQ ID NO: 17094 - DNA, 21 bp, Artificial Sequence
  Description of Artificial Sequence: Synthetic oligonucleotide
ggcagcgaagacaaacacaaa

SEQ ID NO: 17095 - DNA, 21 bp, Artificial Sequence
  Description of Artificial Sequence: Synthetic oligonucleotide
ggtcagagtaagggtaattcg

SEQ ID NO: 17096 - DNA, 21 bp, Artificial Sequence
  Description of Artificial Sequence: Synthetic oligonucleotide
ggtcatggtgatattaagggt

SEQ ID NO: 17097 - DNA, 21 bp, Artificial Sequence
  Description of Artificial Sequence: Synthetic oligonucleotide
aatgctagttctgctacgtct

SEQ ID NO: 17098 - DNA, 21 bp, Artificial Sequence
  Description of Artificial Sequence: Synthetic oligonucleotide
accaccagcgacaaaagcacc

SEQ ID NO: 17099 - DNA, 21 bp, Artificial Sequence
  Description of Artificial Sequence: Synthetic oligonucleotide
tctgcgaatgctgggggtggt

SEQ ID NO: 17100 - DNA, 21 bp, Artificial Sequence
  Description of Artificial Sequence: Synthetic oligonucleotide
gatgggattacgactccgaag

SEQ ID NO: 17101 - DNA, 21 bp, Artificial Sequence
  Description of Artificial Sequence: Synthetic oligonucleotide
aataattctaaggcgagtgct

SEQ ID NO: 17102 - DNA, 21 bp, Artificial Sequence
  Description of Artificial Sequence: Synthetic oligonucleotide
ggtcatagtgggactacgagt

SEQ ID NO: 17103 - DNA, 21 bp, Artificial Sequence
  Description of Artificial Sequence: Synthetic oligonucleotide
agcggcggcagcaccgcccaa

SEQ ID NO: 17104 - DNA, 21 bp, Artificial Sequence
  Description of Artificial Sequence: Synthetic oligonucleotide
agtggtgctgcttcttcgggt

SEQ ID NO: 17105 - DNA, 21 bp, Artificial Sequence
  Description of Artificial Sequence: Synthetic oligonucleotide
ctggttgcggatggttctaag

SEQ ID NO: 17106 - DNA, 21 bp, Artificial Sequence
  Description of Artificial Sequence: Synthetic oligonucleotide
aacgacggcaaaaccctcgcc

SEQ ID NO: 17107 - DNA, 21 bp, Artificial Sequence
  Description of Artificial Sequence: Synthetic oligonucleotide
atggggactcctaattctaag

SEQ ID NO: 17108 - DNA, 21 bp, Artificial Sequence
  Description of Artificial Sequence: Synthetic oligonucleotide
aatcaggcgtctagtaatcat

SEQ ID NO: 17109 - DNA, 21 bp, Artificial Sequence
  Description of Artificial Sequence: Synthetic oligonucleotide
agccaaagcggcgccggcggc

SEQ ID NO: 17110 - DNA, 21 bp, Artificial Sequence
  Description of Artificial Sequence: Synthetic oligonucleotide
atcaccagcagcagccccacc

SEQ ID NO: 17111 - DNA, 21 bp, Artificial Sequence
  Description of Artificial Sequence: Synthetic oligonucleotide
accaacagccccaacggcgcc

SEQ ID NO: 17112 - DNA, 21 bp, Artificial Sequence
  Description of Artificial Sequence: Synthetic oligonucleotide
tcggggcctactgataagagt

SEQ ID NO: 17113 - DNA, 21 bp, Artificial Sequence
  Description of Artificial Sequence: Synthetic oligonucleotide
accagcaccaccaaaaccggc

SEQ ID NO: 17114 - DNA, 21 bp, Artificial Sequence
  Description of Artificial Sequence: Synthetic oligonucleotide
agcagcgaacaagccagcaga

SEQ ID NO: 17115 - DNA, 21 bp, Artificial Sequence
  Description of Artificial Sequence: Synthetic oligonucleotide
atgcccaacaacaacgccggc

SEQ ID NO: 17116 - DNA, 21 bp, Artificial Sequence
  Description of Artificial Sequence: Synthetic oligonucleotide
cacaccggcggccacgccacc

SEQ ID NO: 17117 - DNA, 21 bp, Artificial Sequence
  Description of Artificial Sequence: Synthetic oligonucleotide
gccctccccgacagcaaagcc

SEQ ID NO: 17118 - DNA, 21 bp, Artificial Sequence
  Description of Artificial Sequence: Synthetic oligonucleotide
gctagtgggggtaaggttatt

SEQ ID NO: 17119 - DNA, 21 bp, Artificial Sequence
  Description of Artificial Sequence: Synthetic oligonucleotide
ggcaccagcccccacgccggc

SEQ ID NO: 17120 - DNA, 21 bp, Artificial Sequence
  Description of Artificial Sequence: Synthetic oligonucleotide
ggcagccaaaaaaccgccggc

SEQ ID NO: 17121 - DNA, 21 bp, Artificial Sequence
  Description of Artificial Sequence: Synthetic oligonucleotide
ggccccaccaacagcagagcc

SEQ ID NO: 17122 - DNA, 21 bp, Artificial Sequence
  Description of Artificial Sequence: Synthetic oligonucleotide
gggaaggatggggtggttaag

SEQ ID NO: 17123 - DNA, 21 bp, Artificial Sequence
  Description of Artificial Sequence: Synthetic oligonucleotide
gtgactaataatcctacggtt

SEQ ID NO: 17124 - DNA, 21 bp, Artificial Sequence
  Description of Artificial Sequence: Synthetic oligonucleotide
tctggtcagacgagtaagcag

SEQ ID NO: 17125 - DNA, 21 bp, Artificial Sequence
  Description of Artificial Sequence: Synthetic oligonucleotide
tcttcgaataatacgactagt

SEQ ID NO: 17126 - DNA, 21 bp, Artificial Sequence
  Description of Artificial Sequence: Synthetic oligonucleotide
ctcgccagccaaggcaacagc

SEQ ID NO: 17127 - DNA, 21 bp, Artificial Sequence
  Description of Artificial Sequence: Synthetic oligonucleotide
agacaagaacaaaacagcgtc

SEQ ID NO: 17128 - DNA, 21 bp, Artificial Sequence
  Description of Artificial Sequence: Synthetic oligonucleotide
gatgggtctactgctggtcgt

SEQ ID NO: 17129 - DNA, 21 bp, Artificial Sequence
  Description of Artificial Sequence: Synthetic oligonucleotide
accggcggccaaggcgccaac

SEQ ID NO: 17130 - DNA, 21 bp, Artificial Sequence
  Description of Artificial Sequence: Synthetic oligonucleotide
catcaggcgacgaagtcgggg

SEQ ID NO: 17131 - DNA, 21 bp, Artificial Sequence
  Description of Artificial Sequence: Synthetic oligonucleotide
agggaggggtctagttctgcg

SEQ ID NO: 17132 - DNA, 21 bp, Artificial Sequence
  Description of Artificial Sequence: Synthetic oligonucleotide
gaaaccggcagcaacagcaga

SEQ ID NO: 17133 - DNA, 21 bp, Artificial Sequence
  Description of Artificial Sequence: Synthetic oligonucleotide
ggcgtcaccgaacccagaaaa

SEQ ID NO: 17134 - DNA, 21 bp, Artificial Sequence
  Description of Artificial Sequence: Synthetic oligonucleotide
ggcatcggcgccaaaggcacc

SEQ ID NO: 17135 - DNA, 21 bp, Artificial Sequence
  Description of Artificial Sequence: Synthetic oligonucleotide
acccaacaaagcagcaacacc

SEQ ID NO: 17136 - DNA, 21 bp, Artificial Sequence
  Description of Artificial Sequence: Synthetic oligonucleotide
aacgccgaaaacaaagccgtc

SEQ ID NO: 17137 - DNA, 21 bp, Artificial Sequence
  Description of Artificial Sequence: Synthetic oligonucleotide
gtcaccaccagcagcagcgcc

SEQ ID NO: 17138 - DNA, 21 bp, Artificial Sequence
  Description of Artificial Sequence: Synthetic oligonucleotide
caaagcggcaacgaactcaaa

SEQ ID NO: 17139 - DNA, 21 bp, Artificial Sequence
  Description of Artificial Sequence: Synthetic oligonucleotide
gaaaccggcggcaaacacgtc

SEQ ID NO: 17140 - DNA, 21 bp, Artificial Sequence
  Description of Artificial Sequence: Synthetic oligonucleotide
gaaagcagcagaagcgccccc

SEQ ID NO: 17141 - DNA, 21 bp, Artificial Sequence
  Description of Artificial Sequence: Synthetic oligonucleotide
atgcagaaggagtcgcctgcg

SEQ ID NO: 17142 - DNA, 21 bp, Artificial Sequence
  Description of Artificial Sequence: Synthetic oligonucleotide
gtgatggggacttctagtggt

SEQ ID NO: 17143 - DNA, 21 bp, Artificial Sequence
  Description of Artificial Sequence: Synthetic oligonucleotide
gacggcagccccaccaccgcc

SEQ ID NO: 17144 - DNA, 21 bp, Artificial Sequence
  Description of Artificial Sequence: Synthetic oligonucleotide
ggcggcagcggcaaagaccaa

SEQ ID NO: 17145 - DNA, 21 bp, Artificial Sequence
  Description of Artificial Sequence: Synthetic oligonucleotide
gccagcggccaaaaaggcgac

SEQ ID NO: 17146 - DNA, 21 bp, Artificial Sequence
  Description of Artificial Sequence: Synthetic oligonucleotide
tctaatgcggcgggtgctagt

SEQ ID NO: 17147 - DNA, 21 bp, Artificial Sequence
  Description of Artificial Sequence: Synthetic oligonucleotide
ggtgagattgcggctaagggt

SEQ ID NO: 17148 - DNA, 21 bp, Artificial Sequence
  Description of Artificial Sequence: Synthetic oligonucleotide
accaacaccgaaaccaccaga

SEQ ID NO: 17149 - DNA, 21 bp, Artificial Sequence
  Description of Artificial Sequence: Synthetic oligonucleotide
caaagcaccagcaccgtcggc

SEQ ID NO: 17150 - DNA, 21 bp, Artificial Sequence
  Description of Artificial Sequence: Synthetic oligonucleotide
accaccgccggcaacggcagc

SEQ ID NO: 17151 - DNA, 21 bp, Artificial Sequence
  Description of Artificial Sequence: Synthetic oligonucleotide
accagagacagcagcagccac

SEQ ID NO: 17152 - DNA, 21 bp, Artificial Sequence
  Description of Artificial Sequence: Synthetic oligonucleotide
accggcggcgaagtccccaga

SEQ ID NO: 17153 - DNA, 21 bp, Artificial Sequence
  Description of Artificial Sequence: Synthetic oligonucleotide
agcgccaccaacaaagccagc

SEQ ID NO: 17154 - DNA, 21 bp, Artificial Sequence
  Description of Artificial Sequence: Synthetic oligonucleotide
ggtagttcggggactccgggg

SEQ ID NO: 17155 - DNA, 21 bp, Artificial Sequence
  Description of Artificial Sequence: Synthetic oligonucleotide
acggctgggtcgcagaagaat

SEQ ID NO: 17156 - DNA, 21 bp, Artificial Sequence
  Description of Artificial Sequence: Synthetic oligonucleotide
gatcctggtacttctaatcgt

SEQ ID NO: 17157 - DNA, 21 bp, Artificial Sequence
  Description of Artificial Sequence: Synthetic oligonucleotide
cagggtgctcagtctcttggg

SEQ ID NO: 17158 - DNA, 21 bp, Artificial Sequence
  Description of Artificial Sequence: Synthetic oligonucleotide
caaaacagaagccccagcgaa

SEQ ID NO: 17159 - DNA, 21 bp, Artificial Sequence
  Description of Artificial Sequence: Synthetic oligonucleotide
gacatgagcccccccaaacaa

SEQ ID NO: 17160 - DNA, 21 bp, Artificial Sequence
  Description of Artificial Sequence: Synthetic oligonucleotide
acgggttcgacgagttcgatg

SEQ ID NO: 17161 - DNA, 21 bp, Artificial Sequence
  Description of Artificial Sequence: Synthetic oligonucleotide
ggggaggcgtctccggttagg

SEQ ID NO: 17162 - DNA, 21 bp, Artificial Sequence
  Description of Artificial Sequence: Synthetic oligonucleotide
gacagcgtcgccaacaacaga

SEQ ID NO: 17163 - DNA, 21 bp, Artificial Sequence
  Description of Artificial Sequence: Synthetic oligonucleotide
gtccccagcagcagcaacgtc

SEQ ID NO: 17164 - DNA, 21 bp, Artificial Sequence
  Description of Artificial Sequence: Synthetic oligonucleotide
acgggtagtaagacggtggag

SEQ ID NO: 17165 - DNA, 21 bp, Artificial Sequence
  Description of Artificial Sequence: Synthetic oligonucleotide
cagattgattcgaagaagggt

SEQ ID NO: 17166 - DNA, 21 bp, Artificial Sequence
  Description of Artificial Sequence: Synthetic oligonucleotide
ctcaacggcgcccccggcagc

SEQ ID NO: 17167 - DNA, 21 bp, Artificial Sequence
  Description of Artificial Sequence: Synthetic oligonucleotide
gggactagtcgggagtcgggg

SEQ ID NO: 17168 - DNA, 21 bp, Artificial Sequence
  Description of Artificial Sequence: Synthetic oligonucleotide
gtcggcgccagccccgaaaga

SEQ ID NO: 17169 - DNA, 21 bp, Artificial Sequence
  Description of Artificial Sequence: Synthetic oligonucleotide
gccaacggcgcccccaccacc

SEQ ID NO: 17170 - DNA, 21 bp, Artificial Sequence
  Description of Artificial Sequence: Synthetic oligonucleotide
actcggaattctggtgctacg

SEQ ID NO: 17171 - DNA, 21 bp, Artificial Sequence
  Description of Artificial Sequence: Synthetic oligonucleotide
agcaccagcaccaaaagcagc

SEQ ID NO: 17172 - DNA, 21 bp, Artificial Sequence
  Description of Artificial Sequence: Synthetic oligonucleotide
ggcgcccacagcaccgaaaaa

SEQ ID NO: 17173 - DNA, 21 bp, Artificial Sequence
  Description of Artificial Sequence: Synthetic oligonucleotide
aatggtgttagtgggaagtcg

SEQ ID NO: 17174 - DNA, 21 bp, Artificial Sequence
  Description of Artificial Sequence: Synthetic oligonucleotide
gacagcaccaccaccggcaaa

SEQ ID NO: 17175 - DNA, 21 bp, Artificial Sequence
  Description of Artificial Sequence: Synthetic oligonucleotide
tctaatggtgctaataagttg

SEQ ID NO: 17176 - DNA, 21 bp, Artificial Sequence
  Description of Artificial Sequence: Synthetic oligonucleotide
gccagcgacaaagccagcaga

SEQ ID NO: 17177 - DNA, 21 bp, Artificial Sequence
  Description of Artificial Sequence: Synthetic oligonucleotide
agcgtcagccaacccaccagc

SEQ ID NO: 17178 - DNA, 21 bp, Artificial Sequence
  Description of Artificial Sequence: Synthetic oligonucleotide
gttggtggtaatggtcaggcg

SEQ ID NO: 17179 - DNA, 21 bp, Artificial Sequence
  Description of Artificial Sequence: Synthetic oligonucleotide
aacagcgccaccgccaaagcc

SEQ ID NO: 17180 - DNA, 21 bp, Artificial Sequence
  Description of Artificial Sequence: Synthetic oligonucleotide
gacctcagcagcaaaagcatc

SEQ ID NO: 17181 - DNA, 21 bp, Artificial Sequence
  Description of Artificial Sequence: Synthetic oligonucleotide
gctagtgcgagtccgaatcag

SEQ ID NO: 17182 - DNA, 21 bp, Artificial Sequence
  Description of Artificial Sequence: Synthetic oligonucleotide
gaaagcggcaccaccggcaga

SEQ ID NO: 17183 - DNA, 21 bp, Artificial Sequence
  Description of Artificial Sequence: Synthetic oligonucleotide
acgagtacgtcggcgcctgtg

SEQ ID NO: 17184 - DNA, 21 bp, Artificial Sequence
  Description of Artificial Sequence: Synthetic oligonucleotide
aacaacggcgccagcagcagc

SEQ ID NO: 17185 - DNA, 21 bp, Artificial Sequence
  Description of Artificial Sequence: Synthetic oligonucleotide
ggcggcggccaacaacccagc

SEQ ID NO: 17186 - DNA, 21 bp, Artificial Sequence
  Description of Artificial Sequence: Synthetic oligonucleotide
gggaaggataatggtgtgtct

SEQ ID NO: 17187 - DNA, 21 bp, Artificial Sequence
  Description of Artificial Sequence: Synthetic oligonucleotide
gatcggcagactccgactctt

SEQ ID NO: 17188 - DNA, 21 bp, Artificial Sequence
  Description of Artificial Sequence: Synthetic oligonucleotide
accagagaaaacaaaaccgaa

SEQ ID NO: 17189 - DNA, 21 bp, Artificial Sequence
  Description of Artificial Sequence: Synthetic oligonucleotide
accgccggcagcaccgtccac

SEQ ID NO: 17190 - DNA, 21 bp, Artificial Sequence
  Description of Artificial Sequence: Synthetic oligonucleotide
agcggcagcagcaccgtcgcc

SEQ ID NO: 17191 - DNA, 21 bp, Artificial Sequence
  Description of Artificial Sequence: Synthetic oligonucleotide
agtgctagtcagacttcgcat

SEQ ID NO: 17192 - DNA, 21 bp, Artificial Sequence
  Description of Artificial Sequence: Synthetic oligonucleotide
aacagcgaaagcagcaaaggc

SEQ ID NO: 17193 - DNA, 21 bp, Artificial Sequence
  Description of Artificial Sequence: Synthetic oligonucleotide
ggcagaaccaacgccgaagcc

SEQ ID NO: 17194 - DNA, 21 bp, Artificial Sequence
  Description of Artificial Sequence: Synthetic oligonucleotide
caacaaagcagcaacaacgtc

SEQ ID NO: 17195 - DNA, 21 bp, Artificial Sequence
  Description of Artificial Sequence: Synthetic oligonucleotide
caagccagcggcagccccgcc

SEQ ID NO: 17196 - DNA, 21 bp, Artificial Sequence
  Description of Artificial Sequence: Synthetic oligonucleotide
acttctggggggtcttctctg

SEQ ID NO: 17197 - DNA, 21 bp, Artificial Sequence
  Description of Artificial Sequence: Synthetic oligonucleotide
aacaacagcacccaccccggc

SEQ ID NO: 17198 - DNA, 21 bp, Artificial Sequence
  Description of Artificial Sequence: Synthetic oligonucleotide
aatgggaattcgcctgctatg

SEQ ID NO: 17199 - DNA, 21 bp, Artificial Sequence
  Description of Artificial Sequence: Synthetic oligonucleotide
aatggtggtgttgcgtcgtct

SEQ ID NO: 17200 - DNA, 21 bp, Artificial Sequence
  Description of Artificial Sequence: Synthetic oligonucleotide
accagcagcaccagcaccggc

SEQ ID NO: 17201 - DNA, 21 bp, Artificial Sequence
  Description of Artificial Sequence: Synthetic oligonucleotide
agtcgtacgaaggagtcggtt

SEQ ID NO: 17202 - DNA, 21 bp, Artificial Sequence
  Description of Artificial Sequence: Synthetic oligonucleotide
gatagtccggggacgctgaag

SEQ ID NO: 17203 - DNA, 21 bp, Artificial Sequence
  Description of Artificial Sequence: Synthetic oligonucleotide
gccggcaccggccaagtccaa

SEQ ID NO: 17204 - DNA, 21 bp, Artificial Sequence
  Description of Artificial Sequence: Synthetic oligonucleotide
gccggccacggcagccaagcc

SEQ ID NO: 17205 - DNA, 21 bp, Artificial Sequence
  Description of Artificial Sequence: Synthetic oligonucleotide
ggcgtcgaaagcagccccaga

SEQ ID NO: 17206 - DNA, 21 bp, Artificial Sequence
  Description of Artificial Sequence: Synthetic oligonucleotide
ggcgtcggcaccgtcaccggc

SEQ ID NO: 17207 - DNA, 21 bp, Artificial Sequence
  Description of Artificial Sequence: Synthetic oligonucleotide
ggggctcataaggatgatggg

SEQ ID NO: 17208 - DNA, 21 bp, Artificial Sequence
  Description of Artificial Sequence: Synthetic oligonucleotide
ggcagcggccaaagccacgcc

SEQ ID NO: 17209 - DNA, 21 bp, Artificial Sequence
  Description of Artificial Sequence: Synthetic oligonucleotide
aagtctgatgggcagcaggcg

SEQ ID NO: 17210 - DNA, 21 bp, Artificial Sequence
  Description of Artificial Sequence: Synthetic oligonucleotide
gaagccaccggcagcagactc

SEQ ID NO: 17211 - DNA, 21 bp, Artificial Sequence
  Description of Artificial Sequence: Synthetic oligonucleotide
gccagcgacagcaaacacggc

SEQ ID NO: 17212 - DNA, 21 bp, Artificial Sequence
  Description of Artificial Sequence: Synthetic oligonucleotide
agcaacagcagcagcaccagc

SEQ ID NO: 17213 - DNA, 21 bp, Artificial Sequence
  Description of Artificial Sequence: Synthetic oligonucleotide
gccaaaaacaccaccagcagc

SEQ ID NO: 17214 - DNA, 21 bp, Artificial Sequence
  Description of Artificial Sequence: Synthetic oligonucleotide
atgaatagtccgtcgagtctg

SEQ ID NO: 17215 - DNA, 21 bp, Artificial Sequence
  Description of Artificial Sequence: Synthetic oligonucleotide
accgtcgccaacacccccagc

SEQ ID NO: 17216 - DNA, 21 bp, Artificial Sequence
  Description of Artificial Sequence: Synthetic oligonucleotide
actggggcgcagaataaggat

SEQ ID NO: 17217 - DNA, 21 bp, Artificial Sequence
  Description of Artificial Sequence: Synthetic oligonucleotide
ggcccccaacccaaagacggc

SEQ ID NO: 17218 - DNA, 21 bp, Artificial Sequence
  Description of Artificial Sequence: Synthetic oligonucleotide
ggcgaaaccagcggcaaaaac

SEQ ID NO: 17219 - DNA, 21 bp, Artificial Sequence
  Description of Artificial Sequence: Synthetic oligonucleotide
atggccgaaagcggcaaaagc

SEQ ID NO: 17220 - DNA, 21 bp, Artificial Sequence
  Description of Artificial Sequence: Synthetic oligonucleotide
accggcgccagcagcagcgtc

SEQ ID NO: 17221 - DNA, 21 bp, Artificial Sequence
  Description of Artificial Sequence: Synthetic oligonucleotide
cgtactaatactacttcggtt

SEQ ID NO: 17222 - DNA, 21 bp, Artificial Sequence
  Description of Artificial Sequence: Synthetic oligonucleotide
gccggcagcgaaaccggcaaa

SEQ ID NO: 17223 - DNA, 21 bp, Artificial Sequence
  Description of Artificial Sequence: Synthetic oligonucleotide
ggcaacagagaagtcaacaaa

SEQ ID NO: 17224 - DNA, 21 bp, Artificial Sequence
  Description of Artificial Sequence: Synthetic oligonucleotide
agcggcagcggcagcagcggc

SEQ ID NO: 17225 - DNA, 21 bp, Artificial Sequence
  Description of Artificial Sequence: Synthetic oligonucleotide
cgggagggtcaggttgcgacg

SEQ ID NO: 17226 - DNA, 21 bp, Artificial Sequence
  Description of Artificial Sequence: Synthetic oligonucleotide
ggcatgagcaacagccccagc

SEQ ID NO: 17227 - DNA, 21 bp, Artificial Sequence
  Description of Artificial Sequence: Synthetic oligonucleotide
caggagcctaagcctctgaat

SEQ ID NO: 17228 - DNA, 21 bp, Artificial Sequence
  Description of Artificial Sequence: Synthetic oligonucleotide
ggggctgatgctagtaagttg

SEQ ID NO: 17229 - DNA, 21 bp, Artificial Sequence
  Description of Artificial Sequence: Synthetic oligonucleotide
caaagcagcgacagaagcgtc

SEQ ID NO: 17230 - DNA, 21 bp, Artificial Sequence
  Description of Artificial Sequence: Synthetic oligonucleotide
gggtcttcgccgggggttcat

SEQ ID NO: 17231 - DNA, 21 bp, Artificial Sequence
  Description of Artificial Sequence: Synthetic oligonucleotide
agtggtacgccgagttctttg

SEQ ID NO: 17232 - DNA, 21 bp, Artificial Sequence
  Description of Artificial Sequence: Synthetic oligonucleotide
agcagcagcaaagaagtcgcc

SEQ ID NO: 17233 - DNA, 21 bp, Artificial Sequence
  Description of Artificial Sequence: Synthetic oligonucleotide
gggcgtggtagtccgaaggat

SEQ ID NO: 17234 - DNA, 21 bp, Artificial Sequence
  Description of Artificial Sequence: Synthetic oligonucleotide
agcaacagcagcacccccacc

SEQ ID NO: 17235 - DNA, 21 bp, Artificial Sequence
  Description of Artificial Sequence: Synthetic oligonucleotide
ctcagcggcacccccagcacc

SEQ ID NO: 17236 - DNA, 21 bp, Artificial Sequence
  Description of Artificial Sequence: Synthetic oligonucleotide
accggcaacagcaaccaacaa

SEQ ID NO: 17237 - DNA, 21 bp, Artificial Sequence
  Description of Artificial Sequence: Synthetic oligonucleotide
gtcagcgacggcaaaaacctc

SEQ ID NO: 17238 - DNA, 21 bp, Artificial Sequence
  Description of Artificial Sequence: Synthetic oligonucleotide
agccaacaaagcaccccccac

SEQ ID NO: 17239 - DNA, 21 bp, Artificial Sequence
  Description of Artificial Sequence: Synthetic oligonucleotide
ggcagcggccccagcgccacc

SEQ ID NO: 17240 - DNA, 21 bp, Artificial Sequence
  Description of Artificial Sequence: Synthetic oligonucleotide
ggtactggtcctactcctcct

SEQ ID NO: 17241 - DNA, 21 bp, Artificial Sequence
  Description of Artificial Sequence: Synthetic oligonucleotide
cagactggtaatggtgggaat

SEQ ID NO: 17242 - DNA, 21 bp, Artificial Sequence
  Description of Artificial Sequence: Synthetic oligonucleotide
aacgccggcggcagcaacaga

SEQ ID NO: 17243 - DNA, 21 bp, Artificial Sequence
  Description of Artificial Sequence: Synthetic oligonucleotide
gacaccagcaaagacagcaaa

SEQ ID NO: 17244 - DNA, 21 bp, Artificial Sequence
  Description of Artificial Sequence: Synthetic oligonucleotide
tcggggtctccgaatgggttg

SEQ ID NO: 17245 - DNA, 21 bp, Artificial Sequence
  Description of Artificial Sequence: Synthetic oligonucleotide
ggcaccggcgccaaccacgcc

SEQ ID NO: 17246 - DNA, 21 bp, Artificial Sequence
  Description of Artificial Sequence: Synthetic oligonucleotide
ctcggcaccaccaaaagcgcc

SEQ ID NO: 17247 - DNA, 21 bp, Artificial Sequence
  Description of Artificial Sequence: Synthetic oligonucleotide
agcacccccagcgccaccaaa

SEQ ID NO: 17248 - DNA, 21 bp, Artificial Sequence
  Description of Artificial Sequence: Synthetic oligonucleotide
gaactcagaagcagcaacgtc

SEQ ID NO: 17249 - DNA, 21 bp, Artificial Sequence
  Description of Artificial Sequence: Synthetic oligonucleotide
aagggtagtggtagtaatggt

SEQ ID NO: 17250 - DNA, 21 bp, Artificial Sequence
  Description of Artificial Sequence: Synthetic oligonucleotide
actaattctagtaaggctctg

SEQ ID NO: 17251 - DNA, 21 bp, Artificial Sequence
  Description of Artificial Sequence: Synthetic oligonucleotide
cagaagggggcgggtgcgact

SEQ ID NO: 17252 - DNA, 21 bp, Artificial Sequence
  Description of Artificial Sequence: Synthetic oligonucleotide
tcgggtaatgattctcgtacg

SEQ ID NO: 17253 - DNA, 21 bp, Artificial Sequence
  Description of Artificial Sequence: Synthetic oligonucleotide
actaggaattcttcgacgacg

SEQ ID NO: 17254 - DNA, 21 bp, Artificial Sequence
  Description of Artificial Sequence: Synthetic oligonucleotide
ggtagttctacttcgtcgacg

SEQ ID NO: 17255 - DNA, 21 bp, Artificial Sequence
  Description of Artificial Sequence: Synthetic oligonucleotide
gacagcaacgccaaaagcggc

SEQ ID NO: 17256 - DNA, 21 bp, Artificial Sequence
  Description of Artificial Sequence: Synthetic oligonucleotide
gtgaatactggtggtagtaat

SEQ ID NO: 17257 - DNA, 21 bp, Artificial Sequence
  Description of Artificial Sequence: Synthetic oligonucleotide
ctcaaccaaggcagcgtccaa

SEQ ID NO: 17258 - DNA, 21 bp, Artificial Sequence
  Description of Artificial Sequence: Synthetic oligonucleotide
gaaaacgtcaacaaaaacaac

SEQ ID NO: 17259 - DNA, 21 bp, Artificial Sequence
  Description of Artificial Sequence: Synthetic oligonucleotide
aatagtaatcagactcagggt

SEQ ID NO: 17260 - DNA, 21 bp, Artificial Sequence
  Description of Artificial Sequence: Synthetic oligonucleotide
aatgcgagtcaggggcatgcg

SEQ ID NO: 17261 - DNA, 21 bp, Artificial Sequence
  Description of Artificial Sequence: Synthetic oligonucleotide
cagacttctgttagtagtgct

SEQ ID NO: 17262 - DNA, 21 bp, Artificial Sequence
  Description of Artificial Sequence: Synthetic oligonucleotide
gggcagggggcgacgacgtct

SEQ ID NO: 17263 - DNA, 21 bp, Artificial Sequence
  Description of Artificial Sequence: Synthetic oligonucleotide
acccaccaaagcagcaccagc

SEQ ID NO: 17264 - DNA, 21 bp, Artificial Sequence
  Description of Artificial Sequence: Synthetic oligonucleotide
acggggaatggttcggcttct

SEQ ID NO: 17265 - DNA, 21 bp, Artificial Sequence
  Description of Artificial Sequence: Synthetic oligonucleotide
agcggccccgacagcaaaagc

SEQ ID NO: 17266 - DNA, 21 bp, Artificial Sequence
  Description of Artificial Sequence: Synthetic oligonucleotide
accggcagcagcagcgtcgtc

SEQ ID NO: 17267 - DNA, 21 bp, Artificial Sequence
  Description of Artificial Sequence: Synthetic oligonucleotide
agcaccagcagcaaagtcagc

SEQ ID NO: 17268 - DNA, 21 bp, Artificial Sequence
  Description of Artificial Sequence: Synthetic oligonucleotide
aacgcccaaaccgccggcggc

SEQ ID NO: 17269 - DNA, 21 bp, Artificial Sequence
  Description of Artificial Sequence: Synthetic oligonucleotide
aacggcagcggccaacaacaa

SEQ ID NO: 17270 - DNA, 21 bp, Artificial Sequence
  Description of Artificial Sequence: Synthetic oligonucleotide
accagagtccccagcgccggc

SEQ ID NO: 17271 - DNA, 21 bp, Artificial Sequence
  Description of Artificial Sequence: Synthetic oligonucleotide
agcaccaccaccggcggcggc

SEQ ID NO: 17272 - DNA, 21 bp, Artificial Sequence
  Description of Artificial Sequence: Synthetic oligonucleotide
agcggcgaacaaaaacaagcc

SEQ ID NO: 17273 - DNA, 21 bp, Artificial Sequence
  Description of Artificial Sequence: Synthetic oligonucleotide
atgaaaggcaacacccccggc

SEQ ID NO: 17274 - DNA, 21 bp, Artificial Sequence
  Description of Artificial Sequence: Synthetic oligonucleotide
cacggcagcggccaacaccaa

SEQ ID NO: 17275 - DNA, 21 bp, Artificial Sequence
  Description of Artificial Sequence: Synthetic oligonucleotide
gacagaagcgaccaccccaaa

SEQ ID NO: 17276 - DNA, 21 bp, Artificial Sequence
  Description of Artificial Sequence: Synthetic oligonucleotide
gacagagccggccaaaccttc

SEQ ID NO: 17277 - DNA, 21 bp, Artificial Sequence
  Description of Artificial Sequence: Synthetic oligonucleotide
gacagcagaaacagcagcgcc

SEQ ID NO: 17278 - DNA, 21 bp, Artificial Sequence
  Description of Artificial Sequence: Synthetic oligonucleotide
gagtcggggtctcatagtatg

SEQ ID NO: 17279 - DNA, 21 bp, Artificial Sequence
  Description of Artificial Sequence: Synthetic oligonucleotide
gccagcaacagcgccgtcaaa

SEQ ID NO: 17280 - DNA, 21 bp, Artificial Sequence
  Description of Artificial Sequence: Synthetic oligonucleotide
gccagcgaaagaagcggcacc

SEQ ID NO: 17281 - DNA, 21 bp, Artificial Sequence
  Description of Artificial Sequence: Synthetic oligonucleotide
gctaatggggctgggagtacg

SEQ ID NO: 17282 - DNA, 21 bp, Artificial Sequence
  Description of Artificial Sequence: Synthetic oligonucleotide
gctaatgttgagaagcctcag

SEQ ID NO: 17283 - DNA, 21 bp, Artificial Sequence
  Description of Artificial Sequence: Synthetic oligonucleotide
ggtaaggaggggggtcatggg

SEQ ID NO: 17284 - DNA, 21 bp, Artificial Sequence
  Description of Artificial Sequence: Synthetic oligonucleotide
ggtaggacgggtcagccgggt

SEQ ID NO: 17285 - DNA, 21 bp, Artificial Sequence
  Description of Artificial Sequence: Synthetic oligonucleotide
cacggcacccaacaaaccgcc

SEQ ID NO: 17286 - DNA, 21 bp, Artificial Sequence
  Description of Artificial Sequence: Synthetic oligonucleotide
accaccagcagcagcggcagc

SEQ ID NO: 17287 - DNA, 21 bp, Artificial Sequence
  Description of Artificial Sequence: Synthetic oligonucleotide
ctcggcgtcaaagacaccaac

SEQ ID NO: 17288 - DNA, 21 bp, Artificial Sequence
  Description of Artificial Sequence: Synthetic oligonucleotide
cttggtgtgccggataatagg

SEQ ID NO: 17289 - DNA, 21 bp, Artificial Sequence
  Description of Artificial Sequence: Synthetic oligonucleotide
accaaccaaaccagcagccac

SEQ ID NO: 17290 - DNA, 21 bp, Artificial Sequence
  Description of Artificial Sequence: Synthetic oligonucleotide
ttggcttctgataaggctgct

SEQ ID NO: 17291 - DNA, 21 bp, Artificial Sequence
  Description of Artificial Sequence: Synthetic oligonucleotide
gatggtacgaagacgactggt

SEQ ID NO: 17292 - DNA, 21 bp, Artificial Sequence
  Description of Artificial Sequence: Synthetic oligonucleotide
ggtcctactgggagtgggggg

SEQ ID NO: 17293 - DNA, 21 bp, Artificial Sequence
  Description of Artificial Sequence: Synthetic oligonucleotide
ggtgataatgcgcagttgaag

SEQ ID NO: 17294 - DNA, 21 bp, Artificial Sequence
  Description of Artificial Sequence: Synthetic oligonucleotide
agcagaagcgccaccagcacc

SEQ ID NO: 17295 - DNA, 21 bp, Artificial Sequence
  Description of Artificial Sequence: Synthetic oligonucleotide
caggctactacgagtacttcg

SEQ ID NO: 17296 - DNA, 21 bp, Artificial Sequence
  Description of Artificial Sequence: Synthetic oligonucleotide
agcacccaagccaccggcaaa

SEQ ID NO: 17297 - DNA, 21 bp, Artificial Sequence
  Description of Artificial Sequence: Synthetic oligonucleotide
aacagcggcaccaaaggcggc

SEQ ID NO: 17298 - DNA, 21 bp, Artificial Sequence
  Description of Artificial Sequence: Synthetic oligonucleotide
aacgccatcgaaaaaaccaaa

SEQ ID NO: 17299 - DNA, 21 bp, Artificial Sequence
  Description of Artificial Sequence: Synthetic oligonucleotide
gatgggaagaatagtcttgcg

SEQ ID NO: 17300 - DNA, 21 bp, Artificial Sequence
  Description of Artificial Sequence: Synthetic oligonucleotide
tctacgacgaagcctaatgat

SEQ ID NO: 17301 - DNA, 21 bp, Artificial Sequence
  Description of Artificial Sequence: Synthetic oligonucleotide
ggcgaaaaacaaggcaccacc

SEQ ID NO: 17302 - DNA, 21 bp, Artificial Sequence
  Description of Artificial Sequence: Synthetic oligonucleotide
ggggttgctaatccttcgtcg

SEQ ID NO: 17303 - DNA, 21 bp, Artificial Sequence
  Description of Artificial Sequence: Synthetic oligonucleotide
ggtactgaggctcatcggacg

SEQ ID NO: 17304 - DNA, 21 bp, Artificial Sequence
  Description of Artificial Sequence: Synthetic oligonucleotide
accgccgccagcacccccagc

SEQ ID NO: 17305 - DNA, 21 bp, Artificial Sequence
  Description of Artificial Sequence: Synthetic oligonucleotide
cagaatggtgcgtctccgaat

SEQ ID NO: 17306 - DNA, 21 bp, Artificial Sequence
  Description of Artificial Sequence: Synthetic oligonucleotide
gtcagcgccgccagcgtcagc

SEQ ID NO: 17307 - DNA, 21 bp, Artificial Sequence
  Description of Artificial Sequence: Synthetic oligonucleotide
ggctacggcagcaaaggcgaa

SEQ ID NO: 17308 - DNA, 21 bp, Artificial Sequence
  Description of Artificial Sequence: Synthetic oligonucleotide
tctgtgtcgagtcctagtgct

SEQ ID NO: 17309 - DNA, 21 bp, Artificial Sequence
  Description of Artificial Sequence: Synthetic oligonucleotide
caaggcaacggccacatccaa

SEQ ID NO: 17310 - DNA, 21 bp, Artificial Sequence
  Description of Artificial Sequence: Synthetic oligonucleotide
caaagcgcccccgaaaccaaa

SEQ ID NO: 17311 - DNA, 21 bp, Artificial Sequence
  Description of Artificial Sequence: Synthetic oligonucleotide
gctaatacgtctcatagtagt

SEQ ID NO: 17312 - DNA, 21 bp, Artificial Sequence
  Description of Artificial Sequence: Synthetic oligonucleotide
ggcggcaaagccagcagcgcc

SEQ ID NO: 17313 - DNA, 21 bp, Artificial Sequence
  Description of Artificial Sequence: Synthetic oligonucleotide
agcagaaacgaaggccccaaa

SEQ ID NO: 17314 - DNA, 21 bp, Artificial Sequence
  Description of Artificial Sequence: Synthetic oligonucleotide
tcttctagtcagactcatact

SEQ ID NO: 17315 - DNA, 21 bp, Artificial Sequence
  Description of Artificial Sequence: Synthetic oligonucleotide
accgtcggcaaagaccccatg

SEQ ID NO: 17316 - DNA, 21 bp, Artificial Sequence
  Description of Artificial Sequence: Synthetic oligonucleotide
tcgaggaatactcagtctgag

SEQ ID NO: 17317 - DNA, 21 bp, Artificial Sequence
  Description of Artificial Sequence: Synthetic oligonucleotide
agcaaaacccaaacccccgcc

SEQ ID NO: 17318 - DNA, 21 bp, Artificial Sequence
  Description of Artificial Sequence: Synthetic oligonucleotide
agcaaaggccaaagcaccagc

SEQ ID NO: 17319 - DNA, 21 bp, Artificial Sequence
  Description of Artificial Sequence: Synthetic oligonucleotide
cagggtgagaataatgttaag

SEQ ID NO: 17320 - DNA, 21 bp, Artificial Sequence
  Description of Artificial Sequence: Synthetic oligonucleotide
accagcggcagcaccgtcgcc

SEQ ID NO: 17321 - DNA, 21 bp, Artificial Sequence
  Description of Artificial Sequence: Synthetic oligonucleotide
tcttctgctgcgggtcagggt

SEQ ID NO: 17322 - DNA, 21 bp, Artificial Sequence
  Description of Artificial Sequence: Synthetic oligonucleotide
gtcgccggcggcaacagcgtc

SEQ ID NO: 17323 - DNA, 21 bp, Artificial Sequence
  Description of Artificial Sequence: Synthetic oligonucleotide
acggataatagtggtcctaag

SEQ ID NO: 17324 - DNA, 21 bp, Artificial Sequence
  Description of Artificial Sequence: Synthetic oligonucleotide
gttggtggtagttctaatgcg

SEQ ID NO: 17325 - DNA, 21 bp, Artificial Sequence
  Description of Artificial Sequence: Synthetic oligonucleotide
ggcagccaagccagacccctc

SEQ ID NO: 17326 - DNA, 21 bp, Artificial Sequence
  Description of Artificial Sequence: Synthetic oligonucleotide
gtttctgggggggcttcgcct

SEQ ID NO: 17327 - DNA, 21 bp, Artificial Sequence
  Description of Artificial Sequence: Synthetic oligonucleotide
caggatgggaagcctagtgct

SEQ ID NO: 17328 - DNA, 21 bp, Artificial Sequence
  Description of Artificial Sequence: Synthetic oligonucleotide
agcggcaccgacacccacaga

SEQ ID NO: 17329 - DNA, 21 bp, Artificial Sequence
  Description of Artificial Sequence: Synthetic oligonucleotide
gccatcgaaagcaaacccagc

SEQ ID NO: 17330 - DNA, 21 bp, Artificial Sequence
  Description of Artificial Sequence: Synthetic oligonucleotide
agcagcgccaccgcccaaagc

SEQ ID NO: 17331 - DNA, 21 bp, Artificial Sequence
  Description of Artificial Sequence: Synthetic oligonucleotide
gcgggtactagtaatagggtt

SEQ ID NO: 17332 - DNA, 21 bp, Artificial Sequence
  Description of Artificial Sequence: Synthetic oligonucleotide
ggggtgaatggtgcttcgagg

SEQ ID NO: 17333 - DNA, 21 bp, Artificial Sequence
  Description of Artificial Sequence: Synthetic oligonucleotide
cagcagcctccgcctggtaag

SEQ ID NO: 17334 - DNA, 21 bp, Artificial Sequence
  Description of Artificial Sequence: Synthetic oligonucleotide
ggtactgcgagtgagaatcgg

SEQ ID NO: 17335 - DNA, 21 bp, Artificial Sequence
  Description of Artificial Sequence: Synthetic oligonucleotide
aaaagcggcaacagcaacgtc

SEQ ID NO: 17336 - DNA, 21 bp, Artificial Sequence
  Description of Artificial Sequence: Synthetic oligonucleotide
gccggcagccccagcaacggc

SEQ ID NO: 17337 - DNA, 21 bp, Artificial Sequence
  Description of Artificial Sequence: Synthetic oligonucleotide
ggcctcagcaaagaaagaccc

SEQ ID NO: 17338 - DNA, 21 bp, Artificial Sequence
  Description of Artificial Sequence: Synthetic oligonucleotide
ggtgcgcatacggggtctcag

SEQ ID NO: 17339 - DNA, 21 bp, Artificial Sequence
  Description of Artificial Sequence: Synthetic oligonucleotide
gttggtgttagtaaggagtct

SEQ ID NO: 17340 - DNA, 21 bp, Artificial Sequence
  Description of Artificial Sequence: Synthetic oligonucleotide
gattctcagaaggctaatgct

SEQ ID NO: 17341 - DNA, 21 bp, Artificial Sequence
  Description of Artificial Sequence: Synthetic oligonucleotide
gtgcctcagaatagtactaag

SEQ ID NO: 17342 - DNA, 21 bp, Artificial Sequence
  Description of Artificial Sequence: Synthetic oligonucleotide
actgatagtactcatacgtcg

SEQ ID NO: 17343 - DNA, 21 bp, Artificial Sequence
  Description of Artificial Sequence: Synthetic oligonucleotide
agcaccgaaaaaagcctcggc

SEQ ID NO: 17344 - DNA, 21 bp, Artificial Sequence
  Description of Artificial Sequence: Synthetic oligonucleotide
cacgccggcagcaacagcagc

SEQ ID NO: 17345 - DNA, 21 bp, Artificial Sequence
  Description of Artificial Sequence: Synthetic oligonucleotide
gagaggactactccgagtaat

SEQ ID NO: 17346 - DNA, 21 bp, Artificial Sequence
  Description of Artificial Sequence: Synthetic oligonucleotide
ggcaacggcagcagcagcggc

SEQ ID NO: 17347 - DNA, 21 bp, Artificial Sequence
  Description of Artificial Sequence: Synthetic oligonucleotide
tctgggcagaatagttcggtg

SEQ ID NO: 17348 - DNA, 21 bp, Artificial Sequence
  Description of Artificial Sequence: Synthetic oligonucleotide
gaaaaccccagcggcaaaggc

SEQ ID NO: 17349 - DNA, 21 bp, Artificial Sequence
  Description of Artificial Sequence: Synthetic oligonucleotide
aacggttctggacagaatgga

SEQ ID NO: 17350 - DNA, 21 bp, Artificial Sequence
  Description of Artificial Sequence: Synthetic oligonucleotide
ggtagtaattcgactccgtct

SEQ ID NO: 17351 - DNA, 21 bp, Artificial Sequence
  Description of Artificial Sequence: Synthetic oligonucleotide
gacggcaaaggcgaaaaaagc

SEQ ID NO: 17352 - DNA, 21 bp, Artificial Sequence
  Description of Artificial Sequence: Synthetic oligonucleotide
ggcgccgaccccaaaaacggc

SEQ ID NO: 17353 - DNA, 21 bp, Artificial Sequence
  Description of Artificial Sequence: Synthetic oligonucleotide
tattctgggaaggatgtgtcg

SEQ ID NO: 17354 - DNA, 21 bp, Artificial Sequence
  Description of Artificial Sequence: Synthetic oligonucleotide
tctgttggtgcttcgaattct

SEQ ID NO: 17355 - DNA, 21 bp, Artificial Sequence
  Description of Artificial Sequence: Synthetic oligonucleotide
accagcaacagccccttcacc

SEQ ID NO: 17356 - DNA, 21 bp, Artificial Sequence
  Description of Artificial Sequence: Synthetic oligonucleotide
gaaggcagcacccaaaccaaa

SEQ ID NO: 17357 - DNA, 21 bp, Artificial Sequence
  Description of Artificial Sequence: Synthetic oligonucleotide
accaccgaagccggcagcaaa

SEQ ID NO: 17358 - DNA, 21 bp, Artificial Sequence
  Description of Artificial Sequence: Synthetic oligonucleotide
gagaataaggggagtaatagt

SEQ ID NO: 17359 - DNA, 21 bp, Artificial Sequence
  Description of Artificial Sequence: Synthetic oligonucleotide
actgggatttctggtacgaat

SEQ ID NO: 17360 - DNA, 21 bp, Artificial Sequence
  Description of Artificial Sequence: Synthetic oligonucleotide
ggggatacgaagccgattcat

SEQ ID NO: 17361 - DNA, 21 bp, Artificial Sequence
  Description of Artificial Sequence: Synthetic oligonucleotide
acccccagcgacaaaaccgtc

SEQ ID NO: 17362 - DNA, 21 bp, Artificial Sequence
  Description of Artificial Sequence: Synthetic oligonucleotide
gaacccaacagcaaacaaggc

SEQ ID NO: 17363 - DNA, 21 bp, Artificial Sequence
  Description of Artificial Sequence: Synthetic oligonucleotide
gtcaccctcgacaaaagcagc

SEQ ID NO: 17364 - DNA, 21 bp, Artificial Sequence
  Description of Artificial Sequence: Synthetic oligonucleotide
actacggggggttcttcgact

SEQ ID NO: 17365 - DNA, 21 bp, Artificial Sequence
  Description of Artificial Sequence: Synthetic oligonucleotide
accagcgccgccggcaccgcc

SEQ ID NO: 17366 - DNA, 21 bp, Artificial Sequence
  Description of Artificial Sequence: Synthetic oligonucleotide
actggtgagtcgcatccgaat

SEQ ID NO: 17367 - DNA, 21 bp, Artificial Sequence
  Description of Artificial Sequence: Synthetic oligonucleotide
gttagtaattctaagtctacg

SEQ ID NO: 17368 - DNA, 21 bp, Artificial Sequence
  Description of Artificial Sequence: Synthetic oligonucleotide
agcagccaaaaacccgtcaac

SEQ ID NO: 17369 - DNA, 21 bp, Artificial Sequence
  Description of Artificial Sequence: Synthetic oligonucleotide
agtagtgaggctcgtaatcat

SEQ ID NO: 17370 - DNA, 21 bp, Artificial Sequence
  Description of Artificial Sequence: Synthetic oligonucleotide
gatcaggctaatccgcgtcag

SEQ ID NO: 17371 - DNA, 21 bp, Artificial Sequence
  Description of Artificial Sequence: Synthetic oligonucleotide
agcaccaacacccccccccaa

SEQ ID NO: 17372 - DNA, 21 bp, Artificial Sequence
  Description of Artificial Sequence: Synthetic oligonucleotide
gggaatcagcagggtgcttcg

SEQ ID NO: 17373 - DNA, 21 bp, Artificial Sequence
  Description of Artificial Sequence: Synthetic oligonucleotide
ttgggtaattctcctacgacg

SEQ ID NO: 17374 - DNA, 21 bp, Artificial Sequence
  Description of Artificial Sequence: Synthetic oligonucleotide
aatcagtctagtgcgggtggt

SEQ ID NO: 17375 - DNA, 21 bp, Artificial Sequence
  Description of Artificial Sequence: Synthetic oligonucleotide
tctcagacttcgagtagtcag

SEQ ID NO: 17376 - DNA, 21 bp, Artificial Sequence
  Description of Artificial Sequence: Synthetic oligonucleotide
aaaggcaccagcaacagccaa

SEQ ID NO: 17377 - DNA, 21 bp, Artificial Sequence
  Description of Artificial Sequence: Synthetic oligonucleotide
gaaagaagcgacaaacccttc

SEQ ID NO: 17378 - DNA, 21 bp, Artificial Sequence
  Description of Artificial Sequence: Synthetic oligonucleotide
agcaacgtcagcagccacacc

SEQ ID NO: 17379 - DNA, 21 bp, Artificial Sequence
  Description of Artificial Sequence: Synthetic oligonucleotide
agcaacgccagcggcaacaac

SEQ ID NO: 17380 - DNA, 21 bp, Artificial Sequence
  Description of Artificial Sequence: Synthetic oligonucleotide
caggatagggagaagacgctt

SEQ ID NO: 17381 - DNA, 21 bp, Artificial Sequence
  Description of Artificial Sequence: Synthetic oligonucleotide
aacaacgccagcaccagcacc

SEQ ID NO: 17382 - DNA, 21 bp, Artificial Sequence
  Description of Artificial Sequence: Synthetic oligonucleotide
agaagcgaaggcgccagcgtc

SEQ ID NO: 17383 - DNA, 21 bp, Artificial Sequence
  Description of Artificial Sequence: Synthetic oligonucleotide
tcgactggttcgggtccgtcg

SEQ ID NO: 17384 - DNA, 21 bp, Artificial Sequence
  Description of Artificial Sequence: Synthetic oligonucleotide
tctagtcagacggctaataag

SEQ ID NO: 17385 - DNA, 21 bp, Artificial Sequence
  Description of Artificial Sequence: Synthetic oligonucleotide
atgtctactagtgctaatcat

SEQ ID NO: 17386 - DNA, 21 bp, Artificial Sequence
  Description of Artificial Sequence: Synthetic oligonucleotide
tctggtgcgagtacggggaat

SEQ ID NO: 17387 - DNA, 21 bp, Artificial Sequence
  Description of Artificial Sequence: Synthetic oligonucleotide
gatcagttgtctaatgctaag

SEQ ID NO: 17388 - DNA, 21 bp, Artificial Sequence
  Description of Artificial Sequence: Synthetic oligonucleotide
gacagcagcagccacagcaaa

SEQ ID NO: 17389 - DNA, 21 bp, Artificial Sequence
  Description of Artificial Sequence: Synthetic oligonucleotide
caggggacgtcgagtgtgccg

SEQ ID NO: 17390 - DNA, 21 bp, Artificial Sequence
  Description of Artificial Sequence: Synthetic oligonucleotide
ggcaccgtcggcagcaacagc

SEQ ID NO: 17391 - DNA, 21 bp, Artificial Sequence
  Description of Artificial Sequence: Synthetic oligonucleotide
agcgtcagcagcacccccagc

SEQ ID NO: 17392 - DNA, 21 bp, Artificial Sequence
  Description of Artificial Sequence: Synthetic oligonucleotide
aacagcatcggccaaagcaaa

SEQ ID NO: 17393 - DNA, 21 bp, Artificial Sequence
  Description of Artificial Sequence: Synthetic oligonucleotide
gccgccggcagcaacagcacc

SEQ ID NO: 17394 - DNA, 21 bp, Artificial Sequence
  Description of Artificial Sequence: Synthetic oligonucleotide
acgtctgctcgtgatgttcag

SEQ ID NO: 17395 - DNA, 21 bp, Artificial Sequence
  Description of Artificial Sequence: Synthetic oligonucleotide
atgaacaccagcaaccccgtc

SEQ ID NO: 17396 - DNA, 21 bp, Artificial Sequence
  Description of Artificial Sequence: Synthetic oligonucleotide
accggcagcaccggcaacatg

SEQ ID NO: 17397 - DNA, 21 bp, Artificial Sequence
  Description of Artificial Sequence: Synthetic oligonucleotide
agcaacggcaccagcggcggc

SEQ ID NO: 17398 - DNA, 21 bp, Artificial Sequence
  Description of Artificial Sequence: Synthetic oligonucleotide
agggagggggatcgtgggggg

SEQ ID NO: 17399 - DNA, 21 bp, Artificial Sequence
  Description of Artificial Sequence: Synthetic oligonucleotide
atgccccccaaacccagcacc

SEQ ID NO: 17400 - DNA, 21 bp, Artificial Sequence
  Description of Artificial Sequence: Synthetic oligonucleotide
atggacggcaccagcagcaga

SEQ ID NO: 17401 - DNA, 21 bp, Artificial Sequence
  Description of Artificial Sequence: Synthetic oligonucleotide
cttactggttctaagtctgat

SEQ ID NO: 17402 - DNA, 21 bp, Artificial Sequence
  Description of Artificial Sequence: Synthetic oligonucleotide
gattcttctaatcagaggaat

SEQ ID NO: 17403 - DNA, 21 bp, Artificial Sequence
  Description of Artificial Sequence: Synthetic oligonucleotide
ggtactgggccgtcgaagagt

SEQ ID NO: 17404 - DNA, 21 bp, Artificial Sequence
  Description of Artificial Sequence: Synthetic oligonucleotide
gtgacgtctagtaagacggag

SEQ ID NO: 17405 - DNA, 21 bp, Artificial Sequence
  Description of Artificial Sequence: Synthetic oligonucleotide
accgacaaagccaacgccgtc

SEQ ID NO: 17406 - DNA, 21 bp, Artificial Sequence
  Description of Artificial Sequence: Synthetic oligonucleotide
accggcagcagcggcagcggc

SEQ ID NO: 17407 - DNA, 21 bp, Artificial Sequence
  Description of Artificial Sequence: Synthetic oligonucleotide
cttaatggttctagtagtcgc

SEQ ID NO: 17408 - DNA, 21 bp, Artificial Sequence
  Description of Artificial Sequence: Synthetic oligonucleotide
gagaggacgacgggggttggt

SEQ ID NO: 17409 - DNA, 21 bp, Artificial Sequence
  Description of Artificial Sequence: Synthetic oligonucleotide
acgggtagtgggtcgacttct

SEQ ID NO: 17410 - DNA, 21 bp, Artificial Sequence
  Description of Artificial Sequence: Synthetic oligonucleotide
gcgagtggtggtaagaatgag

SEQ ID NO: 17411 - DNA, 21 bp, Artificial Sequence
  Description of Artificial Sequence: Synthetic oligonucleotide
gtgggggagaattctccgcgt

SEQ ID NO: 17412 - DNA, 21 bp, Artificial Sequence
  Description of Artificial Sequence: Synthetic oligonucleotide
accgccaacaaaagcaaagac

SEQ ID NO: 17413 - DNA, 21 bp, Artificial Sequence
  Description of Artificial Sequence: Synthetic oligonucleotide
agtctgggttctaagggttcg

SEQ ID NO: 17414 - DNA, 21 bp, Artificial Sequence
  Description of Artificial Sequence: Synthetic oligonucleotide
aacggcagcggcacccccagc

SEQ ID NO: 17415 - DNA, 21 bp, Artificial Sequence
  Description of Artificial Sequence: Synthetic oligonucleotide
aaaggcaacaccagcgccgcc

SEQ ID NO: 17416 - DNA, 21 bp, Artificial Sequence
  Description of Artificial Sequence: Synthetic oligonucleotide
cggagtgatcagggtaatatt

SEQ ID NO: 17417 - DNA, 21 bp, Artificial Sequence
  Description of Artificial Sequence: Synthetic oligonucleotide
ctcaacggcagcaaccaaacc

SEQ ID NO: 17418 - DNA, 21 bp, Artificial Sequence
  Description of Artificial Sequence: Synthetic oligonucleotide
agcggcagcggcagcaacctc

SEQ ID NO: 17419 - DNA, 21 bp, Artificial Sequence
  Description of Artificial Sequence: Synthetic oligonucleotide
gagtcggtttcgaagaatttg

SEQ ID NO: 17420 - DNA, 21 bp, Artificial Sequence
  Description of Artificial Sequence: Synthetic oligonucleotide
ggttctcttaaggatgctacg

SEQ ID NO: 17421 - DNA, 21 bp, Artificial Sequence
  Description of Artificial Sequence: Synthetic oligonucleotide
atgaccgtcaaaagcagcgaa

SEQ ID NO: 17422 - DNA, 21 bp, Artificial Sequence
  Description of Artificial Sequence: Synthetic oligonucleotide
ggcagcgtcaaaggcgaaccc

SEQ ID NO: 17423 - DNA, 21 bp, Artificial Sequence
  Description of Artificial Sequence: Synthetic oligonucleotide
gctcagggtgggtctgttaag

SEQ ID NO: 17424 - DNA, 21 bp, Artificial Sequence
  Description of Artificial Sequence: Synthetic oligonucleotide
agcaacagcagcggccacgtc

SEQ ID NO: 17425 - DNA, 21 bp, Artificial Sequence
  Description of Artificial Sequence: Synthetic oligonucleotide
ggtaagagtacttcggagggt

SEQ ID NO: 17426 - DNA, 21 bp, Artificial Sequence
  Description of Artificial Sequence: Synthetic oligonucleotide
ggcagcagcgacaaaagaaac

SEQ ID NO: 17427 - DNA, 21 bp, Artificial Sequence
  Description of Artificial Sequence: Synthetic oligonucleotide
tctgtttctgctccttcgacg

SEQ ID NO: 17428 - DNA, 21 bp, Artificial Sequence
  Description of Artificial Sequence: Synthetic oligonucleotide
accagagacagcaaaagcctc

SEQ ID NO: 17429 - DNA, 21 bp, Artificial Sequence
  Description of Artificial Sequence: Synthetic oligonucleotide
atgcgggatgcttcgactact

SEQ ID NO: 17430 - DNA, 21 bp, Artificial Sequence
  Description of Artificial Sequence: Synthetic oligonucleotide
caaggcagcaccagccccatc

SEQ ID NO: 17431 - DNA, 21 bp, Artificial Sequence
  Description of Artificial Sequence: Synthetic oligonucleotide
gacaacagagaccccaaactc

SEQ ID NO: 17432 - DNA, 21 bp, Artificial Sequence
  Description of Artificial Sequence: Synthetic oligonucleotide
accggcagccaaagcagcacc

SEQ ID NO: 17433 - DNA, 21 bp, Artificial Sequence
  Description of Artificial Sequence: Synthetic oligonucleotide
gagacgccgacttcgaatcgg

SEQ ID NO: 17434 - DNA, 21 bp, Artificial Sequence
  Description of Artificial Sequence: Synthetic oligonucleotide
gttcgcgatagtagtaatcat

SEQ ID NO: 17435 - DNA, 21 bp, Artificial Sequence
  Description of Artificial Sequence: Synthetic oligonucleotide
gctgctgggagttcgaatacg

SEQ ID NO: 17436 - DNA, 21 bp, Artificial Sequence
  Description of Artificial Sequence: Synthetic oligonucleotide
gacggcagagccagcgtcagc

SEQ ID NO: 17437 - DNA, 21 bp, Artificial Sequence
  Description of Artificial Sequence: Synthetic oligonucleotide
ggcctcggcgcccaagccgcc

SEQ ID NO: 17438 - DNA, 21 bp, Artificial Sequence
  Description of Artificial Sequence: Synthetic oligonucleotide
agcgtcagcagcagccccagc

SEQ ID NO: 17439 - DNA, 21 bp, Artificial Sequence
  Description of Artificial Sequence: Synthetic oligonucleotide
cagttgaatccgaaggatggg

SEQ ID NO: 17440 - DNA, 21 bp, Artificial Sequence
  Description of Artificial Sequence: Synthetic oligonucleotide
gccggcaccgaaaaaatcagc

SEQ ID NO: 17441 - DNA, 21 bp, Artificial Sequence
  Description of Artificial Sequence: Synthetic oligonucleotide
accgccagcgacaaaaccaga

SEQ ID NO: 17442 - DNA, 21 bp, Artificial Sequence
  Description of Artificial Sequence: Synthetic oligonucleotide
aattcgactacgaaggcgaat

SEQ ID NO: 17443 - DNA, 21 bp, Artificial Sequence
  Description of Artificial Sequence: Synthetic oligonucleotide
tctaagtctaataatcgtgag

SEQ ID NO: 17444 - DNA, 21 bp, Artificial Sequence
  Description of Artificial Sequence: Synthetic oligonucleotide
agtttgagtcagaagagtgag

SEQ ID NO: 17445 - DNA, 21 bp, Artificial Sequence
  Description of Artificial Sequence: Synthetic oligonucleotide
aatgttggtcatcctaatgag

SEQ ID NO: 17446 - DNA, 21 bp, Artificial Sequence
  Description of Artificial Sequence: Synthetic oligonucleotide
agcagcgaacaccccaaaggc

SEQ ID NO: 17447 - DNA, 21 bp, Artificial Sequence
  Description of Artificial Sequence: Synthetic oligonucleotide
agcgcccaacccagcggcggc

SEQ ID NO: 17448 - DNA, 21 bp, Artificial Sequence
  Description of Artificial Sequence: Synthetic oligonucleotide
agtggtagttctaggacggag

SEQ ID NO: 17449 - DNA, 21 bp, Artificial Sequence
  Description of Artificial Sequence: Synthetic oligonucleotide
caggataatcagggtaagccg

SEQ ID NO: 17450 - DNA, 21 bp, Artificial Sequence
  Description of Artificial Sequence: Synthetic oligonucleotide
gaaggcgacaaacaccccgtc

SEQ ID NO: 17451 - DNA, 21 bp, Artificial Sequence
  Description of Artificial Sequence: Synthetic oligonucleotide
gaaggcgcccacagacccggc

SEQ ID NO: 17452 - DNA, 21 bp, Artificial Sequence
  Description of Artificial Sequence: Synthetic oligonucleotide
ggccccgaaagcagaccccaa

SEQ ID NO: 17453 - DNA, 21 bp, Artificial Sequence
  Description of Artificial Sequence: Synthetic oligonucleotide
gggactagtgagaagacgatt

SEQ ID NO: 17454 - DNA, 21 bp, Artificial Sequence
  Description of Artificial Sequence: Synthetic oligonucleotide
ggtaatggttcttctagggat

SEQ ID NO: 17455 - DNA, 21 bp, Artificial Sequence
  Description of Artificial Sequence: Synthetic oligonucleotide
ttccccaccgaaagcgccggc

SEQ ID NO: 17456 - DNA, 21 bp, Artificial Sequence
  Description of Artificial Sequence: Synthetic oligonucleotide
aaccccggcaaagacagcaga

SEQ ID NO: 17457 - DNA, 21 bp, Artificial Sequence
  Description of Artificial Sequence: Synthetic oligonucleotide
atggggggttcgggtcatggt

SEQ ID NO: 17458 - DNA, 21 bp, Artificial Sequence
  Description of Artificial Sequence: Synthetic oligonucleotide
accgaaagcaaaagcagcgtc

SEQ ID NO: 17459 - DNA, 21 bp, Artificial Sequence
  Description of Artificial Sequence: Synthetic oligonucleotide
accaccgccagccccaacaaa

SEQ ID NO: 17460 - DNA, 21 bp, Artificial Sequence
  Description of Artificial Sequence: Synthetic oligonucleotide
acgtcgaagagtacgacgtcg

SEQ ID NO: 17461 - DNA, 21 bp, Artificial Sequence
  Description of Artificial Sequence: Synthetic oligonucleotide
gacatgaccggcaccaacaaa

SEQ ID NO: 17462 - DNA, 21 bp, Artificial Sequence
  Description of Artificial Sequence: Synthetic oligonucleotide
agcaacaccagcggcgtcacc

SEQ ID NO: 17463 - DNA, 21 bp, Artificial Sequence
  Description of Artificial Sequence: Synthetic oligonucleotide
gaaatggacagcaaaggcacc

SEQ ID NO: 17464 - DNA, 21 bp, Artificial Sequence
  Description of Artificial Sequence: Synthetic oligonucleotide
ggcagcggcggcagcaaagaa

SEQ ID NO: 17465 - DNA, 21 bp, Artificial Sequence
  Description of Artificial Sequence: Synthetic oligonucleotide
gagattccggcggggaagtct

SEQ ID NO: 17466 - DNA, 21 bp, Artificial Sequence
  Description of Artificial Sequence: Synthetic oligonucleotide
gtcggcgacgccaaagccatg

SEQ ID NO: 17467 - DNA, 21 bp, Artificial Sequence
  Description of Artificial Sequence: Synthetic oligonucleotide
gaacaaagaaaaagcatggtc

SEQ ID NO: 17468 - DNA, 21 bp, Artificial Sequence
  Description of Artificial Sequence: Synthetic oligonucleotide
ggcagcggcaccgccggcaac

SEQ ID NO: 17469 - DNA, 21 bp, Artificial Sequence
  Description of Artificial Sequence: Synthetic oligonucleotide
agccaaaccagcgccaaccaa

SEQ ID NO: 17470 - DNA, 21 bp, Artificial Sequence
  Description of Artificial Sequence: Synthetic oligonucleotide
agtggtgggtctcaggggcag

SEQ ID NO: 17471 - DNA, 21 bp, Artificial Sequence
  Description of Artificial Sequence: Synthetic oligonucleotide
caaaacggcaaacaacccctc

SEQ ID NO: 17472 - DNA, 21 bp, Artificial Sequence
  Description of Artificial Sequence: Synthetic oligonucleotide
agcagagaccaaaacggccac

SEQ ID NO: 17473 - DNA, 21 bp, Artificial Sequence
  Description of Artificial Sequence: Synthetic oligonucleotide
agtgaggcgggtagtggtaaa

SEQ ID NO: 17474 - DNA, 21 bp, Artificial Sequence
  Description of Artificial Sequence: Synthetic oligonucleotide
ggcgacggcagcagcagagcc

SEQ ID NO: 17475 - DNA, 21 bp, Artificial Sequence
  Description of Artificial Sequence: Synthetic oligonucleotide
agcggcagcaaaagcatcgaa

SEQ ID NO: 17476 - DNA, 21 bp, Artificial Sequence
  Description of Artificial Sequence: Synthetic oligonucleotide
atgaccgaaagcgccagcaaa

SEQ ID NO: 17477 - DNA, 21 bp, Artificial Sequence
  Description of Artificial Sequence: Synthetic oligonucleotide
cagtctgggagtggtacggct

SEQ ID NO: 17478 - DNA, 21 bp, Artificial Sequence
  Description of Artificial Sequence: Synthetic oligonucleotide
gtcaacgacagcaaaaccacc

SEQ ID NO: 17479 - DNA, 21 bp, Artificial Sequence
  Description of Artificial Sequence: Synthetic oligonucleotide
gacggcaaagcccccctcctc

SEQ ID NO: 17480 - DNA, 21 bp, Artificial Sequence
  Description of Artificial Sequence: Synthetic oligonucleotide
cacgccaacagcgccaaagaa

SEQ ID NO: 17481 - DNA, 21 bp, Artificial Sequence
  Description of Artificial Sequence: Synthetic oligonucleotide
agcccccaaggcgaacacaaa

SEQ ID NO: 17482 - DNA, 21 bp, Artificial Sequence
  Description of Artificial Sequence: Synthetic oligonucleotide
tcgggtgagacgactaagagg

SEQ ID NO: 17483 - DNA, 21 bp, Artificial Sequence
  Description of Artificial Sequence: Synthetic oligonucleotide
ggtcaggattctattaagggg

SEQ ID NO: 17484 - DNA, 21 bp, Artificial Sequence
  Description of Artificial Sequence: Synthetic oligonucleotide
agcggccaaagcaaacccgac

SEQ ID NO: 17485 - DNA, 21 bp, Artificial Sequence
  Description of Artificial Sequence: Synthetic oligonucleotide
cttgtggagaagtcttctagt

SEQ ID NO: 17486 - DNA, 21 bp, Artificial Sequence
  Description of Artificial Sequence: Synthetic oligonucleotide
actccggcgagttctagtatt

SEQ ID NO: 17487 - DNA, 21 bp, Artificial Sequence
  Description of Artificial Sequence: Synthetic oligonucleotide
aacagcggccccagcggccaa

SEQ ID NO: 17488 - DNA, 21 bp, Artificial Sequence
  Description of Artificial Sequence: Synthetic oligonucleotide
agcagcacccccagcagcggc

SEQ ID NO: 17489 - DNA, 21 bp, Artificial Sequence
  Description of Artificial Sequence: Synthetic oligonucleotide
accgtcggcagcggcagcccc

SEQ ID NO: 17490 - DNA, 21 bp, Artificial Sequence
  Description of Artificial Sequence: Synthetic oligonucleotide
tctggtgtgagttcgacggcg

SEQ ID NO: 17491 - DNA, 21 bp, Artificial Sequence
  Description of Artificial Sequence: Synthetic oligonucleotide
gagagggttcagacttcggag

SEQ ID NO: 17492 - DNA, 21 bp, Artificial Sequence
  Description of Artificial Sequence: Synthetic oligonucleotide
gcggctggggctgagcggggg

SEQ ID NO: 17493 - DNA, 21 bp, Artificial Sequence
  Description of Artificial Sequence: Synthetic oligonucleotide
ggtcttgataagtcgctgacg

SEQ ID NO: 17494 - DNA, 21 bp, Artificial Sequence
  Description of Artificial Sequence: Synthetic oligonucleotide
catggtaataattcgccgagt

SEQ ID NO: 17495 - DNA, 21 bp, Artificial Sequence
  Description of Artificial Sequence: Synthetic oligonucleotide
aacggcaccagcaaacaagac

SEQ ID NO: 17496 - DNA, 21 bp, Artificial Sequence
  Description of Artificial Sequence: Synthetic oligonucleotide
gaaatcaacaaagccaaccaa

SEQ ID NO: 17497 - DNA, 21 bp, Artificial Sequence
  Description of Artificial Sequence: Synthetic oligonucleotide
gatggtacttcgcataagtct

SEQ ID NO: 17498 - DNA, 21 bp, Artificial Sequence
  Description of Artificial Sequence: Synthetic oligonucleotide
gccaccagccaaagcaacatg

SEQ ID NO: 17499 - DNA, 21 bp, Artificial Sequence
  Description of Artificial Sequence: Synthetic oligonucleotide
atgaacggcggcaccggcacc

SEQ ID NO: 17500 - DNA, 21 bp, Artificial Sequence
  Description of Artificial Sequence: Synthetic oligonucleotide
agacaaggcgaccaccccagc

SEQ ID NO: 17501 - DNA, 21 bp, Artificial Sequence
  Description of Artificial Sequence: Synthetic oligonucleotide
tcgtcgggtaaggagtctggt

SEQ ID NO: 17502 - DNA, 21 bp, Artificial Sequence
  Description of Artificial Sequence: Synthetic oligonucleotide
agccccagcaccaccggccaa

SEQ ID NO: 17503 - DNA, 21 bp, Artificial Sequence
  Description of Artificial Sequence: Synthetic oligonucleotide
ggcggcaacgaccacaaaacc

SEQ ID NO: 17504 - DNA, 21 bp, Artificial Sequence
  Description of Artificial Sequence: Synthetic oligonucleotide
ggtgatcctaagtcgactctg

SEQ ID NO: 17505 - DNA, 21 bp, Artificial Sequence
  Description of Artificial Sequence: Synthetic oligonucleotide
ggtgcttcggggaagatgatg

SEQ ID NO: 17506 - DNA, 21 bp, Artificial Sequence
  Description of Artificial Sequence: Synthetic oligonucleotide
ggggatgggagtcatactagg

SEQ ID NO: 17507 - DNA, 21 bp, Artificial Sequence
  Description of Artificial Sequence: Synthetic oligonucleotide
agcatgagcagcagccccacc

SEQ ID NO: 17508 - DNA, 21 bp, Artificial Sequence
  Description of Artificial Sequence: Synthetic oligonucleotide
cagcagacggctgatactaag

SEQ ID NO: 17509 - DNA, 21 bp, Artificial Sequence
  Description of Artificial Sequence: Synthetic oligonucleotide
aattctgctagtacgtcgggt

SEQ ID NO: 17510 - DNA, 21 bp, Artificial Sequence
  Description of Artificial Sequence: Synthetic oligonucleotide
agcaacaccaaccacaacagc

SEQ ID NO: 17511 - DNA, 21 bp, Artificial Sequence
  Description of Artificial Sequence: Synthetic oligonucleotide
aacgtcagcggccaaaaccaa

SEQ ID NO: 17512 - DNA, 21 bp, Artificial Sequence
  Description of Artificial Sequence: Synthetic oligonucleotide
accagcagcaacgtcccccaa

SEQ ID NO: 17513 - DNA, 21 bp, Artificial Sequence
  Description of Artificial Sequence: Synthetic oligonucleotide
tctggggctagttctagtcat

SEQ ID NO: 17514 - DNA, 21 bp, Artificial Sequence
  Description of Artificial Sequence: Synthetic oligonucleotide
gatgggtctcgtgttgctcat

SEQ ID NO: 17515 - DNA, 21 bp, Artificial Sequence
  Description of Artificial Sequence: Synthetic oligonucleotide
gatactcagagtaatcggacg

SEQ ID NO: 17516 - DNA, 21 bp, Artificial Sequence
  Description of Artificial Sequence: Synthetic oligonucleotide
atgaccagcaaaaccgtcggc

SEQ ID NO: 17517 - DNA, 21 bp, Artificial Sequence
  Description of Artificial Sequence: Synthetic oligonucleotide
gaaggcaaccaaaccggcagc

SEQ ID NO: 17518 - DNA, 21 bp, Artificial Sequence
  Description of Artificial Sequence: Synthetic oligonucleotide
ggcagcaacggcgccagcacc

SEQ ID NO: 17519 - DNA, 21 bp, Artificial Sequence
  Description of Artificial Sequence: Synthetic oligonucleotide
tttccgtctagtacgcctaag

SEQ ID NO: 17520 - DNA, 21 bp, Artificial Sequence
  Description of Artificial Sequence: Synthetic oligonucleotide
agcctcaccgaagtcaacaaa

SEQ ID NO: 17521 - DNA, 21 bp, Artificial Sequence
  Description of Artificial Sequence: Synthetic oligonucleotide
ggcaccgccagccccagcagc

SEQ ID NO: 17522 - DNA, 21 bp, Artificial Sequence
  Description of Artificial Sequence: Synthetic oligonucleotide
ggccaaagcgacgccatcaaa

SEQ ID NO: 17523 - DNA, 21 bp, Artificial Sequence
  Description of Artificial Sequence: Synthetic oligonucleotide
gacaaccacgaaaaaaccagc

SEQ ID NO: 17524 - DNA, 21 bp, Artificial Sequence
  Description of Artificial Sequence: Synthetic oligonucleotide
ggtaagacggatggtactcat

SEQ ID NO: 17525 - DNA, 21 bp, Artificial Sequence
  Description of Artificial Sequence: Synthetic oligonucleotide
ggttctgaggttgcgcctaag

SEQ ID NO: 17526 - DNA, 21 bp, Artificial Sequence
  Description of Artificial Sequence: Synthetic oligonucleotide
ggcaacaccggcgccagcagc

SEQ ID NO: 17527 - DNA, 21 bp, Artificial Sequence
  Description of Artificial Sequence: Synthetic oligonucleotide
agcagcggcggcaccagaaac

SEQ ID NO: 17528 - DNA, 21 bp, Artificial Sequence
  Description of Artificial Sequence: Synthetic oligonucleotide
gattctaatgttacgcataag

SEQ ID NO: 17529 - DNA, 21 bp, Artificial Sequence
  Description of Artificial Sequence: Synthetic oligonucleotide
ggttatgaggggaatggtaag

SEQ ID NO: 17530 - DNA, 21 bp, Artificial Sequence
  Description of Artificial Sequence: Synthetic oligonucleotide
gggacgggtgctgctggtact

SEQ ID NO: 17531 - DNA, 21 bp, Artificial Sequence
  Description of Artificial Sequence: Synthetic oligonucleotide
aatagttcgtctcctacgacg

SEQ ID NO: 17532 - DNA, 21 bp, Artificial Sequence
  Description of Artificial Sequence: Synthetic oligonucleotide
acgggttctccgtctggtcag

SEQ ID NO: 17533 - DNA, 21 bp, Artificial Sequence
  Description of Artificial Sequence: Synthetic oligonucleotide
gctggtacttctactagtaat

SEQ ID NO: 17534 - DNA, 21 bp, Artificial Sequence
  Description of Artificial Sequence: Synthetic oligonucleotide
caggctacgtcggcggcggcg

SEQ ID NO: 17535 - DNA, 21 bp, Artificial Sequence
  Description of Artificial Sequence: Synthetic oligonucleotide
acgtcggcggcgcgtgctgag

SEQ ID NO: 17536 - DNA, 21 bp, Artificial Sequence
  Description of Artificial Sequence: Synthetic oligonucleotide
gcggggtctccttcgactcag

SEQ ID NO: 17537 - DNA, 21 bp, Artificial Sequence
  Description of Artificial Sequence: Synthetic oligonucleotide
gtccccgaccacagcgtcaaa

SEQ ID NO: 17538 - DNA, 21 bp, Artificial Sequence
  Description of Artificial Sequence: Synthetic oligonucleotide
tcgagtgggacggtgcctggt

SEQ ID NO: 17539 - DNA, 21 bp, Artificial Sequence
  Description of Artificial Sequence: Synthetic oligonucleotide
aatcttgggacgagtagtggt

SEQ ID NO: 17540 - DNA, 21 bp, Artificial Sequence
  Description of Artificial Sequence: Synthetic oligonucleotide
actcataatactagtaatgcg

SEQ ID NO: 17541 - DNA, 21 bp, Artificial Sequence
  Description of Artificial Sequence: Synthetic oligonucleotide
acgaattcgggtacggggaag

SEQ ID NO: 17542 - DNA, 21 bp, Artificial Sequence
  Description of Artificial Sequence: Synthetic oligonucleotide
aatactcataagacggcgtct

SEQ ID NO: 17543 - DNA, 21 bp, Artificial Sequence
  Description of Artificial Sequence: Synthetic oligonucleotide
aaccccggcgccagccccggc

SEQ ID NO: 17544 - DNA, 21 bp, Artificial Sequence
  Description of Artificial Sequence: Synthetic oligonucleotide
acgggtggatctccgaagaat

SEQ ID NO: 17545 - DNA, 21 bp, Artificial Sequence
  Description of Artificial Sequence: Synthetic oligonucleotide
cacagcggcaaagacagcagc

SEQ ID NO: 17546 - DNA, 21 bp, Artificial Sequence
  Description of Artificial Sequence: Synthetic oligonucleotide
cagggggctgcgacggttgcg

SEQ ID NO: 17547 - DNA, 21 bp, Artificial Sequence
  Description of Artificial Sequence: Synthetic oligonucleotide
cttgtgggtgagaaggctgtt

SEQ ID NO: 17548 - DNA, 21 bp, Artificial Sequence
  Description of Artificial Sequence: Synthetic oligonucleotide
gacaaaagcagcggcaccggc

SEQ ID NO: 17549 - DNA, 21 bp, Artificial Sequence
  Description of Artificial Sequence: Synthetic oligonucleotide
gccgtcggcagcgccaccggc

SEQ ID NO: 17550 - DNA, 21 bp, Artificial Sequence
  Description of Artificial Sequence: Synthetic oligonucleotide
ggtggggtgcctcctactggg

SEQ ID NO: 17551 - DNA, 21 bp, Artificial Sequence
  Description of Artificial Sequence: Synthetic oligonucleotide
agacaagacaaagtcgccgcc

SEQ ID NO: 17552 - DNA, 21 bp, Artificial Sequence
  Description of Artificial Sequence: Synthetic oligonucleotide
gggactcaggagagtagtagg

SEQ ID NO: 17553 - DNA, 21 bp, Artificial Sequence
  Description of Artificial Sequence: Synthetic oligonucleotide
ggcaccaacaaaagcgtcgtc

SEQ ID NO: 17554 - DNA, 21 bp, Artificial Sequence
  Description of Artificial Sequence: Synthetic oligonucleotide
agtgctcagactagttctctg

SEQ ID NO: 17555 - DNA, 21 bp, Artificial Sequence
  Description of Artificial Sequence: Synthetic oligonucleotide
ggtcatgaggggcctaagggg

SEQ ID NO: 17556 - DNA, 21 bp, Artificial Sequence
  Description of Artificial Sequence: Synthetic oligonucleotide
actgggagttcgacgactgct

SEQ ID NO: 17557 - DNA, 21 bp, Artificial Sequence
  Description of Artificial Sequence: Synthetic oligonucleotide
catgaggatgcgaaggctggg

SEQ ID NO: 17558 - DNA, 21 bp, Artificial Sequence
  Description of Artificial Sequence: Synthetic oligonucleotide
ggcggccccgccaccgccacc

SEQ ID NO: 17559 - DNA, 21 bp, Artificial Sequence
  Description of Artificial Sequence: Synthetic oligonucleotide
gacagaaccaacgaagcccac

SEQ ID NO: 17560 - DNA, 21 bp, Artificial Sequence
  Description of Artificial Sequence: Synthetic oligonucleotide
ggtggggggaatcattcggtg

SEQ ID NO: 17561 - DNA, 21 bp, Artificial Sequence
  Description of Artificial Sequence: Synthetic oligonucleotide
gtcaccaacagcaccaccaaa

SEQ ID NO: 17562 - DNA, 21 bp, Artificial Sequence
  Description of Artificial Sequence: Synthetic oligonucleotide
caaagcgcccaaggcgccgcc

SEQ ID NO: 17563 - DNA, 21 bp, Artificial Sequence
  Description of Artificial Sequence: Synthetic oligonucleotide
gacggcagaggcgccaccagc

SEQ ID NO: 17564 - DNA, 21 bp, Artificial Sequence
  Description of Artificial Sequence: Synthetic oligonucleotide
aacggcgccagaagcagcgaa

SEQ ID NO: 17565 - DNA, 21 bp, Artificial Sequence
  Description of Artificial Sequence: Synthetic oligonucleotide
agcgaaagccaaggccacaaa

SEQ ID NO: 17566 - DNA, 21 bp, Artificial Sequence
  Description of Artificial Sequence: Synthetic oligonucleotide
attgcgtcgcagaaggctgag

SEQ ID NO: 17567 - DNA, 21 bp, Artificial Sequence
  Description of Artificial Sequence: Synthetic oligonucleotide
caaaacagccccggcaacgtc

SEQ ID NO: 17568 - DNA, 21 bp, Artificial Sequence
  Description of Artificial Sequence: Synthetic oligonucleotide
atggccgccggcaacgaaaaa

SEQ ID NO: 17569 - DNA, 21 bp, Artificial Sequence
  Description of Artificial Sequence: Synthetic oligonucleotide
gataggggtgagcatagtcgg

SEQ ID NO: 17570 - DNA, 21 bp, Artificial Sequence
  Description of Artificial Sequence: Synthetic oligonucleotide
cacaccaccagccaaaacagc

SEQ ID NO: 17571 - DNA, 21 bp, Artificial Sequence
  Description of Artificial Sequence: Synthetic oligonucleotide
attggttcggggtcgtctacg

SEQ ID NO: 17572 - DNA, 21 bp, Artificial Sequence
  Description of Artificial Sequence: Synthetic oligonucleotide
gatgcgactggtcagagggtg

SEQ ID NO: 17573 - DNA, 21 bp, Artificial Sequence
  Description of Artificial Sequence: Synthetic oligonucleotide
aatcggaatggggcttctggg

SEQ ID NO: 17574 - DNA, 21 bp, Artificial Sequence
  Description of Artificial Sequence: Synthetic oligonucleotide
agcaacggcagcgccagcagc

SEQ ID NO: 17575 - DNA, 21 bp, Artificial Sequence
  Description of Artificial Sequence: Synthetic oligonucleotide
gagcttactaaggctaatacg

SEQ ID NO: 17576 - DNA, 21 bp, Artificial Sequence
  Description of Artificial Sequence: Synthetic oligonucleotide
atgcccaacggcaaccaacaa

SEQ ID NO: 17577 - DNA, 21 bp, Artificial Sequence
  Description of Artificial Sequence: Synthetic oligonucleotide
ggtggggagtctcgttcgtcg

SEQ ID NO: 17578 - DNA, 21 bp, Artificial Sequence
  Description of Artificial Sequence: Synthetic oligonucleotide
gccagcgccagcaaagtcagc

SEQ ID NO: 17579 - DNA, 21 bp, Artificial Sequence
  Description of Artificial Sequence: Synthetic oligonucleotide
agttctactccgagtagtgct

SEQ ID NO: 17580 - DNA, 21 bp, Artificial Sequence
  Description of Artificial Sequence: Synthetic oligonucleotide
tctagtgtgagtggtagtaat

SEQ ID NO: 17581 - DNA, 21 bp, Artificial Sequence
  Description of Artificial Sequence: Synthetic oligonucleotide
agcacccaaagcgacagaagc

SEQ ID NO: 17582 - DNA, 21 bp, Artificial Sequence
  Description of Artificial Sequence: Synthetic oligonucleotide
gtcagcaacggcagcggcgcc

SEQ ID NO: 17583 - DNA, 21 bp, Artificial Sequence
  Description of Artificial Sequence: Synthetic oligonucleotide
tctaataatagtggtcctact

SEQ ID NO: 17584 - DNA, 21 bp, Artificial Sequence
  Description of Artificial Sequence: Synthetic oligonucleotide
ttgactccgggtactgctgcg

SEQ ID NO: 17585 - DNA, 21 bp, Artificial Sequence
  Description of Artificial Sequence: Synthetic oligonucleotide
agtaatgcttcgcctcatgcg

SEQ ID NO: 17586 - DNA, 21 bp, Artificial Sequence
  Description of Artificial Sequence: Synthetic oligonucleotide
actaatgcgagttctactgcg

SEQ ID NO: 17587 - DNA, 21 bp, Artificial Sequence
  Description of Artificial Sequence: Synthetic oligonucleotide
gctggtcataaggagactact

SEQ ID NO: 17588 - DNA, 21 bp, Artificial Sequence
  Description of Artificial Sequence: Synthetic oligonucleotide
ggcagcgaagccaccgccaaa

SEQ ID NO: 17589 - DNA, 21 bp, Artificial Sequence
  Description of Artificial Sequence: Synthetic oligonucleotide
ggcgccaccagcccccaccaa

SEQ ID NO: 17590 - DNA, 21 bp, Artificial Sequence
  Description of Artificial Sequence: Synthetic oligonucleotide
aattcgggttctcctggttcg

SEQ ID NO: 17591 - DNA, 21 bp, Artificial Sequence
  Description of Artificial Sequence: Synthetic oligonucleotide
agcgtcggcaacagcagcagc

SEQ ID NO: 17592 - DNA, 21 bp, Artificial Sequence
  Description of Artificial Sequence: Synthetic oligonucleotide
agtcgggtgaagaatgagagt

SEQ ID NO: 17593 - DNA, 21 bp, Artificial Sequence
  Description of Artificial Sequence: Synthetic oligonucleotide
actagtgcggggtcgaaggat

SEQ ID NO: 17594 - DNA, 21 bp, Artificial Sequence
  Description of Artificial Sequence: Synthetic oligonucleotide
agcagagaaaaaaccgaacac

SEQ ID NO: 17595 - DNA, 21 bp, Artificial Sequence
  Description of Artificial Sequence: Synthetic oligonucleotide
agcaacggcaccagcagcggc

SEQ ID NO: 17596 - DNA, 21 bp, Artificial Sequence
  Description of Artificial Sequence: Synthetic oligonucleotide
aacggcggcaaaggcagcagc

SEQ ID NO: 17597 - DNA, 21 bp, Artificial Sequence
  Description of Artificial Sequence: Synthetic oligonucleotide
aagactgcgcaggtgtcggcg

SEQ ID NO: 17598 - DNA, 21 bp, Artificial Sequence
  Description of Artificial Sequence: Synthetic oligonucleotide
caaagcaaaagccccagccac

SEQ ID NO: 17599 - DNA, 21 bp, Artificial Sequence
  Description of Artificial Sequence: Synthetic oligonucleotide
cataatggggagcagagtcgt

SEQ ID NO: 17600 - DNA, 21 bp, Artificial Sequence
  Description of Artificial Sequence: Synthetic oligonucleotide
gagagtacgactccgggtcgt

SEQ ID NO: 17601 - DNA, 21 bp, Artificial Sequence
  Description of Artificial Sequence: Synthetic oligonucleotide
agcagcgaaagcaaaagcgtc

SEQ ID NO: 17602 - DNA, 21 bp, Artificial Sequence
  Description of Artificial Sequence: Synthetic oligonucleotide
cagactgggtcttcgaatggt

SEQ ID NO: 17603 - DNA, 21 bp, Artificial Sequence
  Description of Artificial Sequence: Synthetic oligonucleotide
gaaagcgccagccacagcaga

SEQ ID NO: 17604 - DNA, 21 bp, Artificial Sequence
  Description of Artificial Sequence: Synthetic oligonucleotide
gaggctcattctgcgaataag

SEQ ID NO: 17605 - DNA, 21 bp, Artificial Sequence
  Description of Artificial Sequence: Synthetic oligonucleotide
ggcgacaaaaccagcctcaaa

SEQ ID NO: 17606 - DNA, 21 bp, Artificial Sequence
  Description of Artificial Sequence: Synthetic oligonucleotide
gccggcgtcagcaaacccagc

SEQ ID NO: 17607 - DNA, 21 bp, Artificial Sequence
  Description of Artificial Sequence: Synthetic oligonucleotide
acccacggcgccagcagcagc

SEQ ID NO: 17608 - DNA, 21 bp, Artificial Sequence
  Description of Artificial Sequence: Synthetic oligonucleotide
agcaccggcagcggcagcagc

SEQ ID NO: 17609 - DNA, 21 bp, Artificial Sequence
  Description of Artificial Sequence: Synthetic oligonucleotide
cggaagggggctagtacggag

SEQ ID NO: 17610 - DNA, 21 bp, Artificial Sequence
  Description of Artificial Sequence: Synthetic oligonucleotide
tcgttgacggataagtcttct

SEQ ID NO: 17611 - DNA, 21 bp, Artificial Sequence
  Description of Artificial Sequence: Synthetic oligonucleotide
ctcgccaccaaagacaacagc

SEQ ID NO: 17612 - DNA, 21 bp, Artificial Sequence
  Description of Artificial Sequence: Synthetic oligonucleotide
aagaatggtagtacgcctgag

SEQ ID NO: 17613 - DNA, 21 bp, Artificial Sequence
  Description of Artificial Sequence: Synthetic oligonucleotide
tctacggctacttctgcggcg

SEQ ID NO: 17614 - DNA, 21 bp, Artificial Sequence
  Description of Artificial Sequence: Synthetic oligonucleotide
accaccaccaccaaaagcagc

SEQ ID NO: 17615 - DNA, 21 bp, Artificial Sequence
  Description of Artificial Sequence: Synthetic oligonucleotide
acccaaggcaaccccagccaa

SEQ ID NO: 17616 - DNA, 21 bp, Artificial Sequence
  Description of Artificial Sequence: Synthetic oligonucleotide
gttagtgggtctggtggtaag

SEQ ID NO: 17617 - DNA, 21 bp, Artificial Sequence
  Description of Artificial Sequence: Synthetic oligonucleotide
atgcccaaaaacacccccagc

SEQ ID NO: 17618 - DNA, 21 bp, Artificial Sequence
  Description of Artificial Sequence: Synthetic oligonucleotide
tctcagaagtctccgccgatt

SEQ ID NO: 17619 - DNA, 21 bp, Artificial Sequence
  Description of Artificial Sequence: Synthetic oligonucleotide
gacagcatcagagaaagcaaa

SEQ ID NO: 17620 - DNA, 21 bp, Artificial Sequence
  Description of Artificial Sequence: Synthetic oligonucleotide
gccggcgaccaaagcaaactc

SEQ ID NO: 17621 - DNA, 21 bp, Artificial Sequence
  Description of Artificial Sequence: Synthetic oligonucleotide
gaacacaacggcggcaacaaa

SEQ ID NO: 17622 - DNA, 21 bp, Artificial Sequence
  Description of Artificial Sequence: Synthetic oligonucleotide
tcgactatgacgacttcgagt

SEQ ID NO: 17623 - DNA, 21 bp, Artificial Sequence
  Description of Artificial Sequence: Synthetic oligonucleotide
tctaatgcgtctaagaatgag

SEQ ID NO: 17624 - DNA, 21 bp, Artificial Sequence
  Description of Artificial Sequence: Synthetic oligonucleotide
ggcaacggcagcggccccagc

SEQ ID NO: 17625 - DNA, 21 bp, Artificial Sequence
  Description of Artificial Sequence: Synthetic oligonucleotide
actactcatacgactagtggt

SEQ ID NO: 17626 - DNA, 21 bp, Artificial Sequence
  Description of Artificial Sequence: Synthetic oligonucleotide
tctcaggagcctagtcgtggg

SEQ ID NO: 17627 - DNA, 21 bp, Artificial Sequence
  Description of Artificial Sequence: Synthetic oligonucleotide
agcaaacaacaaagcagcgaa

SEQ ID NO: 17628 - DNA, 21 bp, Artificial Sequence
  Description of Artificial Sequence: Synthetic oligonucleotide
gacagcagcggcaaagccaac

SEQ ID NO: 17629 - DNA, 21 bp, Artificial Sequence
  Description of Artificial Sequence: Synthetic oligonucleotide
ggcgccaacaacagcagcacc

SEQ ID NO: 17630 - DNA, 21 bp, Artificial Sequence
  Description of Artificial Sequence: Synthetic oligonucleotide
atggatgggtcgagtcctcat

SEQ ID NO: 17631 - DNA, 21 bp, Artificial Sequence
  Description of Artificial Sequence: Synthetic oligonucleotide
gaccccagcagcagaccccaa

SEQ ID NO: 17632 - DNA, 21 bp, Artificial Sequence
  Description of Artificial Sequence: Synthetic oligonucleotide
gctggggagactggtattaag

SEQ ID NO: 17633 - DNA, 21 bp, Artificial Sequence
  Description of Artificial Sequence: Synthetic oligonucleotide
ggcaacagccaaacccaaggc

SEQ ID NO: 17634 - DNA, 21 bp, Artificial Sequence
  Description of Artificial Sequence: Synthetic oligonucleotide
acggggcagactagtacgtcg

SEQ ID NO: 17635 - DNA, 21 bp, Artificial Sequence
  Description of Artificial Sequence: Synthetic oligonucleotide
gtcgccagcaaaagcaccgtc

SEQ ID NO: 17636 - DNA, 21 bp, Artificial Sequence
  Description of Artificial Sequence: Synthetic oligonucleotide
gagggtgcgaatcatgcgtcg

SEQ ID NO: 17637 - DNA, 21 bp, Artificial Sequence
  Description of Artificial Sequence: Synthetic oligonucleotide
ctgaatacgccttctgctgcg

SEQ ID NO: 17638 - DNA, 21 bp, Artificial Sequence
  Description of Artificial Sequence: Synthetic oligonucleotide
caagccagcgacaaaacctac

SEQ ID NO: 17639 - DNA, 21 bp, Artificial Sequence
  Description of Artificial Sequence: Synthetic oligonucleotide
agtcaggggggttcgacttcg

SEQ ID NO: 17640 - DNA, 21 bp, Artificial Sequence
  Description of Artificial Sequence: Synthetic oligonucleotide
cttgatgggaagaattctatg

SEQ ID NO: 17641 - DNA, 21 bp, Artificial Sequence
  Description of Artificial Sequence: Synthetic oligonucleotide
atgaatacgccgaatcctcat

SEQ ID NO: 17642 - DNA, 21 bp, Artificial Sequence
  Description of Artificial Sequence: Synthetic oligonucleotide
gacgtccccagcaaaagcgcc

SEQ ID NO: 17643 - DNA, 21 bp, Artificial Sequence
  Description of Artificial Sequence: Synthetic oligonucleotide
ggcatcagcaacggcaacagc

SEQ ID NO: 17644 - DNA, 21 bp, Artificial Sequence
  Description of Artificial Sequence: Synthetic oligonucleotide
gccctcagcagcagcaacaaa

SEQ ID NO: 17645 - DNA, 21 bp, Artificial Sequence
  Description of Artificial Sequence: Synthetic oligonucleotide
gtcagcagcaaagaagccacc

SEQ ID NO: 17646 - DNA, 21 bp, Artificial Sequence
  Description of Artificial Sequence: Synthetic oligonucleotide
tctgggggggcgccgagtacg

SEQ ID NO: 17647 - DNA, 21 bp, Artificial Sequence
  Description of Artificial Sequence: Synthetic oligonucleotide
aatgatacgtcggggacccgt

SEQ ID NO: 17648 - DNA, 21 bp, Artificial Sequence
  Description of Artificial Sequence: Synthetic oligonucleotide
accggcagcgaaagcgtcaga

SEQ ID NO: 17649 - DNA, 21 bp, Artificial Sequence
  Description of Artificial Sequence: Synthetic oligonucleotide
ggcgacggcaaaagcaccatc

SEQ ID NO: 17650 - DNA, 21 bp, Artificial Sequence
  Description of Artificial Sequence: Synthetic oligonucleotide
ctcagcggcgaccccagaggc

SEQ ID NO: 17651 - DNA, 21 bp, Artificial Sequence
  Description of Artificial Sequence: Synthetic oligonucleotide
ggttcggtgccgggtaatact

SEQ ID NO: 17652 - DNA, 21 bp, Artificial Sequence
  Description of Artificial Sequence: Synthetic oligonucleotide
acgactacgagtactacggcg

SEQ ID NO: 17653 - DNA, 21 bp, Artificial Sequence
  Description of Artificial Sequence: Synthetic oligonucleotide
caaaacgccaccgccgtcagc

SEQ ID NO: 17654 - DNA, 21 bp, Artificial Sequence
  Description of Artificial Sequence: Synthetic oligonucleotide
caagtccccgaaggccaaaaa

SEQ ID NO: 17655 - DNA, 21 bp, Artificial Sequence
  Description of Artificial Sequence: Synthetic oligonucleotide
agcaccagcaaaaccgaaagc

SEQ ID NO: 17656 - DNA, 21 bp, Artificial Sequence
  Description of Artificial Sequence: Synthetic oligonucleotide
gaaagcggcagccacagcgcc

SEQ ID NO: 17657 - DNA, 21 bp, Artificial Sequence
  Description of Artificial Sequence: Synthetic oligonucleotide
ggcagcaccgccgccccccac

SEQ ID NO: 17658 - DNA, 21 bp, Artificial Sequence
  Description of Artificial Sequence: Synthetic oligonucleotide
aatggtgcgccgactgcgtcg

SEQ ID NO: 17659 - DNA, 21 bp, Artificial Sequence
  Description of Artificial Sequence: Synthetic oligonucleotide
accggcagcagccccagcacc

SEQ ID NO: 17660 - DNA, 21 bp, Artificial Sequence
  Description of Artificial Sequence: Synthetic oligonucleotide
gtgactggtaatgagtcgaag

SEQ ID NO: 17661 - DNA, 21 bp, Artificial Sequence
  Description of Artificial Sequence: Synthetic oligonucleotide
tctggtgcgactacttcgggt

SEQ ID NO: 17662 - DNA, 21 bp, Artificial Sequence
  Description of Artificial Sequence: Synthetic oligonucleotide
gcgggtgctaatagtacgctt

SEQ ID NO: 17663 - DNA, 21 bp, Artificial Sequence
  Description of Artificial Sequence: Synthetic oligonucleotide
cagcaggatggttcgcatcat

SEQ ID NO: 17664 - DNA, 21 bp, Artificial Sequence
  Description of Artificial Sequence: Synthetic oligonucleotide
ggcgccagcaccagcccccac

SEQ ID NO: 17665 - DNA, 21 bp, Artificial Sequence
  Description of Artificial Sequence: Synthetic oligonucleotide
aacagaggcagcggcaccagc

SEQ ID NO: 17666 - DNA, 21 bp, Artificial Sequence
  Description of Artificial Sequence: Synthetic oligonucleotide
aatagtaattcttcggcgggt

SEQ ID NO: 17667 - DNA, 21 bp, Artificial Sequence
  Description of Artificial Sequence: Synthetic oligonucleotide
cagtcggggggtactagtcat

SEQ ID NO: 17668 - DNA, 21 bp, Artificial Sequence
  Description of Artificial Sequence: Synthetic oligonucleotide
gtgtctgggaaggagactagt

SEQ ID NO: 17669 - DNA, 21 bp, Artificial Sequence
  Description of Artificial Sequence: Synthetic oligonucleotide
gggacgaataaggatttgcgt

SEQ ID NO: 17670 - DNA, 21 bp, Artificial Sequence
  Description of Artificial Sequence: Synthetic oligonucleotide
caactcagcggcggcaccaaa

SEQ ID NO: 17671 - DNA, 21 bp, Artificial Sequence
  Description of Artificial Sequence: Synthetic oligonucleotide
gatgctactttgaagggtaat

SEQ ID NO: 17672 - DNA, 21 bp, Artificial Sequence
  Description of Artificial Sequence: Synthetic oligonucleotide
gccggcaaccaagtcgccagc

SEQ ID NO: 17673 - DNA, 21 bp, Artificial Sequence
  Description of Artificial Sequence: Synthetic oligonucleotide
gctagtaatgagaagggtggg

SEQ ID NO: 17674 - DNA, 21 bp, Artificial Sequence
  Description of Artificial Sequence: Synthetic oligonucleotide
acttctagtagtgcggcgacg

SEQ ID NO: 17675 - DNA, 21 bp, Artificial Sequence
  Description of Artificial Sequence: Synthetic oligonucleotide
actagggatactggttcggtg

SEQ ID NO: 17676 - DNA, 21 bp, Artificial Sequence
  Description of Artificial Sequence: Synthetic oligonucleotide
aaactcagcaaacccagcgac

SEQ ID NO: 17677 - DNA, 21 bp, Artificial Sequence
  Description of Artificial Sequence: Synthetic oligonucleotide
atgggcgaaagcaaaatcatg

SEQ ID NO: 17678 - DNA, 21 bp, Artificial Sequence
  Description of Artificial Sequence: Synthetic oligonucleotide
ggtgatgctaagaatttggcg

SEQ ID NO: 17679 - DNA, 21 bp, Artificial Sequence
  Description of Artificial Sequence: Synthetic oligonucleotide
tcgcagggtagtagtacggag

SEQ ID NO: 17680 - DNA, 21 bp, Artificial Sequence
  Description of Artificial Sequence: Synthetic oligonucleotide
aacaccggcagcagcggccaa

SEQ ID NO: 17681 - DNA, 21 bp, Artificial Sequence
  Description of Artificial Sequence: Synthetic oligonucleotide
gaaagaggcgccagcagcatc

SEQ ID NO: 17682 - DNA, 21 bp, Artificial Sequence
  Description of Artificial Sequence: Synthetic oligonucleotide
gccaccaccgccagcaaaggc

SEQ ID NO: 17683 - DNA, 21 bp, Artificial Sequence
  Description of Artificial Sequence: Synthetic oligonucleotide
gctgcggatgcgaaggggtct

SEQ ID NO: 17684 - DNA, 21 bp, Artificial Sequence
  Description of Artificial Sequence: Synthetic oligonucleotide
ggccaaggcagcgaaagcaga

SEQ ID NO: 17685 - DNA, 21 bp, Artificial Sequence
  Description of Artificial Sequence: Synthetic oligonucleotide
aacgccagcaaccacaaagaa

SEQ ID NO: 17686 - DNA, 21 bp, Artificial Sequence
  Description of Artificial Sequence: Synthetic oligonucleotide
ggtaatgcggataataggcat

SEQ ID NO: 17687 - DNA, 21 bp, Artificial Sequence
  Description of Artificial Sequence: Synthetic oligonucleotide
agttctaatagtcctaatatg

SEQ ID NO: 17688 - DNA, 21 bp, Artificial Sequence
  Description of Artificial Sequence: Synthetic oligonucleotide
agcggcagccaacccgtcggc

SEQ ID NO: 17689 - DNA, 21 bp, Artificial Sequence
  Description of Artificial Sequence: Synthetic oligonucleotide
agtaatagtgagaggtctgct

SEQ ID NO: 17690 - DNA, 21 bp, Artificial Sequence
  Description of Artificial Sequence: Synthetic oligonucleotide
agtgttgatcaggtgaatagg

SEQ ID NO: 17691 - DNA, 21 bp, Artificial Sequence
  Description of Artificial Sequence: Synthetic oligonucleotide
ggccccgccaaaagcagcatc

SEQ ID NO: 17692 - DNA, 21 bp, Artificial Sequence
  Description of Artificial Sequence: Synthetic oligonucleotide
ggggttggtagtagtaatctt

SEQ ID NO: 17693 - DNA, 21 bp, Artificial Sequence
  Description of Artificial Sequence: Synthetic oligonucleotide
aataataataagtcttcgact

SEQ ID NO: 17694 - DNA, 21 bp, Artificial Sequence
  Description of Artificial Sequence: Synthetic oligonucleotide
gcgggtaatagtccttctctt

SEQ ID NO: 17695 - DNA, 21 bp, Artificial Sequence
  Description of Artificial Sequence: Synthetic oligonucleotide
ggcagagacgccgtcatcggc

SEQ ID NO: 17696 - DNA, 21 bp, Artificial Sequence
  Description of Artificial Sequence: Synthetic oligonucleotide
actagtagtacgtctacgcag

SEQ ID NO: 17697 - DNA, 21 bp, Artificial Sequence
  Description of Artificial Sequence: Synthetic oligonucleotide
gaagtcgccaaaaccagccaa

SEQ ID NO: 17698 - DNA, 21 bp, Artificial Sequence
  Description of Artificial Sequence: Synthetic oligonucleotide
accgaccaaagccaagtcaaa

SEQ ID NO: 17699 - DNA, 21 bp, Artificial Sequence
  Description of Artificial Sequence: Synthetic oligonucleotide
acgcaggctacggcgactgtt

SEQ ID NO: 17700 - DNA, 21 bp, Artificial Sequence
  Description of Artificial Sequence: Synthetic oligonucleotide
gacggcagcggccaaaaccaa

SEQ ID NO: 17701 - DNA, 21 bp, Artificial Sequence
  Description of Artificial Sequence: Synthetic oligonucleotide
gccggcgtcggcagcaccccc

SEQ ID NO: 17702 - DNA, 21 bp, Artificial Sequence
  Description of Artificial Sequence: Synthetic oligonucleotide
aatagtagtaagccgtctgag

SEQ ID NO: 17703 - DNA, 21 bp, Artificial Sequence
  Description of Artificial Sequence: Synthetic oligonucleotide
agcggcggcgccagcggcagc

SEQ ID NO: 17704 - DNA, 21 bp, Artificial Sequence
  Description of Artificial Sequence: Synthetic oligonucleotide
catagtaatcagtcgagtagt

SEQ ID NO: 17705 - DNA, 21 bp, Artificial Sequence
  Description of Artificial Sequence: Synthetic oligonucleotide
gtgactcctagtaatccgccg

SEQ ID NO: 17706 - DNA, 21 bp, Artificial Sequence
  Description of Artificial Sequence: Synthetic oligonucleotide
accggcgccagcgtcaacgaa

SEQ ID NO: 17707 - DNA, 21 bp, Artificial Sequence
  Description of Artificial Sequence: Synthetic oligonucleotide
gcccaaggccccaccagcggc

SEQ ID NO: 17708 - DNA, 21 bp, Artificial Sequence
  Description of Artificial Sequence: Synthetic oligonucleotide
gctggtccgactaataatcag

SEQ ID NO: 17709 - DNA, 21 bp, Artificial Sequence
  Description of Artificial Sequence: Synthetic oligonucleotide
aacagcggcgccgacctcaaa

SEQ ID NO: 17710 - DNA, 21 bp, Artificial Sequence
  Description of Artificial Sequence: Synthetic oligonucleotide
gattctgctgggaagccttcg

SEQ ID NO: 17711 - DNA, 21 bp, Artificial Sequence
  Description of Artificial Sequence: Synthetic oligonucleotide
agcaacggcagcagcatcgcc

SEQ ID NO: 17712 - DNA, 21 bp, Artificial Sequence
  Description of Artificial Sequence: Synthetic oligonucleotide
agaaccaacagcgaacccaaa

SEQ ID NO: 17713 - DNA, 21 bp, Artificial Sequence
  Description of Artificial Sequence: Synthetic oligonucleotide
caaaccgacaaacccaacagc

SEQ ID NO: 17714 - DNA, 21 bp, Artificial Sequence
  Description of Artificial Sequence: Synthetic oligonucleotide
gagggtcagccggctattcgg

SEQ ID NO: 17715 - DNA, 21 bp, Artificial Sequence
  Description of Artificial Sequence: Synthetic oligonucleotide
ggtactgtgaatgggaagggg

SEQ ID NO: 17716 - DNA, 21 bp, Artificial Sequence
  Description of Artificial Sequence: Synthetic oligonucleotide
gccggcaccgacaaaagaacc

SEQ ID NO: 17717 - DNA, 21 bp, Artificial Sequence
  Description of Artificial Sequence: Synthetic oligonucleotide
acgtcgcctgggaagccgctt

SEQ ID NO: 17718 - DNA, 21 bp, Artificial Sequence
  Description of Artificial Sequence: Synthetic oligonucleotide
catgctggtaagtctaatact

SEQ ID NO: 17719 - DNA, 21 bp, Artificial Sequence
  Description of Artificial Sequence: Synthetic oligonucleotide
aatgctaatcctcctaatact

SEQ ID NO: 17720 - DNA, 21 bp, Artificial Sequence
  Description of Artificial Sequence: Synthetic oligonucleotide
agtgatgtttctggggctaag

SEQ ID NO: 17721 - DNA, 21 bp, Artificial Sequence
  Description of Artificial Sequence: Synthetic oligonucleotide
tctgggactaatgtgactgct

SEQ ID NO: 17722 - DNA, 21 bp, Artificial Sequence
  Description of Artificial Sequence: Synthetic oligonucleotide
agcaacggcagccccaccgcc

SEQ ID NO: 17723 - DNA, 21 bp, Artificial Sequence
  Description of Artificial Sequence: Synthetic oligonucleotide
actggtaatgggcctacttcg

SEQ ID NO: 17724 - DNA, 21 bp, Artificial Sequence
  Description of Artificial Sequence: Synthetic oligonucleotide
gatgcggtgcatggtaaggct

SEQ ID NO: 17725 - DNA, 21 bp, Artificial Sequence
  Description of Artificial Sequence: Synthetic oligonucleotide
ggtactacttcttctcctagt

SEQ ID NO: 17726 - DNA, 21 bp, Artificial Sequence
  Description of Artificial Sequence: Synthetic oligonucleotide
aacggcaccaccagaagccaa

SEQ ID NO: 17727 - DNA, 21 bp, Artificial Sequence
  Description of Artificial Sequence: Synthetic oligonucleotide
agagacggcaccagcgccacc

SEQ ID NO: 17728 - DNA, 21 bp, Artificial Sequence
  Description of Artificial Sequence: Synthetic oligonucleotide
agccccagcaaagaaaaagtc

SEQ ID NO: 17729 - DNA, 21 bp, Artificial Sequence
  Description of Artificial Sequence: Synthetic oligonucleotide
catattagtcctacgaagggg

SEQ ID NO: 17730 - DNA, 21 bp, Artificial Sequence
  Description of Artificial Sequence: Synthetic oligonucleotide
gatacgaagccgggtactagt

SEQ ID NO: 17731 - DNA, 21 bp, Artificial Sequence
  Description of Artificial Sequence: Synthetic oligonucleotide
ggcagaaaaagcgaaggcggc

SEQ ID NO: 17732 - DNA, 21 bp, Artificial Sequence
  Description of Artificial Sequence: Synthetic oligonucleotide
agcagcgacaccaccagcaaa

SEQ ID NO: 17733 - DNA, 21 bp, Artificial Sequence
  Description of Artificial Sequence: Synthetic oligonucleotide
gacaacaacagaaaccccgtc

SEQ ID NO: 17734 - DNA, 21 bp, Artificial Sequence
  Description of Artificial Sequence: Synthetic oligonucleotide
cagactgttgggactcaggct

SEQ ID NO: 17735 - DNA, 21 bp, Artificial Sequence
  Description of Artificial Sequence: Synthetic oligonucleotide
gccagcgcccccagcggcaaa

SEQ ID NO: 17736 - DNA, 21 bp, Artificial Sequence
  Description of Artificial Sequence: Synthetic oligonucleotide
accctccaaaccgccagcagc

SEQ ID NO: 17737 - DNA, 21 bp, Artificial Sequence
  Description of Artificial Sequence: Synthetic oligonucleotide
gatgggtcgtctcataagacg

SEQ ID NO: 17738 - DNA, 21 bp, Artificial Sequence
  Description of Artificial Sequence: Synthetic oligonucleotide
atgtcgcagagtccgacgttg

SEQ ID NO: 17739 - DNA, 21 bp, Artificial Sequence
  Description of Artificial Sequence: Synthetic oligonucleotide
aaccacgccagcagcgccgcc

SEQ ID NO: 17740 - DNA, 21 bp, Artificial Sequence
  Description of Artificial Sequence: Synthetic oligonucleotide
aatacgtcttcgcctacgtct

SEQ ID NO: 17741 - DNA, 21 bp, Artificial Sequence
  Description of Artificial Sequence: Synthetic oligonucleotide
aatatgggtactacggctaag

SEQ ID NO: 17742 - DNA, 21 bp, Artificial Sequence
  Description of Artificial Sequence: Synthetic oligonucleotide
caaggcaacggcaaccaaatc

SEQ ID NO: 17743 - DNA, 21 bp, Artificial Sequence
  Description of Artificial Sequence: Synthetic oligonucleotide
gttggtacgaataattcttct

SEQ ID NO: 17744 - DNA, 21 bp, Artificial Sequence
  Description of Artificial Sequence: Synthetic oligonucleotide
ggcagcagcagcaaaaccgtc

SEQ ID NO: 17745 - DNA, 21 bp, Artificial Sequence
  Description of Artificial Sequence: Synthetic oligonucleotide
gacaacagagccaaagacggc

SEQ ID NO: 17746 - DNA, 21 bp, Artificial Sequence
  Description of Artificial Sequence: Synthetic oligonucleotide
aaaaccgaaagcagcgcccaa

SEQ ID NO: 17747 - DNA, 21 bp, Artificial Sequence
  Description of Artificial Sequence: Synthetic oligonucleotide
gtcaaaaacagccccagcacc

SEQ ID NO: 17748 - DNA, 21 bp, Artificial Sequence
  Description of Artificial Sequence: Synthetic oligonucleotide
acgggtactgggagtcgggag

SEQ ID NO: 17749 - DNA, 21 bp, Artificial Sequence
  Description of Artificial Sequence: Synthetic oligonucleotide
gtcaccggcgccaacagcgcc

SEQ ID NO: 17750 - DNA, 21 bp, Artificial Sequence
  Description of Artificial Sequence: Synthetic oligonucleotide
agcagcgccgacagaaacacc

SEQ ID NO: 17751 - DNA, 21 bp, Artificial Sequence
  Description of Artificial Sequence: Synthetic oligonucleotide
tctggtagttctacgagtgtg

SEQ ID NO: 17752 - DNA, 21 bp, Artificial Sequence
  Description of Artificial Sequence: Synthetic oligonucleotide
accatgagcagcaaaaccctc

SEQ ID NO: 17753 - DNA, 21 bp, Artificial Sequence
  Description of Artificial Sequence: Synthetic oligonucleotide
ggcagagaagccacccccagc

SEQ ID NO: 17754 - DNA, 21 bp, Artificial Sequence
  Description of Artificial Sequence: Synthetic oligonucleotide
gggggttctactggggggagt

SEQ ID NO: 17755 - DNA, 21 bp, Artificial Sequence
  Description of Artificial Sequence: Synthetic oligonucleotide
aacggcagcaccgaaaacaga

SEQ ID NO: 17756 - DNA, 21 bp, Artificial Sequence
  Description of Artificial Sequence: Synthetic oligonucleotide
agcgccagcagcagcaaagtc

SEQ ID NO: 17757 - DNA, 21 bp, Artificial Sequence
  Description of Artificial Sequence: Synthetic oligonucleotide
caactcaccgaaaaaggcagc

SEQ ID NO: 17758 - DNA, 21 bp, Artificial Sequence
  Description of Artificial Sequence: Synthetic oligonucleotide
gagccggtttcgggtggtagt

SEQ ID NO: 17759 - DNA, 21 bp, Artificial Sequence
  Description of Artificial Sequence: Synthetic oligonucleotide
tctacgaatagtccgaaggct

SEQ ID NO: 17760 - DNA, 21 bp, Artificial Sequence
  Description of Artificial Sequence: Synthetic oligonucleotide
agtacgactaagggtggggat

SEQ ID NO: 17761 - DNA, 21 bp, Artificial Sequence
  Description of Artificial Sequence: Synthetic oligonucleotide
ttgcagacttctaaggctact

SEQ ID NO: 17762 - DNA, 21 bp, Artificial Sequence
  Description of Artificial Sequence: Synthetic oligonucleotide
cttcagtcttcgaaggatggt

SEQ ID NO: 17763 - DNA, 21 bp, Artificial Sequence
  Description of Artificial Sequence: Synthetic oligonucleotide
agcaccggcagccccgccctc

SEQ ID NO: 17764 - DNA, 21 bp, Artificial Sequence
  Description of Artificial Sequence: Synthetic oligonucleotide
acttcggctgggacgaattct

SEQ ID NO: 17765 - DNA, 21 bp, Artificial Sequence
  Description of Artificial Sequence: Synthetic oligonucleotide
gggccttcgactgctcagaat

SEQ ID NO: 17766 - DNA, 21 bp, Artificial Sequence
  Description of Artificial Sequence: Synthetic oligonucleotide
agcggcagcggcagcggcacc

SEQ ID NO: 17767 - DNA, 21 bp, Artificial Sequence
  Description of Artificial Sequence: Synthetic oligonucleotide
aaagccgacagcgccagaggc

SEQ ID NO: 17768 - DNA, 21 bp, Artificial Sequence
  Description of Artificial Sequence: Synthetic oligonucleotide
aacaacggcggcaaagccaac

SEQ ID NO: 17769 - DNA, 21 bp, Artificial Sequence
  Description of Artificial Sequence: Synthetic oligonucleotide
atggagaataagagtaatgtg

SEQ ID NO: 17770 - DNA, 21 bp, Artificial Sequence
  Description of Artificial Sequence: Synthetic oligonucleotide
gaaagccccaaactcggcagc

SEQ ID NO: 17771 - DNA, 21 bp, Artificial Sequence
  Description of Artificial Sequence: Synthetic oligonucleotide
gtcaccgcccccagcgccgcc

SEQ ID NO: 17772 - DNA, 21 bp, Artificial Sequence
  Description of Artificial Sequence: Synthetic oligonucleotide
gggacgacttcgaatagtacg

SEQ ID NO: 17773 - DNA, 21 bp, Artificial Sequence
  Description of Artificial Sequence: Synthetic oligonucleotide
gccagcagcaaaagcatcatg

SEQ ID NO: 17774 - DNA, 21 bp, Artificial Sequence
  Description of Artificial Sequence: Synthetic oligonucleotide
ggcaacctcaaaggcgccaac

SEQ ID NO: 17775 - DNA, 21 bp, Artificial Sequence
  Description of Artificial Sequence: Synthetic oligonucleotide
accggcgccacccccaccaac

SEQ ID NO: 17776 - DNA, 21 bp, Artificial Sequence
  Description of Artificial Sequence: Synthetic oligonucleotide
gggccggggacggggaaggct

SEQ ID NO: 17777 - DNA, 21 bp, Artificial Sequence
  Description of Artificial Sequence: Synthetic oligonucleotide
atgggtgttgggagtccgaag

SEQ ID NO: 17778 - DNA, 21 bp, Artificial Sequence
  Description of Artificial Sequence: Synthetic oligonucleotide
tctacggcgagtgggacgaat

SEQ ID NO: 17779 - DNA, 21 bp, Artificial Sequence
  Description of Artificial Sequence: Synthetic oligonucleotide
aattctaatgctactggtaag

SEQ ID NO: 17780 - DNA, 21 bp, Artificial Sequence
  Description of Artificial Sequence: Synthetic oligonucleotide
atgaccggcagcagcaccagc

SEQ ID NO: 17781 - DNA, 21 bp, Artificial Sequence
  Description of Artificial Sequence: Synthetic oligonucleotide
tctgattcgacgcggaatact

SEQ ID NO: 17782 - DNA, 21 bp, Artificial Sequence
  Description of Artificial Sequence: Synthetic oligonucleotide
accagcgaaagcagaaccagc

SEQ ID NO: 17783 - DNA, 21 bp, Artificial Sequence
  Description of Artificial Sequence: Synthetic oligonucleotide
gcccccaacgacagcaaactc

SEQ ID NO: 17784 - DNA, 21 bp, Artificial Sequence
  Description of Artificial Sequence: Synthetic oligonucleotide
ggtacgggggattctcgggcg

SEQ ID NO: 17785 - DNA, 21 bp, Artificial Sequence
  Description of Artificial Sequence: Synthetic oligonucleotide
tctggtgcgaataatacgcgg

SEQ ID NO: 17786 - DNA, 21 bp, Artificial Sequence
  Description of Artificial Sequence: Synthetic oligonucleotide
cttactggtaaggatcggctt

SEQ ID NO: 17787 - DNA, 21 bp, Artificial Sequence
  Description of Artificial Sequence: Synthetic oligonucleotide
gagtctagtactaagggggtt

SEQ ID NO: 17788 - DNA, 21 bp, Artificial Sequence
  Description of Artificial Sequence: Synthetic oligonucleotide
gacaccagacaaagccaaaaa

SEQ ID NO: 17789 - DNA, 21 bp, Artificial Sequence
  Description of Artificial Sequence: Synthetic oligonucleotide
agcagcaaaagcaccgccacc

SEQ ID NO: 17790 - DNA, 21 bp, Artificial Sequence
  Description of Artificial Sequence: Synthetic oligonucleotide
aggttgggggataaggcggag

SEQ ID NO: 17791 - DNA, 21 bp, Artificial Sequence
  Description of Artificial Sequence: Synthetic oligonucleotide
accggcgacgccaaaatccac

SEQ ID NO: 17792 - DNA, 21 bp, Artificial Sequence
  Description of Artificial Sequence: Synthetic oligonucleotide
agcaacgacaaacaaggcctc

SEQ ID NO: 17793 - DNA, 21 bp, Artificial Sequence
  Description of Artificial Sequence: Synthetic oligonucleotide
gaaaacacccacaaaaccgtc

SEQ ID NO: 17794 - DNA, 21 bp, Artificial Sequence
  Description of Artificial Sequence: Synthetic oligonucleotide
gctggttctcaggagaagact

SEQ ID NO: 17795 - DNA, 21 bp, Artificial Sequence
  Description of Artificial Sequence: Synthetic oligonucleotide
aacatgaacgacgccagaagc

SEQ ID NO: 17796 - DNA, 21 bp, Artificial Sequence
  Description of Artificial Sequence: Synthetic oligonucleotide
gacagcatggccagcgtcaaa

SEQ ID NO: 17797 - DNA, 21 bp, Artificial Sequence
  Description of Artificial Sequence: Synthetic oligonucleotide
caagacagcctcaaagaaaga

SEQ ID NO: 17798 - DNA, 21 bp, Artificial Sequence
  Description of Artificial Sequence: Synthetic oligonucleotide
gagaatactactaagtcttcg

SEQ ID NO: 17799 - DNA, 21 bp, Artificial Sequence
  Description of Artificial Sequence: Synthetic oligonucleotide
gccagcaacgccagccccagc

SEQ ID NO: 17800 - DNA, 21 bp, Artificial Sequence
  Description of Artificial Sequence: Synthetic oligonucleotide
tctactgctccggttaatgcg

SEQ ID NO: 17801 - DNA, 21 bp, Artificial Sequence
  Description of Artificial Sequence: Synthetic oligonucleotide
aacgccggcgccgccagccac

SEQ ID NO: 17802 - DNA, 21 bp, Artificial Sequence
  Description of Artificial Sequence: Synthetic oligonucleotide
accagcggcagcgaccccaga

SEQ ID NO: 17803 - DNA, 21 bp, Artificial Sequence
  Description of Artificial Sequence: Synthetic oligonucleotide
agcggccaaagcgtcaacagc

SEQ ID NO: 17804 - DNA, 21 bp, Artificial Sequence
  Description of Artificial Sequence: Synthetic oligonucleotide
agtagtaataagattagtcag

SEQ ID NO: 17805 - DNA, 21 bp, Artificial Sequence
  Description of Artificial Sequence: Synthetic oligonucleotide
caaaacgcccaaaaaaccagc

SEQ ID NO: 17806 - DNA, 21 bp, Artificial Sequence
  Description of Artificial Sequence: Synthetic oligonucleotide
gaagtcagaagcaacaaaggc

SEQ ID NO: 17807 - DNA, 21 bp, Artificial Sequence
  Description of Artificial Sequence: Synthetic oligonucleotide
gtcagagaccaaaccaccggc

SEQ ID NO: 17808 - DNA, 21 bp, Artificial Sequence
  Description of Artificial Sequence: Synthetic oligonucleotide
ttccccgccggcagcaaagac

SEQ ID NO: 17809 - DNA, 21 bp, Artificial Sequence
  Description of Artificial Sequence: Synthetic oligonucleotide
aacagcaaagccagcgccagc

SEQ ID NO: 17810 - DNA, 21 bp, Artificial Sequence
  Description of Artificial Sequence: Synthetic oligonucleotide
aacgccgcccaacacaacacc

SEQ ID NO: 17811 - DNA, 21 bp, Artificial Sequence
  Description of Artificial Sequence: Synthetic oligonucleotide
aattctggtaatgcgagtacg

SEQ ID NO: 17812 - DNA, 21 bp, Artificial Sequence
  Description of Artificial Sequence: Synthetic oligonucleotide
acccacacccaaagcaccggc

SEQ ID NO: 17813 - DNA, 21 bp, Artificial Sequence
  Description of Artificial Sequence: Synthetic oligonucleotide
accggccacaacagcctcaaa

SEQ ID NO: 17814 - DNA, 21 bp, Artificial Sequence
  Description of Artificial Sequence: Synthetic oligonucleotide
accgtcaacgccaaagccggc

SEQ ID NO: 17815 - DNA, 21 bp, Artificial Sequence
  Description of Artificial Sequence: Synthetic oligonucleotide
acgaattctccgacgacgcag

SEQ ID NO: 17816 - DNA, 21 bp, Artificial Sequence
  Description of Artificial Sequence: Synthetic oligonucleotide
acgatgggtgggtctaatagt

SEQ ID NO: 17817 - DNA, 21 bp, Artificial Sequence
  Description of Artificial Sequence: Synthetic oligonucleotide
actattggggatcatcctagg

SEQ ID NO: 17818 - DNA, 21 bp, Artificial Sequence
  Description of Artificial Sequence: Synthetic oligonucleotide
acttcgagtccgccggcgaat

SEQ ID NO: 17819 - DNA, 21 bp, Artificial Sequence
  Description of Artificial Sequence: Synthetic oligonucleotide
agcagcagcggcaccaaaagc

SEQ ID NO: 17820 - DNA, 21 bp, Artificial Sequence
  Description of Artificial Sequence: Synthetic oligonucleotide
agccccgaaagcaacagcaaa

SEQ ID NO: 17821 - DNA, 21 bp, Artificial Sequence
  Description of Artificial Sequence: Synthetic oligonucleotide
agcggcgccagcagcgccgtc

SEQ ID NO: 17822 - DNA, 21 bp, Artificial Sequence
  Description of Artificial Sequence: Synthetic oligonucleotide
agcggcgcccaaggcaacatg

SEQ ID NO: 17823 - DNA, 21 bp, Artificial Sequence
  Description of Artificial Sequence: Synthetic oligonucleotide
atgagcgccggcaaagccggc

SEQ ID NO: 17824 - DNA, 21 bp, Artificial Sequence
  Description of Artificial Sequence: Synthetic oligonucleotide
atgtcgagtgataagggttcg

SEQ ID NO: 17825 - DNA, 21 bp, Artificial Sequence
  Description of Artificial Sequence: Synthetic oligonucleotide
cacaccggcggcgaaaaagcc

SEQ ID NO: 17826 - DNA, 21 bp, Artificial Sequence
  Description of Artificial Sequence: Synthetic oligonucleotide
cagaatacgactggtactacg

SEQ ID NO: 17827 - DNA, 21 bp, Artificial Sequence
  Description of Artificial Sequence: Synthetic oligonucleotide
ctcaccagcagagaccaagtc

SEQ ID NO: 17828 - DNA, 21 bp, Artificial Sequence
  Description of Artificial Sequence: Synthetic oligonucleotide
ctccaaagcggcgtcaccggc

SEQ ID NO: 17829 - DNA, 21 bp, Artificial Sequence
  Description of Artificial Sequence: Synthetic oligonucleotide
gaaagcaccggcgccagcagc

SEQ ID NO: 17830 - DNA, 21 bp, Artificial Sequence
  Description of Artificial Sequence: Synthetic oligonucleotide
gaaggcgccggcagcgccggc

SEQ ID NO: 17831 - DNA, 21 bp, Artificial Sequence
  Description of Artificial Sequence: Synthetic oligonucleotide
gaagtcagcagaaaccccggc

SEQ ID NO: 17832 - DNA, 21 bp, Artificial Sequence
  Description of Artificial Sequence: Synthetic oligonucleotide
gatcgggtggggtctagtact

SEQ ID NO: 17833 - DNA, 21 bp, Artificial Sequence
  Description of Artificial Sequence: Synthetic oligonucleotide
gccaccaaaagcaacgccggc

SEQ ID NO: 17834 - DNA, 21 bp, Artificial Sequence
  Description of Artificial Sequence: Synthetic oligonucleotide
gccccccccaccggcggccac

SEQ ID NO: 17835 - DNA, 21 bp, Artificial Sequence
  Description of Artificial Sequence: Synthetic oligonucleotide
ggccacaccgccagagacggc

SEQ ID NO: 17836 - DNA, 21 bp, Artificial Sequence
  Description of Artificial Sequence: Synthetic oligonucleotide
ggcgccgccggcgccgccagc

SEQ ID NO: 17837 - DNA, 21 bp, Artificial Sequence
  Description of Artificial Sequence: Synthetic oligonucleotide
gggggttctaatgcgcctgtt

SEQ ID NO: 17838 - DNA, 21 bp, Artificial Sequence
  Description of Artificial Sequence: Synthetic oligonucleotide
gtcgccggcgccaccgccggc

SEQ ID NO: 17839 - DNA, 21 bp, Artificial Sequence
  Description of Artificial Sequence: Synthetic oligonucleotide
tcgatgaatgataagtcgact

SEQ ID NO: 17840 - DNA, 21 bp, Artificial Sequence
  Description of Artificial Sequence: Synthetic oligonucleotide
tcgcatattacttctgagaag

SEQ ID NO: 17841 - DNA, 21 bp, Artificial Sequence
  Description of Artificial Sequence: Synthetic oligonucleotide
ttgacgaatagtaatgcggct

SEQ ID NO: 17842 - DNA, 21 bp, Artificial Sequence
  Description of Artificial Sequence: Synthetic oligonucleotide
ttgcagggtactggtgcgggt

SEQ ID NO: 17843 - DNA, 21 bp, Artificial Sequence
  Description of Artificial Sequence: Synthetic oligonucleotide
gctaatacgacgaagtctagt

SEQ ID NO: 17844 - DNA, 21 bp, Artificial Sequence
  Description of Artificial Sequence: Synthetic oligonucleotide
gcggctaatgataggaatctt

SEQ ID NO: 17845 - DNA, 21 bp, Artificial Sequence
  Description of Artificial Sequence: Synthetic oligonucleotide
cacggcaacaacacccccacc

SEQ ID NO: 17846 - DNA, 21 bp, Artificial Sequence
  Description of Artificial Sequence: Synthetic oligonucleotide
acgcagaatactgctacgtct

SEQ ID NO: 17847 - DNA, 21 bp, Artificial Sequence
  Description of Artificial Sequence: Synthetic oligonucleotide
actagtggtcagccgagtcgt

SEQ ID NO: 17848 - DNA, 21 bp, Artificial Sequence
  Description of Artificial Sequence: Synthetic oligonucleotide
accatgacccaaaccagcagc

SEQ ID NO: 17849 - DNA, 21 bp, Artificial Sequence
  Description of Artificial Sequence: Synthetic oligonucleotide
tctgatcagaagggtgctcag

SEQ ID NO: 17850 - DNA, 21 bp, Artificial Sequence
  Description of Artificial Sequence: Synthetic oligonucleotide
gggcagcgggggcaggagggt

SEQ ID NO: 17851 - DNA, 21 bp, Artificial Sequence
  Description of Artificial Sequence: Synthetic oligonucleotide
gagaattcgtcgagtagtcgt

SEQ ID NO: 17852 - DNA, 21 bp, Artificial Sequence
  Description of Artificial Sequence: Synthetic oligonucleotide
acggctgcgacgcatcctgcg

SEQ ID NO: 17853 - DNA, 21 bp, Artificial Sequence
  Description of Artificial Sequence: Synthetic oligonucleotide
gctagtactggtaagatgacg

SEQ ID NO: 17854 - DNA, 21 bp, Artificial Sequence
  Description of Artificial Sequence: Synthetic oligonucleotide
tcttctgagagtaatcgttcg

SEQ ID NO: 17855 - DNA, 21 bp, Artificial Sequence
  Description of Artificial Sequence: Synthetic oligonucleotide
tctagtggtaatgggtcttcg

SEQ ID NO: 17856 - DNA, 21 bp, Artificial Sequence
  Description of Artificial Sequence: Synthetic oligonucleotide
agcaacggcagcagcaccgcc

SEQ ID NO: 17857 - DNA, 21 bp, Artificial Sequence
  Description of Artificial Sequence: Synthetic oligonucleotide
ggcagcagcaccagacccgaa

SEQ ID NO: 17858 - DNA, 21 bp, Artificial Sequence
  Description of Artificial Sequence: Synthetic oligonucleotide
catgtggagccgaagcttggg

SEQ ID NO: 17859 - DNA, 21 bp, Artificial Sequence
  Description of Artificial Sequence: Synthetic oligonucleotide
ggcagcagcgacagcagaagc

SEQ ID NO: 17860 - DNA, 21 bp, Artificial Sequence
  Description of Artificial Sequence: Synthetic oligonucleotide
ggcgacagcaaagtcaacaac

SEQ ID NO: 17861 - DNA, 21 bp, Artificial Sequence
  Description of Artificial Sequence: Synthetic oligonucleotide
gttggtaagtctagtaattcg

SEQ ID NO: 17862 - DNA, 21 bp, Artificial Sequence
  Description of Artificial Sequence: Synthetic oligonucleotide
tctcctggtagtagtgtttcg

SEQ ID NO: 17863 - DNA, 21 bp, Artificial Sequence
  Description of Artificial Sequence: Synthetic oligonucleotide
ctcaccggccccagcaacacc

SEQ ID NO: 17864 - DNA, 21 bp, Artificial Sequence
  Description of Artificial Sequence: Synthetic oligonucleotide
ggcggcatcggcaccaaagaa

SEQ ID NO: 17865 - DNA, 21 bp, Artificial Sequence
  Description of Artificial Sequence: Synthetic oligonucleotide
caagtcgcccccagcaacagc

SEQ ID NO: 17866 - DNA, 21 bp, Artificial Sequence
  Description of Artificial Sequence: Synthetic oligonucleotide
ggtactagtcagacgagtagt

SEQ ID NO: 17867 - DNA, 21 bp, Artificial Sequence
  Description of Artificial Sequence: Synthetic oligonucleotide
tcggggaatagttctcatgct

SEQ ID NO: 17868 - DNA, 21 bp, Artificial Sequence
  Description of Artificial Sequence: Synthetic oligonucleotide
atgactactacgaaggctgag

SEQ ID NO: 17869 - DNA, 21 bp, Artificial Sequence
  Description of Artificial Sequence: Synthetic oligonucleotide
gaagccagcaccagaagcggc

SEQ ID NO: 17870 - DNA, 21 bp, Artificial Sequence
  Description of Artificial Sequence: Synthetic oligonucleotide
tcgaataagccgggtactaat

SEQ ID NO: 17871 - DNA, 21 bp, Artificial Sequence
  Description of Artificial Sequence: Synthetic oligonucleotide
aacagcagaccccaaaacaac

SEQ ID NO: 17872 - DNA, 21 bp, Artificial Sequence
  Description of Artificial Sequence: Synthetic oligonucleotide
caaggccaaagcaacggcagc

SEQ ID NO: 17873 - DNA, 21 bp, Artificial Sequence
  Description of Artificial Sequence: Synthetic oligonucleotide
aaccccaccgccggcggcagc

SEQ ID NO: 17874 - DNA, 21 bp, Artificial Sequence
  Description of Artificial Sequence: Synthetic oligonucleotide
catggttctggtaataagggg

SEQ ID NO: 17875 - DNA, 21 bp, Artificial Sequence
  Description of Artificial Sequence: Synthetic oligonucleotide
agcggcggcagcggcgccaaa

SEQ ID NO: 17876 - DNA, 21 bp, Artificial Sequence
  Description of Artificial Sequence: Synthetic oligonucleotide
acccacaccagcaaaatgagc

SEQ ID NO: 17877 - DNA, 21 bp, Artificial Sequence
  Description of Artificial Sequence: Synthetic oligonucleotide
agagacgtcaaacccgccagc

SEQ ID NO: 17878 - DNA, 21 bp, Artificial Sequence
  Description of Artificial Sequence: Synthetic oligonucleotide
gacagaagcgccgaaaccaga

SEQ ID NO: 17879 - DNA, 21 bp, Artificial Sequence
  Description of Artificial Sequence: Synthetic oligonucleotide
gacgccgtcaccagcaccaaa

SEQ ID NO: 17880 - DNA, 21 bp, Artificial Sequence
  Description of Artificial Sequence: Synthetic oligonucleotide
caaagcaccggcaaactcggc

SEQ ID NO: 17881 - DNA, 21 bp, Artificial Sequence
  Description of Artificial Sequence: Synthetic oligonucleotide
gatagtctgtcgtcgcctaag

SEQ ID NO: 17882 - DNA, 21 bp, Artificial Sequence
  Description of Artificial Sequence: Synthetic oligonucleotide
ggtgatactcgggtttcgagt

SEQ ID NO: 17883 - DNA, 21 bp, Artificial Sequence
  Description of Artificial Sequence: Synthetic oligonucleotide
cacagcgcccaaggcagcagc

SEQ ID NO: 17884 - DNA, 21 bp, Artificial Sequence
  Description of Artificial Sequence: Synthetic oligonucleotide
ggtatgaatactaaggctact

SEQ ID NO: 17885 - DNA, 21 bp, Artificial Sequence
  Description of Artificial Sequence: Synthetic oligonucleotide
tatggtagtgataagtctctg

SEQ ID NO: 17886 - DNA, 21 bp, Artificial Sequence
  Description of Artificial Sequence: Synthetic oligonucleotide
actgaggatggtaagcagcat

SEQ ID NO: 17887 - DNA, 21 bp, Artificial Sequence
  Description of Artificial Sequence: Synthetic oligonucleotide
agcaccgacagccaaggcaaa

SEQ ID NO: 17888 - DNA, 21 bp, Artificial Sequence
  Description of Artificial Sequence: Synthetic oligonucleotide
gtgatggcggataagagtagt

SEQ ID NO: 17889 - DNA, 21 bp, Artificial Sequence
  Description of Artificial Sequence: Synthetic oligonucleotide
ggcgccagcagcgccagagaa

SEQ ID NO: 17890 - DNA, 21 bp, Artificial Sequence
  Description of Artificial Sequence: Synthetic oligonucleotide
gtcaacggcagcaccgtcacc

SEQ ID NO: 17891 - DNA, 21 bp, Artificial Sequence
  Description of Artificial Sequence: Synthetic oligonucleotide
ggtaagcagggtgttagtgct

SEQ ID NO: 17892 - DNA, 21 bp, Artificial Sequence
  Description of Artificial Sequence: Synthetic oligonucleotide
accgtcaccgacggcaacaga

SEQ ID NO: 17893 - DNA, 21 bp, Artificial Sequence
  Description of Artificial Sequence: Synthetic oligonucleotide
gtcagcgaccacaaaagcggc

SEQ ID NO: 17894 - DNA, 21 bp, Artificial Sequence
  Description of Artificial Sequence: Synthetic oligonucleotide
cacagcgccagccaccaagcc

SEQ ID NO: 17895 - DNA, 21 bp, Artificial Sequence
  Description of Artificial Sequence: Synthetic oligonucleotide
gtcagcacccccagcaacctc

SEQ ID NO: 17896 - DNA, 21 bp, Artificial Sequence
  Description of Artificial Sequence: Synthetic oligonucleotide
agcgccggcagcagcagaacc

SEQ ID NO: 17897 - DNA, 21 bp, Artificial Sequence
  Description of Artificial Sequence: Synthetic oligonucleotide
acgccgggtgcgagtaatgtg

SEQ ID NO: 17898 - DNA, 21 bp, Artificial Sequence
  Description of Artificial Sequence: Synthetic oligonucleotide
accaccagcgccccccccaac

SEQ ID NO: 17899 - DNA, 21 bp, Artificial Sequence
  Description of Artificial Sequence: Synthetic oligonucleotide
aattctaagcaggtgcctggt

SEQ ID NO: 17900 - DNA, 21 bp, Artificial Sequence
  Description of Artificial Sequence: Synthetic oligonucleotide
caaagcgacagcgcccccaga

SEQ ID NO: 17901 - DNA, 21 bp, Artificial Sequence
  Description of Artificial Sequence: Synthetic oligonucleotide
ttgtcgaataagggttctggg

SEQ ID NO: 17902 - DNA, 21 bp, Artificial Sequence
  Description of Artificial Sequence: Synthetic oligonucleotide
aaaaacagcggcgccagccaa

SEQ ID NO: 17903 - DNA, 21 bp, Artificial Sequence
  Description of Artificial Sequence: Synthetic oligonucleotide
accatcgccgacagcaacaga

SEQ ID NO: 17904 - DNA, 21 bp, Artificial Sequence
  Description of Artificial Sequence: Synthetic oligonucleotide
agcgccggcggccaaatgagc

SEQ ID NO: 17905 - DNA, 21 bp, Artificial Sequence
  Description of Artificial Sequence: Synthetic oligonucleotide
aacagcgacaacagaggcatc

SEQ ID NO: 17906 - DNA, 21 bp, Artificial Sequence
  Description of Artificial Sequence: Synthetic oligonucleotide
aatactgggagtgatgttaag

SEQ ID NO: 17907 - DNA, 21 bp, Artificial Sequence
  Description of Artificial Sequence: Synthetic oligonucleotide
aatgctagtacttctagtggt

SEQ ID NO: 17908 - DNA, 21 bp, Artificial Sequence
  Description of Artificial Sequence: Synthetic oligonucleotide
cggcgtgataaggagttgtct

SEQ ID NO: 17909 - DNA, 21 bp, Artificial Sequence
  Description of Artificial Sequence: Synthetic oligonucleotide
gagacggttaataagcctagt

SEQ ID NO: 17910 - DNA, 21 bp, Artificial Sequence
  Description of Artificial Sequence: Synthetic oligonucleotide
aatcagggtaatggtagtagt

SEQ ID NO: 17911 - DNA, 21 bp, Artificial Sequence
  Description of Artificial Sequence: Synthetic oligonucleotide
gaggggtcgagtcgggttggg

SEQ ID NO: 17912 - DNA, 21 bp, Artificial Sequence
  Description of Artificial Sequence: Synthetic oligonucleotide
ggttcgattgcggggagtaat

SEQ ID NO: 17913 - DNA, 21 bp, Artificial Sequence
  Description of Artificial Sequence: Synthetic oligonucleotide
aaccaaaccagcaacagcacc

SEQ ID NO: 17914 - DNA, 21 bp, Artificial Sequence
  Description of Artificial Sequence: Synthetic oligonucleotide
gagggtacggataggtttggg

SEQ ID NO: 17915 - DNA, 21 bp, Artificial Sequence
  Description of Artificial Sequence: Synthetic oligonucleotide
gccggcggcaacgccagccaa

SEQ ID NO: 17916 - DNA, 21 bp, Artificial Sequence
  Description of Artificial Sequence: Synthetic oligonucleotide
cgtaatactagtccgggtgtg

SEQ ID NO: 17917 - DNA, 21 bp, Artificial Sequence
  Description of Artificial Sequence: Synthetic oligonucleotide
actggttctaatagtactggt

SEQ ID NO: 17918 - DNA, 21 bp, Artificial Sequence
  Description of Artificial Sequence: Synthetic oligonucleotide
caacccggcagcagcctcaaa

SEQ ID NO: 17919 - DNA, 21 bp, Artificial Sequence
  Description of Artificial Sequence: Synthetic oligonucleotide
attaatgaggggaattcgaag

SEQ ID NO: 17920 - DNA, 21 bp, Artificial Sequence
  Description of Artificial Sequence: Synthetic oligonucleotide
aacgtccccagcggcaacagc

SEQ ID NO: 17921 - DNA, 21 bp, Artificial Sequence
  Description of Artificial Sequence: Synthetic oligonucleotide
gaaagaggcgccaacaccaaa

SEQ ID NO: 17922 - DNA, 21 bp, Artificial Sequence
  Description of Artificial Sequence: Synthetic oligonucleotide
gggtctgcgcagggttcggtt

SEQ ID NO: 17923 - DNA, 21 bp, Artificial Sequence
  Description of Artificial Sequence: Synthetic oligonucleotide
gatccggtgactcctcgggct

SEQ ID NO: 17924 - DNA, 21 bp, Artificial Sequence
  Description of Artificial Sequence: Synthetic oligonucleotide
gatagtaagtctgggacgact

SEQ ID NO: 17925 - DNA, 21 bp, Artificial Sequence
  Description of Artificial Sequence: Synthetic oligonucleotide
ggtactacgactgagagtcgt

SEQ ID NO: 17926 - DNA, 21 bp, Artificial Sequence
  Description of Artificial Sequence: Synthetic oligonucleotide
gccggcaacagagacaacgtc

SEQ ID NO: 17927 - DNA, 21 bp, Artificial Sequence
  Description of Artificial Sequence: Synthetic oligonucleotide
gcgattcagggggattctaag

SEQ ID NO: 17928 - DNA, 21 bp, Artificial Sequence
  Description of Artificial Sequence: Synthetic oligonucleotide
gggaagtctgatcctcagggt

SEQ ID NO: 17929 - DNA, 21 bp, Artificial Sequence
  Description of Artificial Sequence: Synthetic oligonucleotide
gaactcagcagccccaaaacc

SEQ ID NO: 17930 - DNA, 21 bp, Artificial Sequence
  Description of Artificial Sequence: Synthetic oligonucleotide
ggttcgtcgccttctgttcat

SEQ ID NO: 17931 - DNA, 21 bp, Artificial Sequence
  Description of Artificial Sequence: Synthetic oligonucleotide
caaccccaagacgcccccaaa

SEQ ID NO: 17932 - DNA, 21 bp, Artificial Sequence
  Description of Artificial Sequence: Synthetic oligonucleotide
aacagcggcaccaacagcagc

SEQ ID NO: 17933 - DNA, 21 bp, Artificial Sequence
  Description of Artificial Sequence: Synthetic oligonucleotide
gctactggttcgcatagtgtt

SEQ ID NO: 17934 - DNA, 21 bp, Artificial Sequence
  Description of Artificial Sequence: Synthetic oligonucleotide
gacagcagcaccagcgccaaa

SEQ ID NO: 17935 - DNA, 21 bp, Artificial Sequence
  Description of Artificial Sequence: Synthetic oligonucleotide
caacaaccccaagccggcagc

SEQ ID NO: 17936 - DNA, 21 bp, Artificial Sequence
  Description of Artificial Sequence: Synthetic oligonucleotide
ggcagcagcagcgtcagagaa

SEQ ID NO: 17937 - DNA, 21 bp, Artificial Sequence
  Description of Artificial Sequence: Synthetic oligonucleotide
tcggtgggtggggatttgaag

SEQ ID NO: 17938 - DNA, 21 bp, Artificial Sequence
  Description of Artificial Sequence: Synthetic oligonucleotide
gtccaaaccgcccaaaacggc

SEQ ID NO: 17939 - DNA, 21 bp, Artificial Sequence
  Description of Artificial Sequence: Synthetic oligonucleotide
gacaaaaccgacaaaacctac

SEQ ID NO: 17940 - DNA, 21 bp, Artificial Sequence
  Description of Artificial Sequence: Synthetic oligonucleotide
agcggcggcgacagccacaga

SEQ ID NO: 17941 - DNA, 21 bp, Artificial Sequence
  Description of Artificial Sequence: Synthetic oligonucleotide
agtatggggagtgagaaggct

SEQ ID NO: 17942 - DNA, 21 bp, Artificial Sequence
  Description of Artificial Sequence: Synthetic oligonucleotide
cagcctccggattctaagacg

SEQ ID NO: 17943 - DNA, 21 bp, Artificial Sequence
  Description of Artificial Sequence: Synthetic oligonucleotide
gccaccggccaaccccccaga

SEQ ID NO: 17944 - DNA, 21 bp, Artificial Sequence
  Description of Artificial Sequence: Synthetic oligonucleotide
gtcggcagcagcagcggcggc

SEQ ID NO: 17945 - DNA, 21 bp, Artificial Sequence
  Description of Artificial Sequence: Synthetic oligonucleotide
agcgccaacagcacccccaga

SEQ ID NO: 17946 - DNA, 21 bp, Artificial Sequence
  Description of Artificial Sequence: Synthetic oligonucleotide
aacagcagcagagaaagcgtc

SEQ ID NO: 17947 - DNA, 21 bp, Artificial Sequence
  Description of Artificial Sequence: Synthetic oligonucleotide
aatcatggtgataggggtggt

SEQ ID NO: 17948 - DNA, 21 bp, Artificial Sequence
  Description of Artificial Sequence: Synthetic oligonucleotide
ggtgttggggatacgaatcgt

SEQ ID NO: 17949 - DNA, 21 bp, Artificial Sequence
  Description of Artificial Sequence: Synthetic oligonucleotide
agcgacagcaaccacagaaac

SEQ ID NO: 17950 - DNA, 21 bp, Artificial Sequence
  Description of Artificial Sequence: Synthetic oligonucleotide
agcaccgaaagaagcggcaac

SEQ ID NO: 17951 - DNA, 21 bp, Artificial Sequence
  Description of Artificial Sequence: Synthetic oligonucleotide
cacagcagcgacagcgtcaaa

SEQ ID NO: 17952 - DNA, 21 bp, Artificial Sequence
  Description of Artificial Sequence: Synthetic oligonucleotide
catggtcaggcgactattagt

SEQ ID NO: 17953 - DNA, 21 bp, Artificial Sequence
  Description of Artificial Sequence: Synthetic oligonucleotide
agccccgtccccaccagcgcc

SEQ ID NO: 17954 - DNA, 21 bp, Artificial Sequence
  Description of Artificial Sequence: Synthetic oligonucleotide
actaagacgactgctaatggg

SEQ ID NO: 17955 - DNA, 21 bp, Artificial Sequence
  Description of Artificial Sequence: Synthetic oligonucleotide
gaggatcatggtagtaagggg

SEQ ID NO: 17956 - DNA, 21 bp, Artificial Sequence
  Description of Artificial Sequence: Synthetic oligonucleotide
gaggggcggactcctttgatg

SEQ ID NO: 17957 - DNA, 21 bp, Artificial Sequence
  Description of Artificial Sequence: Synthetic oligonucleotide
gttgcgtctgagaggagtgtt

SEQ ID NO: 17958 - DNA, 21 bp, Artificial Sequence
  Description of Artificial Sequence: Synthetic oligonucleotide
caggttagtagtgggcatgct

SEQ ID NO: 17959 - DNA, 21 bp, Artificial Sequence
  Description of Artificial Sequence: Synthetic oligonucleotide
ctgacgggtactgataagggg

SEQ ID NO: 17960 - DNA, 21 bp, Artificial Sequence
  Description of Artificial Sequence: Synthetic oligonucleotide
tctaatgggtctgcggtgtct

SEQ ID NO: 17961 - DNA, 21 bp, Artificial Sequence
  Description of Artificial Sequence: Synthetic oligonucleotide
accggcgccgccagacccgac

SEQ ID NO: 17962 - DNA, 21 bp, Artificial Sequence
  Description of Artificial Sequence: Synthetic oligonucleotide
gtttcgagtagttctgctacg

(The sequence listing continues in the following parts.)

The invention claimed is:

1. A recombinant AAV (rAAV), the rAAV comprising:
a) a variant AAV capsid comprising a variant AAV capsid protein comprising an amino acid substitution of three or more amino acids within a 7-mer peptide sequence of a parental AAV capsid protein, wherein the 7-mer peptide sequence is from amino acid positions that correspond to amino acid residues 452-458 of AAV9 VP1 (SEQ ID NO:1), and wherein the amino acid substitution is not ILGTGTS (SEQ ID NO: 45479), not QSSQTPR (SEQ ID NO: 45480), and not TLAVPFK (SEQ ID NO: 45477); and b) a heterologous polynucleotide comprising a nucleotide sequence encoding a gene product.

2. The rAAV of claim 1, wherein the variant AAV capsid has an increased tropism for a target tissue or a target cell, when measured in a subject, relative to a tropism of the parental AAV capsid.

3. The rAAV of claim 2, wherein the target tissue or the target cell comprises a tissue or a cell of a central nervous system (CNS) or a peripheral nervous system (PNS), or a combination thereof.

4. The rAAV of claim 3, wherein the variant AAV capsid has a decreased tropism for an off-target tissue comprising liver tissue or an off-target cell comprising a liver cell, when measured in a subject, relative to the tropism of the parental AAV capsid.

5. The rAAV of claim 4, wherein the three or more amino acids comprise three contiguous amino acids, each amino acid independently selected from the group consisting of A, D, E, G, K, H, M, N, P, L Q, S, T, and V at amino acid positions in the parental AAV capsid protein corresponding to amino acid residues 452-454, 453-455, 454-456, 455-457, or 456-458 of AAV9 VP1 (SEQ ID NO: 1).

6. The rAAV of claim 4, wherein the three or more amino acids comprise four contiguous amino acids, each amino acid independently selected from the group consisting of A, D, E, G, K, H, M, N, P, L Q, S, T, and V at amino acid positions in the parental AAV capsid protein corresponding to amino acid residues 452-455, 453-456, 454-457, or 455-458 of AAV9 VP1 (SEQ ID NO: 1).

7. The rAAV of claim 4, wherein three or more amino acids comprise at least five contiguous amino acids, each amino acid independently selected from the group consisting of A, D, E, G, K, H, M, N, P, L Q, S, T, and V at amino acid positions in the parental AAV capsid protein corresponding to amino acid residues 452-456, 453-457, or 454-458 of AAV9 VP1 (SEQ ID NO: 1).

8. The rAAV of claim 4, wherein the three or more amino acids comprise three or more of:
   a) A, D, E, G, H, M, N, Q, S, T, or V substituted at an amino acid position corresponding to amino acid residue 452 of AAV9 VP1 (SEQ ID NO: 1);
   b) A, D, E, G, K, N, Q, S, T, or V substituted at an amino acid position corresponding to amino acid residue 453 of AAV9 VP1 (SEQ ID NO: 1);
   c) A, D, E, G, K, N, Q, S, T, or V substituted at amino acid position corresponding to amino acid residue 454 of AAV9 VP1 (SEQ ID NO: 1);
   d) A, D, E, G, K, N, P, Q, S, or T substituted at an amino acid position corresponding to amino acid residue 455 of AAV9 VP1 (SEQ ID NO: 1);
   e) A, D, E, G, H, K, N, P, Q, S, or T substituted at an amino acid position corresponding to amino acid residue 456 of AAV9 VP1 (SEQ ID NO: 1);
   f) A, D, E, G, K, N, P, S, T, or V substituted at an amino acid position corresponding to amino acid residue 457 of AAV9 VP1 (SEQ ID NO: 1); and
   g) A, E, G, H, K, L, N, Q, S, T, or V substituted at amino acid position corresponding to amino acid residue 458 of AAV9 VP1 (SEQ ID NO: 1).

9. The rAAV of claim 5, wherein the amino acid substitution comprises an amino acid sequence selected from DGAATKN (SEQ ID NO: 3943), and DGQSSKS (SEQ ID NO: 2764).

10. The rAAV of claim 4, wherein the three or more amino acids comprises three or more of:
   a) A, D, G, L, N, Q, S, or T substituted at an amino acid at a position corresponding to amino acid residue 452 of AAV9 VP1 (SEQ ID NO: 1);
   b) A, G, N, P, Q, R, S, or substituted at an amino acid at a position corresponding to amino acid residue 453 of AAV9 VP1 (SEQ ID NO: 1);
   c) A, D, G, N, S, or T substituted at an amino acid at a position corresponding to amino acid residue 454 of AAV9 VP1 (SEQ ID NO: 1);
   d) A, D, G, K, N, P, Q, S, or T substituted at an amino acid at a position corresponding to amino acid residue 455 of AAV9 VP1 (SEQ ID NO: 1);
   e) A, G, K, N, P, R, S, or T substituted at an amino acid at a position corresponding to amino acid residue 456 of AAV9 VP (SEQ ID NO: 1);
   f) A, G, K, N, P, R, S, T, or V substituted at an amino acid at a position corresponding to amino acid residue 457 of AAV9 VP1 (SEQ ID NO: 1); and
   g) A, G, K, L, R, S, T, or V substituted at an amino acid at a position corresponding to amino acid residue 458 of AAV9 VP1 (SEQ ID NO: 1).

11. The rAAV of claim 10, wherein the amino acid substitution comprises an amino acid sequence selected from the group consisting of LQTSSPG (SEQ ID NO: 2933), QQGKQSV (SEQ ID NO: 79), SINTKTN (SEQ ID NO: 45475), SNGTKQT (SEQ ID NO: 442), GSGKTAA (SEQ ID NO: 88), MGDKPTR (SEQ ID NO: 2466), QPSGGNT (SEQ ID NO: 2672), ERGANTK (SEQ ID NO: 5192), TTGGHSS (SEQ ID NO: 2743), GTTKTSE (SEQ ID NO: 3064), GTGTSVL (SEQ ID NO: 11958), NQSGTKG (SEQ ID NO: 780), KGPGQMG (SEQ ID NO: 45476), and GTPSKAG (SEQ ID NO: 2741).

12. The rAAV of claim 2, wherein the target tissue or the target cell in the tissue is selected from the group consisting of lung, intestine, kidney, heart, and stomach.

13. The rAAV of claim 12, wherein the three or more amino acids comprise three contiguous amino acids at amino acid positions corresponding to amino acid residues 452-454, 453-455, 454-456, 455-457, or 456-458 of AAV9 VP1, wherein:
   a) 452 is selected from the group consisting of N, K, R, and T;
   b) 453 is selected from the group consisting of L, N, P, and S;
   c) 454 is selected from the group consisting of A, D, G, N, S, and T;
   d) 455 is selected from the group consisting of L, P, S, and T;
   e) 456 is selected from the group consisting of P, R, and S;
   f) 457 is selected from the group consisting of G, N, S, and T; and
   g) 458 is selected from the group consisting of I, L, and R.

14. The rAAV of claim 13, wherein the three or more amino acids comprise:
   a) four contiguous amino acids at amino acid positions corresponding to amino acid residues 452-455, 453-456, 454-457, or 455-458 of AAV9 VP1 (SEQ ID NO: 1);
   b) five contiguous amino acids at amino acid positions corresponding to amino acid residues 452-456, 453-457, or 453-458 of AAV9 VP1 (SEQ ID NO: 1);
   c) six contiguous amino acids at amino acid positions corresponding to amino acid residues 452-457 or 453-458 of AAV9 VP1 (SEQ ID NO: 1); and d) seven contiguous amino acids at amino acid positions corresponding to amino acid residues 452-458 of AAV9 VP1 (SEQ ID NO: 1).

15. The rAAV of claim 13, wherein the target tissue is lung, and the three or more amino acids are provided in an amino acid sequence comprising KDNTPGR (SEQ ID NO: 32538), NNLPRNL (SEQ ID NO: 32867), or any amino acid sequence provided in FIG. 13.

16. The rAAV of claim 13, wherein the target tissue is intestine, and the three or more amino acids are provided in an amino acid sequence comprising RESSPSL (SEQ ID NO: 26474), KDNTPGR (SEQ ID NO: 26584), or any amino acid sequence provided in FIG. 5.

17. The rAAV of claim 13, wherein the tissue is kidney, and the three or more amino acids are provided in an amino acid sequence comprising RVPLSTI (SEQ ID NO: 26933), NNLPRNL (SEQ ID NO: 27530), KDNTPGR (SEQ ID NO: 28509), or any amino acid sequence provided in FIG. 6.

18. The rAAV of claim 13, wherein the tissue is heart, and the three or more amino acids are provided in an amino acid sequence comprising KDNTPGR (SEQ ID NO: 25633), or any amino acid sequence provided in FIG. 4.

19. The rAAV of claim 13, wherein the tissue is stomach, and the three or more amino acids are provided in an amino acid sequence comprising RESSPSL (SEQ ID NO: 31904) or any amino acid sequence of FIG. 12.

20. The rAAV of claim 1, wherein the parental AAV capsid protein is AAV9 VP1 or a variant thereof.

21. The rAAV of claim 20, wherein the AAV9 VP1 variant has a sequence identity of 90% or more to SEQ ID NO: 1.

22. The rAAV of claim 20, wherein the AAV9 VP1 variant has a sequence identity of 95% or more to SEQ ID NO: 1.

23. The rAAV of claim 1, wherein the parental AAV capsid protein further comprises an insertion of an amino acid sequence selected from the group consisting of TLAXPFK (SEQ ID NO: 46424), TLAX (SEQ ID NO: 46425), LAVX (SEQ ID NO: 46426), AVPX (SEQ ID NO: 46427), and VPFX (SEQ ID NO: 46428), between amino acids corresponding to positions 588-589 of AAV9 VP1 (SEQ ID NO: 1), wherein X is any amino acid other than V.

24. The rAAV of claim 23, wherein the parental AAV capsid protein is from AAV-PHP.B or AAVPHP.eB.

25. The rAAV of claim 1, wherein the rAAV is isolated and purified.

* * * * *